US007906278B2

(12) United States Patent
Liew et al.

(10) Patent No.: US 7,906,278 B2
(45) Date of Patent: Mar. 15, 2011

(54) DIAGNOSIS OF OSTEOARTHRITIS BY DETERMINATION OF ASPORIN RNA LEVELS

(75) Inventors: Choong-Chin Liew, Toronto (CA); Wayne Marshall, Toronto (CA); Hongwei Zhang, Toronto (CA)

(73) Assignee: Chondrogene, Inc. (CA)

( * ) Notice: Subject to any disclaimer, the term of this patent is extended or adjusted under 35 U.S.C. 154(b) by 390 days.

(21) Appl. No.: 10/242,535

(22) Filed: Sep. 12, 2002

(65) Prior Publication Data

US 2004/0013663 A1    Jan. 22, 2004

Related U.S. Application Data

(63) Continuation-in-part of application No. 10/085,783, filed on Feb. 28, 2002, now Pat. No. 7,432,049.

(60) Provisional application No. 60/305,340, filed on Jul. 13, 2001, provisional application No. 60/275,017, filed on Mar. 12, 2001, provisional application No. 60/271,955, filed on Feb. 28, 2001.

(51) Int. Cl.
*C12Q 1/68* (2006.01)
*C07H 21/04* (2006.01)

(52) U.S. Cl. ........ 435/6; 536/23.5; 536/24.31; 536/25.4

(58) Field of Classification Search ........................ None
See application file for complete search history.

(56) References Cited

U.S. PATENT DOCUMENTS

2001/0051344 A1* 12/2001 Shalon et al. .................... 435/6

FOREIGN PATENT DOCUMENTS

| EP | 0 705 842 A | 4/1996 |
|---|---|---|
| WO | WO 99 32610 A | 7/1999 |
| WO | WO02085285 | 10/2002 |

OTHER PUBLICATIONS

Gebhard et al. Quantification of expression levels of cellular differentiation markers does not support a general shift in the cellular phenotype of osteoarthritic chondrocytes. Journal of Orthopaedic Research, vol. 21, pp. 96-101, 2003.*

Kroese et al. Genetic tests and their evaluation: can we answer the key questions? Genet Med. 2004 vol. 6, No. 6, pp. 475-80, Nov.-Dec. 2004.*
Lorenzo et al (Identification and characterization of asporin-a novel member of the leucine rich repeat family closely related to decorin and biglycan. The Journal of Biological Chemistry, Manuscript M010932200, pp. 1-47, Jan. 10, 2001.*
McAlinden et al. Age-related changes in the synthesis and mRNA expression of decorin and aggrecan in human meniscus and articular cartilage. OsteoArthritis and Cartilage, vol. 9, pp. 33-41, Jan. 2001.*
Kumar, S. et al., (2001), "Identification and initial characterization of 5000 expressed sequenced tags (ESTs) each from adult human normal and osteoarthritic cartilage cDNA libraries," *Osteoarthritis and Cartilage*, 9: 641-653.
Database EMBL Online!, Van Asseldonk et al., *Homo Sapiens Alpha Gene Sequence*, Database accession No. AF203815, XP002243659, Abstract, Jun. 6, 2003.
Andrews J. et al., *Gene Discovery Using Computational and Microarray Analysis of Transcription in the Drosophila Melanogaster Testis. Genome Research*, vol. 10, Dec. 2000, pp. 2030-2043.
Patel I.R. et al., *TNF-Alpha Convertase Enzyme From Human Arthritis—Affected Cartilage: Isolation of cDNA by Differential Display, Expression of the Active enzyme, and Regulation of TNF—Alpha*, The Journal of Immunology, 1998, 160: pp. 4570-4579.
Shukunami et al., *Expression of Cartilage-Specific Functional Matrix Chondromodulin-I mRNA in Rabbit Growth Plate Chondrocytes and Its Responsiveness to Growth Stimuli in Vitro*, Biochemical and Biophysical Research Communication, vol. 249, No. 3, Aug. 28, 1998, pp. 885-890.
Alizadeh A. et al., *The Lymphochip: A Specialized CDNA Microarray for the Genomic-Scale Analysis of Gene Expression in Normal and Malignant Lymphocytes*, Cold Spring Harbor Symposia on Quantitative Biology, vol. 64, No. 1, 1999, pp. 71-78.
Duggan D. J. et al., *Expression Profiling Using cDNA Microarrays*, Nature Genetics, vol. 21, , Jan. 1999, pp. 10-14.

* cited by examiner

*Primary Examiner* — Jennifer Dunston
(74) *Attorney, Agent, or Firm* — Edwards Angell Palmer & Dodge LLP; Kathleen Williams; Amy DeCloux

(57) ABSTRACT

The invention relates to the identification and selection of sequences which demonstrate particular advantage in identifying individuals having osteoarthritis (OA). The invention also provides a selection of sequences particularly useful in diagnosing the degree of advancement of osteoarthritis of an individual and in the identification of novel therapeutic targets for OA. The invention further provides for the use of these sequences as a tool to diagnose disease progression and to monitor the efficacy of therapeutic regimens.

4 Claims, 9 Drawing Sheets

DIAGNOSIS OF OSTEOARTHRITIS BY DETERMINATION OF ASPORIN RNA LEVELS

RELATED APPLICATIONS

The present application is a continuation-in-part of U.S. patent application with Ser. No. 10/085,783, filed Feb. 28, 2002, now U.S. Pat. No. 7,432,049, which claims priority to U.S. Provisional Application Ser. No. 60/305,340; filed Jul. 13, 2001, U.S. Provisional Application Ser. No. 60/275,017, filed Mar. 12, 2001, and U.S. Provisional Application Ser. No. 60/271,955, filed Feb. 28, 2001, each of which is incorporated herein by reference in its entirety.

This application includes a compact disc in duplicate (2 compact discs: Sequence Listing—Copy 1 Replacement Mar. 27, 2010 and Sequence Listing—Copy 2 Replacement Mar. 27, 2010), which are hereby incorporated by reference in their entirety. Each compact disc is identical and contains the following file: Seq listing Mar2010.TXT.

| Disc | DESCRIPTION | SIZE | CREATED | Text File Name | Machine Format and Operating System |
|---|---|---|---|---|---|
| Copy 1 Replacement Mar. 27, 2010 | Sequence Listing | 28.8MB | Mar. 27, 2010 | Seq listing Mar2010.TXT | IBM PC MS-Windows |
| Copy 2 Replacement Mar. 27, 2010 | Sequence Listing | 28.8MB | Mar. 27, 2010 | Seq listing Mar2010.TXT | IBM PC MS-Windows |

This application includes a compact disc in duplicate (2 compact discs: Table 26—Copy 1 and Table 26—Copy 2), which are hereby incorporated by reference in their entirety. Each compact disc is identical and contains the following file: Table26.TXT.

LENGTHY TABLES

The patent contains a lengthy table section. A copy of the table is available in electronic form from the USPTO web site (http://seqdata.uspto.gov/?pageRequest=docDetail&DocID=US07906278B2). An electronic copy of the table will also be available from the USPTO upon request and payment of the fee set forth in 37 CFR 1.19(b)(3).

| Disc | DESCRIPTION | SIZE | CREATED | Text File Name | Machine Format and Operating System |
|---|---|---|---|---|---|
| Copy 1 Replacement Mar. 10, 2009 | Table 26 | 2.67MB | Mar. 10, 2009 | Table26.TXT | IBM PC MS-Windows |
| Copy 2 Replacement Mar. 10, 2009 | Table 26 | 2.67MB | Mar. 10, 2009 | Table26.TXT | IBM PC MS-Windows |

Disc DESCRIPTION SIZE CREATED Text File Name Machine Format and Operating System Copy 1 Replacement IBM PC Mar. 10, 2009 Table 26 2.67 MB Mar. 10, 2009 Table26.TXT MS-Windows Copy 2 Replacement IBM PC Mar. 10, 2009 Table 26 2.67 MB Mar. 10, 2009 Table26.TXT MS-Windows

FIELD OF THE INVENTION

The invention relates to the identification and selection of sequences which demonstrate particular advantage in identifying individuals having osteoarthritis (OA). The invention also provides a selection of sequences particularly useful in diagnosing the degree of advancement of osteoarthritis of an individual and in the identification of novel therapeutic targets for OA. The invention further provides for the use of these sequences as a tool to diagnose disease progression and to monitor the efficacy of therapeutic regimens.

BACKGROUND OF THE INVENTION

Osteoarthritis (OA) is a chronic disease in which the articular cartilage that lies on the ends of bones that forms the articulating surface of the joints gradually degenerates over time. There are many factors that are believed to predispose a patient to osteoarthritis including genetic susceptibility, obesity, accidental or athletic trauma, surgery, drugs and heavy physical demands. Osteoarthritis is initiated by damage to the cartilage of joints. The two most common injuries to joints are sports-related injuries and long term "repetitive use" joint injuries. Joints most commonly affected by osteoarthritis are the knees, hips and hands. In most cases, due to the essential weight-bearing function of the knees and hips, osteoarthritis in these joints causes much more disability than osteoarthritis of the hands. As cartilage degeneration progresses, secondary changes occur in other tissues in and around joints including bone, muscle, ligaments, menisci and synovium. The net effect of the primary failure of cartilage tissue and secondary damage to other tissues is that the patient experiences pain, swelling, weakness and loss of functional ability in the afflicted joint(s). These symptoms frequently progress to the point that they have a significant impact in terms of lost productivity and or quality of life consequences for the patient.

Articular cartilage is predominantly composed of chondrocytes, type II collagen, proteoglycans and water. Articular cartilage has no blood or nerve supply and chondrocytes are the only type of cell in this tissue. Chondrocytes are responsible for manufacturing the type II collagen and proteoglycans that form the cartilage matrix. This matrix in turn has physical-chemical properties that allow for saturation of the matrix with water. The net effect of this structural-functional relationship is that articular cartilage has exceptional wear characteristics and allows for almost frictionless movement between the articulating cartilage surfaces. In the absence of osteoarthritis, articular cartilage often provides a lifetime of pain-free weight bearing and unrestricted joint motion even under demanding physical conditions.

During fetal development, articular cartilage is initially derived from the interzone of mesenchymal condensations. The mesenchymal cells cluster together and synthesize matrix proteins. The tissue is recognized as cartilage when the accumulation of matrix separates the cells, which are spherical in shape and are now called chondrocytes. During cartilage formation and growth, chondrocytes proliferate rapidly and synthesize large volumes of matrix. Prior to skeletal maturity, chondrocytes are at their highest level of metabolic activity. As skeletal maturation is reached, the rate of chondrocyte metabolic activity and cell division declines. After completion of skeletal growth, most chondrocytes do not divide but do continue to synthesize matrix proteins such as collagens, proteoglycans and other noncollagenous proteins (1, 2).

Like all living tissues, articular cartilage is continually undergoing a process of renewal in which "old" cells and matrix components are being removed (catabolic activity) and "new" cells and molecules are being produced (anabolic activity). Relative to most tissues, the rate of anabolic/catabolic turnover in articular cartilage is low. Long-term maintenance of the structural integrity of mature cartilage relies on the proper balance between matrix synthesis and degradation. Chondrocytes maintain matrix equilibrium by responding to chemical and mechanical stimuli from their environment. Appropriate and effective chondrocyte responses to these stimuli are essential for cartilage homeostasis. Disruption of homeostasis through either inadequate anabolic activity or excessive catabolic activity can result in cartilage degradation and osteoarthritis (3). Most tissues that are damaged and have increased catabolic activity are able to mount an increased anabolic response that allows for tissue healing. Unfortunately, chondrocytes have very limited ability to up-regulate their anabolic activity and increase the synthesis of proteoglycan and type II collagen in response to damage or loss of cartilage matrix. This fundamental limitation of chondrocytes is the core problem that has precluded the development of therapies that can prevent and cure osteoarthritis. Additionally, there is a need for a definitive diagnostic test for detecting early osteoarthritis, and a prognostic test that effectively monitors a patient's response to therapy.

Joint pain is the most common manifestation of early osteoarthritis. The pain tends to be episodic lasting days to weeks and remitting spontaneously. Although redness and swelling of joints is uncommon, joints become tender during a flare-up of osteoarthritis.

"Mild" or "early stage osteoarthritis" is difficult to diagnose. The physician relies primarily on the patient's history and physical exam to make the diagnosis of mild osteoarthritis. X-rays do not show the underlying early changes in articular cartilage. There are no recognized biochemical markers used to confirm the diagnosis of early stage osteoarthritis.

X-ray changes confirm the diagnosis of moderate osteoarthritis. X-rays of normal joints reveal well preserved symmetrical joint spaces. Changes seen on the x-rays of patients with osteoarthritis include new bone formation (osteophytes), joint space narrowing and sclerosis (bone thickening). There are no recognized biochemical markers used to confirm the diagnosis of "moderate osteoarthritis" at this stage.

The clinical exam of a joint with severe osteoarthritis reveals tenderness, joint deformity and a loss of mobility. Passive joint movement during examination may elicit crepitus or the grinding of bone-on-bone as the joint moves. X-ray changes are often profound: the joint space may be obliterated and misalignment of the joint can be seen. New bone formation (osteophytes) is prominent. Again, there are no recognized biochemical markers used to confirm the diagnosis of "severe osteoarthritis".

"Osteoarthritis" is the most common chronic joint disease. It is characterized by progressive degeneration and eventual loss of cartilage. Currently, there is a need for an effective therapy that will alter the course of osteoarthritis. Further advances in preventing, modifying or curing the osteoarthritic disease process critically depends, at least in part, on a thorough understanding of the molecular mechanisms underlying anabolic and catabolic processes in cartilage. Since cellular functions are substantially determined by the genes that the cells express, elucidating the genes expressed in articular cartilage at different developmental and disease stages will inevitably provide new insights into the molecules and mechanisms involved in cartilage formation, injury, disease and repair.

cDNA libraries from putatively normal and severely osteoarthritic human cartilage tissue have been constructed (Kumar et al., $46^{th}$ Annual Meeting, Orthopaedic Res. Soc., Abstract, p. 1031). However, this work does not adequately address the differentiation of chondrocyte gene expression from differing severities of osteoarthritic human cartilage (mild, moderate, marked and severe). In addition, the "normal cartilage" samples were obtained from deceased donors more than 24 hours after death. Thus, this cDNA library does not truly reflect normal chondrocyte gene expression due to the rapid degeneration of RNA that occurs after cessation of perfusion to the sampled joint, as demonstrated by baboon studies, presented herein below.

Even upon construction of cDNA libraries from individuals demonstrating differing severities of osteoarthritis, it has been difficult to identify sequences which will be particularly useful in the diagnosis of osteoarthritis. More importantly previous studies have not identified sequences which will be either effective in diagnosing the degree of advancement of osteoarthritis so as to aid in both early detection and treatment, or in identifying novel therapeutic targets.

Even upon construction of cDNA libraries from individuals demonstrating differing severities of osteoarthritis, it has been difficult to identify sequences which will be particularly useful in the diagnosis of osteoarthritis. More importantly previous studies have not identified sequences which will be effective in diagnosing the degree of advancement of osteoarthritis so as to aid in both early detection, and treatment. Additionally previous studies have not identified sequences which will be effective in identifying agents which will be useful in treating osteoarthritis.

SUMMARY OF THE INVENTION

The invention relates to the identification and selection of sequences which demonstrate particular advantage in identifying individuals having osteoarthritis (OA). The invention also provides a selection of sequences particularly useful in diagnosing the degree of advancement of osteoarthritis of an individual and in the identification of novel therapeutic targets for OA. The invention further provides for the use of these sequences as a tool to diagnose disease progression and to monitor the efficacy of therapeutic regimens.

In one aspect, the present invention provides a composition comprising one or more nucleic acid sequences selected from the group consisting of nucleic acids identified in Table 29, Table 33, Table 37, Table 40, Table 44 and Table 48 and whose sequences are disclosed in Table 26. In another aspect, the present invention provides a vector comprising one or more nucleic acid sequences selected from the group consisting of nucleic acids identified in Table 29, Table 33, Table 37, Table 40, Table 44 and Table 48 and whose sequences are disclosed in Table 26.

In yet another aspect, the present invention provides a host cell comprising the vector comprising one or more nucleic acid sequences selected from the group consisting of nucleic acids identified in Table 29, Table 33, Table 37, Table 40, Table 44 and Table 48 and whose sequences are disclosed in Table 26.

In another aspect, the present invention provides an array comprising a plurality of nucleic acid members, and a solid substrate, each nucleic acid member having a unique position on the array and being stably associated with the solid substrate, where at least one member comprises a sequence of a nucleic acid selected from the group consisting of nucleic acids identified in Table 29, Table 33, Table 37, Table 40, Table 44 and Table 48 and whose sequences are disclosed in Table 26.

In another aspect, the present invention provides an array comprising a plurality of nucleic acid members, and a solid substrate, each nucleic acid member having a unique position on the array and being stably associated with the solid substrate, where at least one member comprises a sequence of a nucleic acid selected from the group consisting of nucleic acids identified in Table 29, 33, 40 and 44 and whose sequences are disclosed in Table 26.

In another aspect, the present invention provides an array comprising a plurality of nucleic acid members, and a solid substrate, each nucleic acid member having a unique position on the array and being stably associated with the solid substrate, where at least one member comprises a sequence of a nucleic acid selected from the group consisting of nucleic acids identified in Tables 29, 37 and 40 and 48 and whose sequences are disclosed in Table 26.

In another aspect, the present invention provides an array comprising a plurality of nucleic acid members, and a solid substrate, each nucleic acid member having a unique position on the array and being stably associated with the solid substrate, where at least one member comprises a sequence of a nucleic acid selected from the group consisting of nucleic acids identified in Tables 33 and 44 and whose sequences are disclosed in Table 26.

In another aspect, the present invention provides an array comprising a plurality of nucleic acid members, and a solid substrate, each nucleic acid member having a unique position on the array and being stably associated with the solid substrate, where at least one member comprises a sequence of a nucleic acid selected from the group consisting of nucleic acids identified in Tables 37 and 48 and whose sequences are disclosed in Table 26.

In another aspect, the present invention provides an array comprising a plurality of nucleic acid members, and a solid substrate, each nucleic acid member having a unique position on the array and being stably associated with the solid substrate, where at least one member comprises a sequence of a nucleic acid selected from the group consisting of nucleic acids identified in Tables 29 and 40 and whose sequences are disclosed in Table 26.

In another aspect, the present invention provides an array comprising a plurality of nucleic acid members, and a solid substrate, each nucleic acid member having a unique position on the array and being stably associated with the solid substrate, where at least one member comprises a sequence of a nucleic acid selected from the group consisting of nucleic acids identified in Table 40 and whose sequences are disclosed in Table 26.

In another aspect, the present invention provides an array comprising a plurality of nucleic acid members, and a solid substrate, each nucleic acid member having a unique position on the array and being stably associated with the solid substrate, where at least one member comprises a sequence of a nucleic acid selected from the group consisting of nucleic acids identified in Table 44 and whose sequences are disclosed in Table 26.

In another aspect, the present invention provides an array comprising a plurality of nucleic acid members, and a solid substrate, each nucleic acid member having a unique position on the array and being stably associated with the solid substrate, where at least one member comprises a sequence of a nucleic acid selected from the group consisting of nucleic acids identified in Table 48 and whose sequences are disclosed in Table 26.

In another aspect, the present invention provides an array comprising a plurality of nucleic acid members, and a solid substrate, each nucleic acid member having a unique position on the array and being stably associated with the solid substrate, where at least one member comprises a sequence of a nucleic acid selected from the group consisting of nucleic acids identified in Table 29 and whose sequences are disclosed in Table 26.

In another aspect, the present invention provides an array comprising a plurality of nucleic acid members, and a solid substrate, each nucleic acid member having a unique position on the array and being stably associated with the solid substrate, where at least one member comprises a sequence of a nucleic acid selected from the group consisting of nucleic acids identified in Table 33 and whose sequences are disclosed in Table 26.

In another aspect, the present invention provides an array comprising a plurality of nucleic acid members, and a solid substrate, each nucleic acid member having a unique position on the array and being stably associated with the solid substrate, where at least one member comprises a sequence of a nucleic acid selected from the group consisting of nucleic acids identified in Table 37 and whose sequences are disclosed in Table 26.

In one embodiment, the subject array of the present invention comprises a majority of the nucleic acid members which are selected from the group consisting of nucleic acids identified in Table 29, Table 33, Table 37, Table 40, Table 44 and Table 48 and whose sequences are disclosed in Table 26.

In one embodiment, the subject array of the present invention comprises a majority of the nucleic acid members which are selected from the group consisting of nucleic acids identified in Tables 29, 33, 40 and 44 and whose sequences are disclosed in Table 26.

In another embodiment, the subject array of the present invention comprises a majority of the nucleic acid members which are selected from the group consisting of nucleic acids identified in Tables 29, 37 and 40 and 48 and whose sequences are disclosed in Table 26.

In another embodiment, the subject array of the present invention comprises a majority of the nucleic acid members which are selected from the group consisting of nucleic acids identified in Tables 33 and 44 and whose sequences are disclosed in Table 26.

In another embodiment, the subject array of the present invention comprises a majority of the nucleic acid members which are selected from the group consisting of nucleic acids identified in Tables 37 and 48 and whose sequences are disclosed in Table 26.

In another embodiment, the subject array of the present invention comprises a majority of the nucleic acid members which are selected from the group consisting of nucleic acids identified in Tables 29 and 40 and whose sequences are disclosed in Table 26.

In another embodiment, the subject array of the present invention comprises a majority of the nucleic acid members which are selected from the group consisting of nucleic acids identified in Table 40 and whose sequences are disclosed in Table 26.

In another embodiment, the subject array of the present invention comprises a majority of the nucleic acid members which are selected from the group consisting of nucleic acids identified in Table 44 and whose sequences are disclosed in Table 26.

In another embodiment, the subject array of the present invention comprises a majority of the nucleic acid members which are selected from the group consisting of nucleic acids identified in Table 48 and whose sequences are disclosed in Table 26.

In another embodiment, the subject array of the present invention comprises a majority of the nucleic acid members which are selected from the group consisting of nucleic acids identified in Table 29 and whose sequences are disclosed in Table 26.

In another embodiment, the subject array of the present invention comprises a majority of the nucleic acid members which are selected from the group consisting of nucleic acids identified in Table 33 and whose sequences are disclosed in Table 26.

In another embodiment, the subject array of the present invention comprises a majority of the nucleic acid members which are selected from the group consisting of nucleic acids identified in Table 37 and whose sequences are disclosed in Table 26.

The present invention provides a method for diagnosing osteoarthritis in a patient comprising hybridizing a nucleic acid sample corresponding to RNA to an array comprising a solid substrate and a plurality of nucleic acid members, where at least one member is differentially expressed in cartilage isolated from a patient diagnosed with osteoarthritis, as compared to cartilage isolated from a normal individual, where cartilage isolated from the normal individual is isolated from cartilage tissue less than 14 hours post-mortem, and where each nucleic acid member has a unique position and is stably associated with the solid substrate and at least one member comprises a sequence of a nucleic acid selected from the group consisting of nucleic acids identified in Table 29, Table 33, Table 37, Table 40, Table 44 and Table 48 and whose sequences are disclosed in Table 26, and where hybridization of the nucleic acid sample to one or more the differentially expressed nucleic acid members is indicative of osteoarthritis.

The present invention also provides a method for diagnosing osteoarthritis in a patient comprising hybridizing a nucleic acid sample corresponding to RNA to an array comprising a solid substrate and a plurality of nucleic acid members, where at least one member is differentially expressed in cartilage isolated from a patient diagnosed with osteoarthritis, as compared to cartilage isolated from a normal individual, where cartilage isolated from the normal individual is isolated from cartilage tissue less than 14 hours post-mortem, and where each nucleic acid member has a unique position and is stably associated with the solid substrate and at least one member comprises a sequence of a nucleic acid selected from the group consisting of nucleic acids identified in Table 29 and Table 40 and whose sequences are disclosed in Table 26, and where hybridization of the nucleic acid sample to one or more the differentially expressed nucleic acid members is indicative of osteoarthritis.

The present invention also provides a method for diagnosing osteoarthritis in a patient comprising hybridizing a nucleic acid sample corresponding to RNA to an array comprising a solid substrate and a plurality of nucleic acid members, where at least one member is differentially expressed in cartilage isolated from a patient diagnosed with osteoarthritis, as compared to cartilage isolated from a normal individual, where cartilage isolated from the normal individual is isolated from cartilage tissue less than 14 hours post-mortem, and where each nucleic acid member has a unique position and is stably associated with the solid substrate and at least one member comprises a sequence of a nucleic acid selected from the group consisting of nucleic acids identified in Table 40 and whose sequences are disclosed in Table 26, and where hybridization of the nucleic acid sample to one or more the differentially expressed nucleic acid members is indicative of osteoarthritis.

The present invention also provides a method for diagnosing mild osteoarthritis in a patient comprising hybridizing a nucleic acid sample corresponding to RNA to an array comprising a solid substrate and a plurality of nucleic acid members, where at least one member is differentially expressed in cartilage isolated from a patient diagnosed with mild osteoarthritis, as compared to cartilage isolated from a normal individual, where cartilage isolated from the normal individual is isolated from cartilage tissue less than 14 hours post-mortem, and where each nucleic acid member has a unique position and is stably associated with the solid substrate and at least one member comprises a sequence of a nucleic acid selected from the group consisting of nucleic acids identified in Table 29, Table 33, Table 40, and Table 44 and whose sequences are disclosed in Table 26, and where hybridization of the nucleic acid sample to one or more the differentially expressed nucleic acid members is indicative of mild osteoarthritis.

The present invention also provides a method for diagnosing mild osteoarthritis in a patient comprising hybridizing a nucleic acid sample corresponding to RNA to an array comprising a solid substrate and a plurality of nucleic acid members, where at least one member is differentially expressed in cartilage isolated from a patient diagnosed with mild osteoarthritis, as compared to cartilage isolated from a normal individual, where cartilage isolated from the normal individual is isolated from cartilage tissue less than 14 hours post-mortem, and where each nucleic acid member has a unique position and is stably associated with the solid substrate and at least one member comprises a sequence of a nucleic acid selected from the group consisting of nucleic acids identified in Table 33 and Table 44 and whose sequences are disclosed in Table 26, and where hybridization of the nucleic acid sample to one or more the differentially expressed nucleic acid members is indicative of mild osteoarthritis.

The present invention also provides a method for diagnosing mild osteoarthritis in a patient comprising hybridizing a nucleic acid sample corresponding to RNA to an array comprising a solid substrate and a plurality of nucleic acid members, where at least one member is differentially expressed in cartilage isolated from a patient diagnosed with mild osteoarthritis, as compared to cartilage isolated from a normal individual, where cartilage isolated from the normal individual is isolated from cartilage tissue less than 14 hours post-mortem, and where each nucleic acid member has a unique position and is stably associated with the solid substrate and at least one member comprises a sequence of a nucleic acid selected from the group consisting of nucleic acids identified in Table 44 and whose sequences are disclosed in Table 26, and where hybridization of the nucleic acid sample to one or more the differentially expressed nucleic acid members is indicative of mild osteoarthritis.

The present invention also provides a method for diagnosing mild osteoarthritis in a patient comprising hybridizing a nucleic acid sample corresponding to RNA to an array comprising a solid substrate and a plurality of nucleic acid members, where at least one member is differentially expressed in cartilage isolated from a patient diagnosed with mild osteoarthritis, as compared to cartilage isolated from a normal individual, where cartilage isolated from the normal individual is isolated from cartilage tissue less than 14 hours post-mortem, and where each nucleic acid member has a unique position and is stably associated with the solid substrate and at least one member comprises a sequence of a nucleic acid selected from the group consisting of nucleic acids identified in Table 29 and whose sequences are disclosed in Table 26, and where hybridization of the nucleic acid sample to one or more the differentially expressed nucleic acid members is indicative of mild osteoarthritis.

The present invention also provides a method for diagnosing mild osteoarthritis in a patient comprising hybridizing a nucleic acid sample corresponding to RNA to an array comprising a solid substrate and a plurality of nucleic acid members, where at least one member is differentially expressed in cartilage isolated from a patient diagnosed with mild osteoarthritis, as compared to cartilage isolated from a normal individual, where cartilage isolated from the normal individual is isolated from cartilage tissue less than 14 hours post-mortem, and where each nucleic acid member has a unique position and is stably associated with the solid substrate and at least one member comprises a sequence of a nucleic acid selected from the group consisting of nucleic acids identified in Table 33 and whose sequences are disclosed in Table 26, and where hybridization of the nucleic acid sample to one or more the differentially expressed nucleic acid members is indicative of mild osteoarthritis.

The present invention also provides a method for diagnosing severe osteoarthritis in a patient comprising hybridizing a nucleic acid sample corresponding to RNA to an array comprising a solid substrate and a plurality of nucleic acid members, where at least one member is differentially expressed in cartilage isolated from a patient diagnosed with severe osteoarthritis, as compared to cartilage isolated from a normal individual, where cartilage isolated from the normal individual is isolated from cartilage tissue less than 14 hours post-mortem, and where each nucleic acid member has a unique position and is stably associated with the solid substrate and at least one member comprises a sequence of a nucleic acid selected from the group consisting of nucleic acids identified in Table 29, Table 37, Table 40, and Table 48 and whose sequences are disclosed in Table 26, and where hybridization of the nucleic acid sample to one or more the differentially expressed nucleic acid members is indicative of severe osteoarthritis.

The present invention also provides a method for diagnosing severe osteoarthritis in a patient comprising hybridizing a nucleic acid sample corresponding to RNA to an array comprising a solid substrate and a plurality of nucleic acid members, where at least one member is differentially expressed in cartilage isolated from a patient diagnosed with severe osteoarthritis, as compared to cartilage isolated from a normal individual, where cartilage isolated from the normal individual is isolated from cartilage tissue less than 14 hours post-mortem, and where each nucleic acid member has a unique position and is stably associated with the solid substrate and at least one member comprises a sequence of a nucleic acid selected from the group consisting of nucleic acids identified in Table 37 and Table 48 and whose sequences are disclosed in Table 26, and where hybridization of the nucleic acid sample to one or more the differentially expressed nucleic acid members is indicative of severe osteoarthritis.

The present invention also provides a method for diagnosing severe osteoarthritis in a patient comprising hybridizing a nucleic acid sample corresponding to RNA to an array comprising a solid substrate and a plurality of nucleic acid members, where at least one member is differentially expressed in cartilage isolated from a patient diagnosed with severe osteoarthritis, as compared to cartilage isolated from a normal individual, where cartilage isolated from the normal individual is isolated from cartilage tissue less than 14 hours post-mortem, and where each nucleic acid member has a unique position and is stably associated with the solid substrate and at least one member comprises a sequence of a nucleic acid selected from the group consisting of nucleic acids identified in Table 48 and whose sequences are disclosed in Table 26, and where hybridization of the nucleic acid sample to one or more the differentially expressed nucleic acid members is indicative of severe osteoarthritis.

The present invention also provides a method for diagnosing severe osteoarthritis in a patient comprising hybridizing a nucleic acid sample corresponding to RNA to an array comprising a solid substrate and a plurality of nucleic acid members, where at least one member is differentially expressed in cartilage isolated from a patient diagnosed with severe osteoarthritis, as compared to cartilage isolated from a normal individual, where cartilage isolated from the normal individual is isolated from cartilage tissue less than 14 hours post-mortem, and where each nucleic acid member has a unique position and is stably associated with the solid substrate and at least one member comprises a sequence of a nucleic acid selected from the group consisting of nucleic acids identified in Table 37 and whose sequences are disclosed in Table 26, and where hybridization of the nucleic acid sample to one or more the differentially expressed nucleic acid members is indicative of severe osteoarthritis.

In another embodiment, the invention provides for a kit comprising one or more arrays of the invention.

As another aspect, the present invention provides a method for monitoring efficacy of a drug for the treatment of osteoarthritis comprising hybridizing a nucleic acid sample taken from a first individual treated with the drug to an array comprising a solid substrate and a plurality of nucleic acid members, where each nucleic acid member has a unique position and is stably associated with the solid substrate and at least one member comprises a sequence of a nucleic acid selected from the group consisting of nucleic acids identified in Table 29, Table 33, Table 37, Table 40, Table 44, and Table 48 and whose sequences are disclosed in Table 26, and where one or more the nucleic acid members on the array being differentially expressed in the sample taken from the first individual treated with the drug, compared to a sample taken from a second individual not treated with the drug, is indicative of the efficacy of the drug for the treatment of osteoarthritis.

In one embodiment, when monitoring for drug efficacy in the treatment of osteoarthritis, the array preferably comprises at least one sequence selected from Table 33, Table 37, Table 40 and Table 44, more preferably a majority of sequences selected from Table 33, Table 37, Table 40 and Table 44 are chosen.

In one embodiment, the second individual is an individual prior to the treatment with said drug and the first individual is the same individual as the first individual during or after the treatment with said drug.

In another embodiment, when monitoring for drug efficacy in the treatment of severe osteoarthritis, the array preferably comprises at least one sequence selected from Table 37 and Table 48. More preferably the array comprises a majority of sequences selected from Table 37 and Table 48.

In another embodiment, when monitoring for drug efficacy in the treatment of mild osteoarthritis, the array preferably comprises at least one sequence selected from Table 33 and Table 44. More preferably the array comprises a majority of sequences selected from Table 33 and Table 44.

In some embodiment, the first and second individual in the method of monitoring drug efficacy is the same individual prior to the treatment with the drug and during or after the treatment with the drug.

The present invention also provides a method of identifying an agent that increases or decreases the expression of a nucleic acid sequence that is differentially expressed in a chondrocyte derived from any two or more of the following chondrocyte disease or developmental stages: fetal, mild osteoarthritic, moderate osteoarthritic, marked osteoarthritic and severe osteoarthritic, comprising: incubating a chondrocyte derived from a normal individual with a candidate agent, where the chondrocyte is isolated from a cartilage sample obtained from the normal individual less than 14 hours postmortem; isolating RNA from the chondrocyte; and hybridizing a probe to the RNA, the probe corresponding to a nucleic acid sequence selected from the group consisting of nucleic acids identified in Table 29, Table 33, Table 37, Table 40, Table 44 and Table 48 and whose sequences are disclosed in Table 26, where, as a result of the incubation in the presence of the candidate agent, a change in the level of expression of the nucleic acid sequence as compare to an incubation in the absence of the candidate agent, is indicative of the candidate agent increasing or decreasing the expression of the nucleic acid sequence that is differentially expressed in a chondrocyte derived from any two or more of the following chondrocyte disease or developmental stages: fetal, mild osteoarthritic, moderate osteoarthritic, marked osteoarthritic and severe osteoarthritic.

In one embodiment, the probe in the subject method of identifying an agent that increases or decreases the expression of a nucleic acid sequence that is differentially expressed in a chondrocyte corresponds to a nucleic acid sequence selected from the group consisting of nucleic acids identified in Table 29, Table 33, Table 40, Table 44.

In another embodiment, the probe in the subject method of identifying an agent that increases or decreases the expression of a nucleic acid sequence that is differentially expressed in a chondrocyte corresponds to a nucleic acid sequence selected from the group consisting of nucleic acids identified in Table 29, Table 37, Table 40, and Table 48.

In another embodiment, the probe in the subject method of identifying an agent that increases or decreases the expression of a nucleic acid sequence that is differentially expressed in a chondrocyte corresponds to a nucleic acid sequence selected from the group consisting of nucleic acids identified in Table 33 and Table 44.

In another embodiment, the probe in the subject method of identifying an agent that increases or decreases the expression of a nucleic acid sequence that is differentially expressed in a chondrocyte corresponds to a nucleic acid sequence selected from the group consisting of nucleic acids identified in Tables 37 and 48.

In another embodiment, the probe in the subject method of identifying an agent that increases or decreases the expression of a nucleic acid sequence that is differentially expressed in a chondrocyte corresponds to a nucleic acid sequence selected from the group consisting of nucleic acids identified in Tables 29 and 40.

In another embodiment, the probe in the subject method of identifying an agent that increases or decreases the expression of a nucleic acid sequence that is differentially expressed in a chondrocyte corresponds to a nucleic acid sequence selected from the group consisting of nucleic acids identified in Table 40.

In another embodiment, the probe in the subject method of identifying an agent that increases or decreases the expression of a nucleic acid sequence that is differentially expressed in a chondrocyte corresponds to a nucleic acid sequence selected from the group consisting of nucleic acids identified in Table 44.

In another embodiment, the probe in the subject method of identifying an agent that increases or decreases the expression of a nucleic acid sequence that is differentially expressed in a chondrocyte corresponds to a nucleic acid sequence selected from the group consisting of nucleic acids identified in Table 48.

In another embodiment, the probe in the subject method of identifying an agent that increases or decreases the expression of a nucleic acid sequence that is differentially expressed in a chondrocyte corresponds to a nucleic acid sequence selected from the group consisting of nucleic acids identified in Table 29.

In another embodiment, the probe in the subject method of identifying an agent that increases or decreases the expression of a nucleic acid sequence that is differentially expressed in a chondrocyte corresponds to a nucleic acid sequence selected from the group consisting of nucleic acids identified in Table 33.

In another embodiment, the probe in the subject method of identifying an agent that increases or decreases the expression of a nucleic acid sequence that is differentially expressed in a chondrocyte corresponds to a nucleic acid sequence selected from the group consisting of nucleic acids identified in Table 37.

BRIEF DESCRIPTION OF THE DRAWINGS

The objects and features of the invention can be better understood with reference to the following detailed description and drawings.

DETAILED DESCRIPTION OF THE INVENTION

Figure 1:
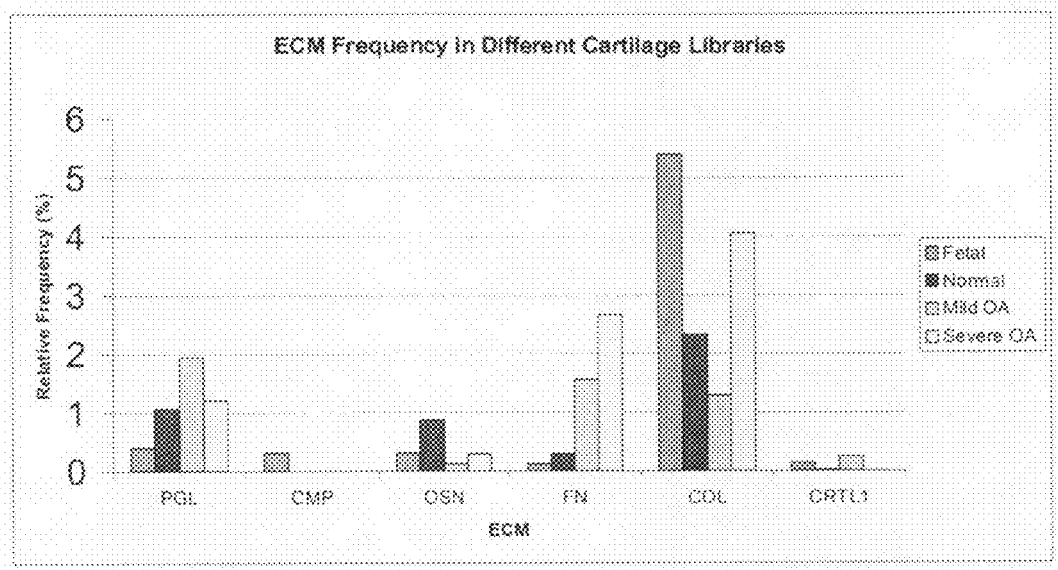
FIG. 1 is a graph according to one embodiment of the invention showing the relative EST frequency level of selected extracellular matrix (ECM) proteins among the fetal, normal, mild osteoarthritic and severe osteoarthritic cartilage cDNA libraries. ESTs per library. Legend: COL=collagen, PGL=proteoglycan, CMP=cartilage matrix proteins, OSN=osteonectin, FN=fibronectin, CRTL 1=cartilage link protein.

The invention relates to methods of profiling gene sequences expressed in human chondrocytes to identify differential gene expression in chondrocytes at different stages of development and disease. Differentially expressed genes and their products (e.g., mRNAs and proteins) can be used in methods for diagnosis, prognosis, screening, or treatment of osteoarthritis.

Definitions

The following definitions are provided for specific terms which are used in the following written description.

As used herein, "osteoarthritis" refers to a chronic disease in which the articular cartilage that lies on the ends of bones that form the articulating surface of the joints gradually degenerates over time. Cartilage degeneration can be caused by an imbalanced catabolic activity (removal of "old" cells and matrix components) and anabolic activity (production of "new" cells and molecules) (Westacott et al., 1996, *Semin Arthritis Rheum*, 25:254-72).

As used herein, "cartilage" or "articular cartilage" refers to elastic, translucent connective tissue in mammals, including human and other species. Cartilage is composed predominantly of chondrocytes, type II collagen, small amounts of other collagen types, other noncollagenous proteins, proteoglycans and water, and is usually surrounded by a perichondrium, made up of fibroblasts, in a matrix of type I and type II collagen as well as other proteoglycans. Although most cartilage becomes bone upon maturation, some cartilage remains in its original form in locations such as the nose, ears, knees, and other joints. The cartilage has no blood or nerve supply and chondrocytes are the only type of cell in this tissue.

As used herein, "chondrocyte" refers to cartilage cells.

As used herein, "synovial fluid" refers to fluid secreted from the "synovial sac" which surrounds each joint. Synovial fluid serves to protect the joint, lubricate the joint and provide nourishment to the articular cartilage. Synovial fluid useful according to the invention contains cells from which RNA can be isolated according to methods well known in the art as described herein.

As used herein, the term "osteoarthritis (OA) staging" or "osteoarthritis (OA) grading" refers to determining the degree of advancement or progression of the disease in the cartilage. In order to classify cartilage into different disease stages, a scoring system is used according to known methods in the art. Preferably the scoring system described in Marshall (Marshall W., 1996, *The Journal of Rheumatology*, 23:582-584, incorporated by reference) is used. According to this method, each of the 6 articular surfaces (patella, femoral trochlea, medial femoral condyle, medial tibial plateau, lateral femoral condyle and lateral tibial plateau) is assigned a cartilage grade based on the worst lesion present on that specific surface. A scoring system is then applied in which each articular surface receives an OA severity number value that reflects the cartilage severity grade for that surface. For example, if the medial femoral condyle has a grade I lesion as its most severe cartilage damage a value of 1 is assigned. A total score for the patient is then derived from the sum of the scores on the 6 articular surfaces. Based on the total score, each patient is placed into one of 40A groups: mild (early) (1-6), moderate (7-12), marked (13-18) and severe (>18).

As used herein, "diagnosis" refers to a process of determining if an individual is afflicted with a disease or ailment. "Diagnosis of OA" or "OA diagnosis", according to the invention, means determining if an individual is afflicted with OA, or, once a patient is diagnosed, determining the OA stage or grade as used herein based on the medical history and physical examination of the patient using methods known in the art (i.e., joint X ray). Preferably, OA stages are measured using the scoring system described by Marshall, supra. "Prognosis of OA" refers to a prediction of the probable occurrence and/or progression of OA in a patient, as well as the likelihood of recovery from OA, or the likelihood of ameliorating symptoms of OA or the likelihood of reversing the effects of OA.

As used herein, "patient" refers to a mammal who is diagnosed with a mild, moderate, marked, or severe form of OA.

As used herein, "normal" refers to an individual who has not shown any OA symptoms or has not been diagnosed with cartilage injury or OA. "Normal", according to the invention, also refers to a sample taken from normal individuals within 14 hours post-mortem. A normal cartilage tissue sample, for example, refers to the whole or a piece of cartilage isolated from cartilage tissue within 14 hours post-mortem from an individual who was not diagnosed with OA and whose corpse does not show any symptoms of OA at the time of tissue removal. In alternative embodiments of the invention, the "normal" cartilage tissue sample is isolated from cartilage tissue less than 14 hours post-mortem, e.g., within 13 hours, 12 hours, 11 hours, 10 hours, 9 hours, 8 hours, 7 hours, 6 hours, 5 hours, 4 hours, 3 hours, 2 hours, or 1 hour post-mortem. In one embodiment of the invention, the "normal" cartilage sample is isolated at 14 hours post-mortem and the integrity of mRNA samples extracted is confirmed.

As used herein, "mRNA integrity" refers to the quality of mRNA extracts from cartilage samples. mRNA extracts with good integrity do not appear to be degraded when examined by methods well known in the art, for example, by RNA agarose gel electrophoresis (e.g., Ausubel et al., John Weley & Sons, Inc., 1997, *Current Protocols in Molecular Biology*). Preferably, the mRNA samples have good integrity (e.g., less than 10%, preferably, less than 5%, and more preferably, less than 1% of the mRNA is degraded) to truly represent the gene expression levels of the cartilage samples from which they are extracted.

As used herein, "fetal" cartilage samples refer to samples taken from a fetus. The chondrocytes of fetal cartilage have a higher level of metabolic activity and cell division rates as compared to chondrocytes from cartilage derived from either a normal adult or from an adult diagnosed with any stage of OA (mild, moderate, marked and severe).

As used herein, "nucleic acid(s)" is interchangeable with the term "polynucleotide(s)" and it generally refers to any polyribonucleotide or poly-deoxyribonucleotide, which may be unmodified RNA or DNA or modified RNA or DNA. "Nucleic acids" include, without limitation, single- and double-stranded nucleic acids. As used herein, the term "nucleic acid(s)" also includes DNAs or RNAs as described above, that contain one or more modified bases. Thus, DNAs or RNAs with backbones modified for stability or for other reasons are "nucleic acids". The term "nucleic acids" as it is used herein embraces such chemically, enzymatically or metabolically modified forms of nucleic acids, as well as the chemical forms of DNA and RNA characteristic of viruses and cells, including for example, simple and complex cells. A "nucleic acid" or "nucleic acid sequence" may also be an expressed sequence tag (EST) according to some embodiments of the invention. An EST is a small part of the expressed sequence of a gene (i.e., the "tag" of a sequence), made from cDNA. An EST can be used to fish the rest of the gene out of the chromosome, by matching base pairs with part of the expressed sequence of the gene.

As used herein, "isolated" or "purified" when used in reference to a nucleic acid means that a naturally occurring sequence has been removed from its normal cellular (e.g., chromosomal) environment or is synthesized in a non-natural environment (e.g., artificially synthesized). Thus, an "isolated" or "purified" sequence may be in a cell-free solution or placed in a different cellular environment. The term "purified" does not imply that the sequence is the only nucleotide present, but that it is essentially free (about 90-95% pure) of non-nucleotide material naturally associated with it, and thus is distinguished from isolated chromosomes.

As used herein, the term "probe" refers to an oligonucleotide which forms a duplex structure with a sequence in the target nucleic acid, due to complementarity of at least one sequence in the probe with a sequence in the target region.

As defined herein, a "nucleic acid array" refers a plurality of unique nucleic acids (or "nucleic acid members") attached to one surface of a solid support at a density exceeding 20 different nucleic acids/cm$^2$ where each of the nucleic acid members is attached to the surface of the solid support in a non-identical pre-selected region. In one embodiment, the nucleic acid member attached to the surface of the solid support is DNA. In a preferred embodiment, the nucleic acid member attached to the surface of the solid support is cDNA. In another preferred embodiment, the nucleic acid member attached to the surface of the solid support is cDNA synthesized by polymerase chain reaction (PCR). Preferably, a nucleic acid member of the array according to the invention is at least 50 nucleotides in length. Preferably, a nucleic acid member of the array is less than 6,000 nucleotides in length. More preferably, a nucleic acid member of the array comprises an array less than 500 nucleotides in length. In one embodiment, the array comprises at least 500 different nucleic acid members attached to one surface of the solid support. In another embodiment, the array comprises at least 10 different nucleic acid members attached to one surface of the solid support. In yet another embodiment, the array comprises at least 10,000 different nucleic acid members attached to one surface of the solid support. In yet another embodiment, the array comprises at least 15,000 different nucleic acid members attached to one surface of the solid support. The term "nucleic acid", as used herein, is interchangeable with the term "polynucleotide".

As used herein, "a plurality of" or "a set of" refers to more than two, for example, 3 or more, 100 or more, or 1000 or more, or 10,000 or more.

As used herein, the term "majority" refers to a number representing more than 50% (e.g., 51%, 60%, or 70%, or 80% or 90% or up to 100%) of the total members of a composition. The term "majority", when referring to an array, it means more than 50% (e.g., 51%, 60%, or 70%, or 80% or 90% or up to 100%) of the total nucleic acid members that are stably associated with the solid substrate of the array.

As used herein, "attaching" or "spotting" refers to a process of depositing a nucleic acid onto a solid substrate to form a nucleic acid array such that the nucleic acid is irreversibly bound to the solid substrate via covalent bonds, hydrogen bonds or ionic interactions.

As used herein, "stably associated" refers to a nucleic acid that is irreversibly bound to a solid substrate to form an array via covalent bonds, hydrogen bonds or ionic interactions such that the nucleic acid retains its unique pre-selected position relative to all other nucleic acids that are stably associated with an array, or to all other pre-selected regions on the solid substrate under conditions in which an array is typically analyzed (i.e., during one or more steps of hybridization, washes, and/or scanning, etc.).

As used herein, "solid substrate" or "solid support" refers to a material having a rigid or semi-rigid surface. The terms "substrate" and "support" are used interchangeably herein with the terms "solid substrate" and "solid support". The solid support may be biological, non-biological, organic, inorganic, or a combination of any of these, existing as particles, strands, precipitates, gels, sheets, tubing, spheres, beads, containers, capillaries, pads, slices, films, plates, slides, chips, etc. Often, the substrate is a silicon or glass surface, (poly) tetrafluoroethylene, (poly)vinylidendifluoride, polystyrene, polycarbonate, a charged membrane, such as nylon 66 or nitrocellulose, or combinations thereof. In a preferred embodiment, the solid support is glass. Preferably, at least one surface of the substrate will be substantially flat. Preferably, the surface of the solid support will contain reactive groups, including, but not limited to, carboxyl, amino, hydroxyl, thiol, and the like. In one embodiment, the surface is optically transparent.

As used herein, "pre-selected region", "predefined region", or "unique position" refers to a localized area on a substrate which is, was, or is intended to be used for the deposit of a nucleic acid and is otherwise referred to herein in the alternative as a "selected region" or simply a "region." The preselected region may have any convenient shape, e.g., circular, rectangular, elliptical, wedge-shaped, etc. In some embodiments, a pre-selected region is smaller than about 1 cm$^2$, more preferably less than 1 mm$^2$, still more preferably less than 0.5 mm$^2$, and in some embodiments less than 0.1 mm$^2$. A nucleic acid member at a "pre-selected region", "predefined region", or "unique position" is one whose identity (e.g., sequence) can be determined by virtue of its position at the region or unique position.

As used herein, a "nucleic acid target" or "a target nucleic acid" is defined as a nucleic acid capable of binding to a nucleic acid member of complementary sequence through one or more types of chemical bonds, usually through complementary base pairing, i.e., through hydrogen bond formation. As used herein, a nucleic acid target may include natural (i.e., A, G, C, or T) or modified bases (7-deazaguanosine, inosine, etc.). In addition, the bases in nucleic acid probe may be joined by a linkage other than a phosphodiester bond, so long as it does not interfere with hybridization (i.e., the probe still specifically binds to its complementary sequence under standard stringent or selective hybridization conditions). Thus, nucleic acid targets may be peptide nucleic acids in which the constituent bases are joined by peptide bonds rather than phosphodiester linkages. Preferably, the nucleic acid targets are derived from human cartilage, blood or synovial fluid extracts. More preferably, the nucleic acid targets are single- or double-stranded DNA, RNA, or DNA-RNA hybrids, from human cartilage, blood or synovial fluid RNA extracts, and preferably from mRNA extracts.

As used herein, a "cartilage nucleic acid sample", refers to nucleic acids derived from cartilage. Preferably, a cartilage nucleic acid sample is RNA or is a nucleic acid corresponding to RNA, for example, cDNA.

As used herein, the term "hybridizing to" or "hybridization" refers to the hydrogen binding with a complementary nucleic acid, via an interaction between for example, a target nucleic acid sequence and a nucleic acid member in an array.

As used herein, "specific hybridization" or "selective hybridization" refers to hybridization which occurs when two nucleic acid sequences are substantially complementary (at least about 65% complementary over a stretch of at least 14 to 25 nucleotides, preferably at least about 75%, more preferably at least about 90% complementary). See Kanehisa, M., 1984, *Nucleic acids Res.*, 12:203, incorporated herein by reference. As a result, it is expected that a certain degree of mismatch is tolerated. Such mismatch may be small, such as a mono-, di- or tri-nucleotide. Alternatively, a region of mismatch can encompass loops, which are defined as regions in which there exists a mismatch in an uninterrupted series of four or more nucleotides. Numerous factors influence the efficiency and selectivity of hybridization of two nucleic acids, for example, a nucleic acid member on a array, to a target nucleic acid sequence. These factors include nucleic acid member length, nucleotide sequence and/or composition, hybridization temperature, buffer composition and potential for steric hindrance in the region to which the nucleic acid member is required to hybridize. A positive correlation exists between the nucleic acid member length and both the efficiency and accuracy with which a nucleic acid member will anneal to a target sequence. In particular, longer sequences have a higher melting temperature ($T_M$) than do shorter ones, and are less likely to be repeated within a given target sequence, thereby minimizing promiscuous hybridization. Hybridization temperature varies inversely with nucleic acid member annealing efficiency, as does the concentration of organic solvents, e.g., formamide, that might be included in a hybridization mixture, while increases in salt concentration facilitate binding. Under stringent annealing conditions, longer nucleic acids, hybridize more efficiently than do shorter ones, which are sufficient under more permissive conditions.

As used herein, the term "differential hybridization" refers to a probe that can hybridize to a same polynucleotide sequence obtained from two or more samples at different levels. A "differential hybridization" means that the ratio of the level of hybridization of the probe to the polynucleotide sequence isolated from one sample as compared to the polynucleotide sequence isolated from another sample is not equal to 1.0. For example, the ratio of the level of hybridization of the probe to the polynucleotide sequence isolated from one sample as compared to the polynucleotide sequence isolated from another sample is greater than or less than 1.0 and includes greater than 1.5 and less than 0.7 greater than 2 and less than 0.5. A differential hybridization also exists if the hybridization is detectable in one sample but not another sample.

As used herein, the term "up regulated" or "increased level of expression" in the context of this invention refers to a sequence which is expressed and which demonstrates an increased level of expression, as can be determined using microarray analysis or other similar analysis, in cartilage isolated from an individual having an identified disease state of osteoarthritis as determined by osteoarthritis staging as compared with cartilage isolated from normal individuals. An "increased level of expression" according to the present invention, is an increase in expression of at least 10% or more, for example, 20%, 30%, 40%, or 50%, 60%, 70%, 80%, 90% or more, or 2-fold, 3-fold, 4-fold, 5-fold, 10-fold, 50-fold, 100-fold or more as measured, for example, by the intensity of hybridization according to methods of the present invention. Up regulated sequences includes sequences having an increased level of expression in cartilage isolated individuals characterized as having mild OA or severe OA as compared with cartilage isolated from normal individuals.

As used herein, the term "down regulated" or "decreased level of expression" in the context of this invention refers to sequences which are expressed and which demonstrate a decreased level of expression, as can be determined using microarray analysis or other similar analysis, in cartilage isolated from cartilage of an individual having an identified disease state of osteoarthritis as determined by osteoarthritis staging as compared with cartilage isolated from normal individuals. An "decreased level of expression" according to the present invention, is a decrease in expression of at least 10% or more, for example, 20%, 30%, 40%, or 50%, 60%, 70%, 80%, 90% or more, or 2-fold, 3-fold, 4-fold, 5-fold, 10-fold, 50-fold, 100-fold or more as measured, for example, by the intensity of hybridization according to methods of the present invention. Down regulated sequences include sequences having a decreased level of expression in cartilage isolated individuals characterized as having mild OA or severe OA as compared with cartilage isolated from normal individuals.

As herein used, the term "standard stringent conditions" means hybridization will occur only if there is at least 95% and preferably, at least 97% identity between the sequences, wherein the region of identity comprises at least 10 nucleotides. In one embodiment, the sequences hybridize under stringent conditions following incubation of the sequences overnight at 42° C., followed by stringent washes (0.2×SSC at 65° C.). As several factors affect the stringency of hybridization, the combination of parameters is more important than the absolute measure of a single factor.

As used herein, the term "level of expression" refers to the measurable expression level of a given nucleic acid. The level of expression of a nucleic acid is determined by methods well known in the art. The term "differentially expressed" or "changes in the level of expression" refers to an increase or decrease in the measurable expression level of a given nucleic acid. As used herein, "differentially expressed" when referring to microarray analysis means the ratio of the level of expression of a given polynucleotide in one sample and the expression level of the given polynucleotide in another sample is not equal to 1.0. "Differentially expressed" when referring to microarray analysis according to the invention also means the ratio of the expression level of a given polynucleotide in one sample and the expression level of the given polynucleotide in another sample where the ratio is greater than or less than 1.0 and includes greater than 1.5 and less than 0.7, as well as greater than 2.0 and less than 0.5. A nucleic acid also is said to be differentially expressed in two samples if one of the two samples contains no detectable expression of the nucleic acid. Absolute quantification of the level of expression of a nucleic acid can be accomplished by including known concentration(s) of one or more control nucleic acid species, generating a standard curve based on the amount of the control nucleic acid and extrapolating the expression level of the "unknown" nucleic acid species from the hybridization intensities of the unknown with respect to the standard curve. The level of expression is measured by hybridization analysis using labeled target nucleic acids according to methods well known in the art. The label on the target nucleic acid can be a luminescent label, an enzymatic label, a radioactive label, a chemical label or a physical label. Preferably, target nucleic acids are labeled with a fluorescent molecule. Preferred fluorescent labels include, but are not limited to: fluorescein, amino coumarin acetic acid, tetramethylrhodamine isothiocyanate (TRITC), Texas Red, Cy3 and Cy5.

As used herein "differentially expressed" when referring to EST analysis refers to the relative expression level of a gene based on the frequency of ESTs representing the gene derived from a cDNA library as compared to the frequency of ESTs representing the same gene derived from another cDNA library. As described herein, the "relative EST frequency" of an EST is calculated by dividing the number of ESTs representing each specific gene by the total number of ESTs analyzed. Differences in "relative EST frequency" may be used as an indication of differential gene expression.

As used herein, the term "significant match", when referring to nucleic acid sequences, means that two nucleic acid sequences exhibit at least 65% identity, at least 70%, at least 75%, at least 80%, at least 85%, and preferably, at least 90% identity, using comparison methods well known in the art (i.e., Altschul, S. F. et al., 1997, *Nucl. Acids Res.*, 25:3389-3402; Schäffer, A. A. et al., 1999, *Bioinformatics* 15:1000-1011). As used herein, "significant match" encompasses non-contiguous or scattered identical nucleotides so long as the sequences exhibit at least 65%, and preferably, at least 70%, at least 75%, at least 80%, at least 85%, and preferably at least 90% identity, when maximally aligned using alignment methods routine in the art.

As used herein, a "novel sequence" or "novel expressed sequence tag (EST)" refers to a nucleic acid sequence which has no significant match to any existing sequence in the "nt", "nr", "est", "gss" and "htg" databases available through NCBI at the time each novel sequence was compared. "No significant match" preferably refers to a less than 65% match between a novel sequence being queried against other sequences in the database, and preferably, a less than 50% match, a less than 40% match, or a less than 30% match, after maximally aligning sequences using methods routine in the art.

As used herein, a "known sequence" refers to a nucleic acid sequence which has significant match to at least one existing sequence in the "nt", "nr", "est", "gss" and "htg" databases available through NCBI. "Known sequence with a function" refers to a nucleic acid with significant match to an existing sequence which encodes a polypeptide with a known function. "Known sequence with no function" refers to a nucleic acid that exhibits a significant match to an existing sequence which encodes a polypeptide of unknown function.

As used herein, a "chondrocyte-specific nucleic acid" is a nucleic acid sequence which is expressed at a detectable level in a chondrocyte and is not expressed at a detectable level in any other cell types as indicated by having no significant match to any sequence in any of the available databases comprising sequences from other cell types.

As used herein, a "chondrocyte enriched nucleic acid" or "chondrocyte enriched sequence" refers to a sequence which is differentially expressed in chondrocytes as compared to non-chondrocytes.

As used herein, "indicative of disease" refers to an expression pattern which is diagnostic of disease such that the expression pattern is found significantly more often in patients with a disease than in patients without the disease (as determined using routine statistical methods setting confidence levels at 95%). Preferably, an expression pattern which is indicative of disease is found in at least 70% of patients who have the disease and is found in less than 10% of patients who do not have the disease. More preferably, an expression pattern which is indicative of disease is found in at least 75%, at least 80%, at least 85%, at least 90%, at least 95% or more in patients who have the disease and is found in less than 10%, less than 8%, less than 5%, less than 2.5%, or less than 1% of patients who do not have the disease.

As used herein, a "gene expression pattern" or "gene expression profile" comprises the pattern of expression of one or more of a set of nucleic acid sequences where one or more members of the set are differentially expressed.

As used herein, "a nucleic acid array expression profile" is generated from the hybridization of nucleic acids derived from a sample to one or more nucleic acid members comprising an array according to the invention.

As used herein, a "therapeutic agent" or "agent" refers to a compound that increases or decreases the expression of a polynucleotide sequence that is differentially expressed in a chondrocyte from any two of the following developmental or osteoarthritis disease stages: (a) fetal, (b) mild, (c) moderate, (d) marked and (e) severe, or (f) chondrocyte from a normal individual, as defined herein. A therapeutic agent according to the invention also refers to a compound that increases or decreases the anabolic activity of a chondrocyte. The invention provides for a "therapeutic agent" that 1) prevents the onset of osteoarthritis; 2) reduces, delays, or eliminates osteoarthritis symptoms such as pain, swelling, weakness and loss of functional ability in the afflicted joints; 3) reduces, delays, or eliminates cartilage degeneration, and/or enhances chondrocyte metabolic activity and cell division rates; and/or 4) restores one or more expression profiles of one or more disease-indicative nucleic acids of a patient to a profile more similar to that of a normal individual when administered to a patient.

As used herein, the term "drug efficacy" refers to the effectiveness of a drug. "Drug efficacy" is usually measured by the clinical response of the patient who has been or is being treated with a drug. A drug is considered to have a high degree of efficacy, if it achieves desired clinical results, for example, the reduction of the symptoms of osteoarthritis or the prevention of osteoarthritis progression as described in the present specification. The amount of drug absorbed may be used to predict a patient's response. A general rule is that as the dose of a drug is increased, a greater effect is seen in the patient until a maximum desired effect is reached. If more drug is administered after the maximum point is reached, the side effects will normally increase.

Identifying Chondrocyte Enriched and Chondrocyte-Specific Polynucleotide Sequences cDNA libraries were constructed from human fetal, normal, mild osteoarthritic and severe osteoarthritic cartilage samples. The known and novel clones derived from these libraries were then used to construct human chondrocyte-specific microarrays to generate differential gene expression profiles useful as a diagnostic tool for detection of mild (early stage) osteoarthritis. Arrays of the invention are useful as a gold standard for osteoarthritis diagnosis and for use to identify and monitor therapeutic efficacy of new drug targets.

One effective and rapid way of characterizing gene expression patterns in a given tissue is through large-scale partial sequencing of a cDNA library produced from such a tissue to generate expressed sequence tags (ESTs). This approach has provided both quantitative and qualitative information on gene expression in a variety of tissues and cells (4-7). Since cDNA libraries represent gene transcription in the cells of the tissue used to construct the library, gene expression profiles generated by random sampling and sequencing is used for detailed genetic-level comparison between developmental, normal and pathological states of the tissue examined.

Many human genes are expressed at different levels in cartilage of different developmental (fetal vs. mature) or disease states. In some cases, a gene is not expressed at all in some developmental or disease states, and at high levels in others (see Tables 13, 27 and 28 for examples). According to the invention, differential analysis of chondrocyte gene expression during different stages of cartilage developmental and in different disease states using an EST-based approach has identified genes that play important roles in osteoarthritis pathogenesis and cartilage repair. The advantage of this method is that it provides gene expression information on a larger scale than other methods. The cDNA clones generated by this approach are also useful for functional studies of certain genes. This type of genomic-based approach has provided important novel insights into our understanding of the osteoarthritis disease process and provides for novel diagnostic, prognostic and therapeutic approaches.

Samples

Cartilage

In one aspect, cartilage is obtained from a fetus using methods known in the art. The chondrocytes of fetal cartilage have a higher level of metabolic activity and cell division rates as compared to chondrocytes from cartilage from either a normal adult or from an individual diagnosed with any stage of osteoarthritis (mild, moderate, marked and severe).

In another aspect, cartilage is obtained from a normal individual who is alive or is obtained from cartilage tissue less than 14 hours post mortem, according to methods known in the art and described below. Normal articular cartilage from human adults are obtained using any known method. However, truly normal cartilage cannot generally be sampled from live donors due to ethical considerations. Preferably, normal cartilage samples are obtained from deceased donors, within a fourteen-hour post-mortem window after cessation of perfusion to the sampled joint, to minimize the degradation of RNA observed beyond the window. In other embodiments, the "normal" tissue is obtained less than 14 hours post-mortem, such as 13, 12, 11, 10, 9, 8, 6, 4, 2, or 1 hour post-mortem. A baboon study was conducted to confirm this approach and is described herein below in Example 11. Preferably the normal cartilage is obtained less than 14 hours post-mortem. More preferably, the normal cartilage is obtained less than 12 hours post-mortem.

Preferably, cartilage also is isolated from the following disease stages of osteoarthritis: mild, marked, moderate and severe. Human cartilage samples from osteoarthritic individuals are obtained using any known method. Preferably the cartilage is obtained from individuals undergoing arthroscopy or total knee replacements and samples are stored in liquid nitrogen until needed. In a preferred embodiment, a minimum of 0.05 g of cartilage sample is isolated to obtain 2 μg total RNA extract for the construction of a cDNA library. In another preferred embodiment, a minimum of 0.025 g cartilage sample is isolated to obtain 1 μg total RNA extract to use as a target sample for a microarray. A cartilage sample that is useful according to the invention is in an amount that is sufficient for the detection of one or more nucleic acid sequences according to the invention.

Blood and Synovial Fluid

Samples useful according to the invention also include blood and synovial fluid samples.

In one aspect, blood is obtained from a normal patient or from an individual diagnosed with, or suspected of having, osteoarthritis according to methods of phlebotomy well known in the art. A blood sample useful according to the invention is in an amount ranging from 1 μl to 100 ml, preferably 10 μl to 50 ml, more preferably 10 μl to 25 ml and most preferably 10 μl to 1 ml. A blood sample that is useful according to the invention is in an amount that is sufficient for the detection of one or more nucleic acid sequences according to the invention. In one embodiment, nucleic acids contained within the blood sample are amplified, for example, by polymerase chain reaction (PCR) or by RT-PCR. Other amplification methods known in the art are also encompassed within the scope of the invention (e.g., ligase chain reaction, NASBA, 3SR, and the like).

A synovial fluid sample is obtained from an individual diagnosed with, or suspected of having osteoarthritis according to methods well known in the art. Preferably, synovial fluid is collected from a human knee joint by aspiration at arthroscopy. A synovial fluid sample useful according to the invention is in an amount ranging from 0.1 ml to 20 ml and preferably 0.5 ml to 10 ml. A synovial fluid sample that is useful according to the invention is in an amount that is sufficient for the detection of one or more nucleic acid sequences according to the invention.

Developmental and Disease Stages of Articular Cartilage

Chondrocytes are preferably obtained from any of the following developmental and disease stages: fetal, normal, mild osteoarthritic, moderate osteoarthritic, marked osteoarthritic or severe osteoarthritic.

Cartilage isolated from a human fetus (e.g., during fetal development) is characterized above, and is useful according to the invention for analysis of fetal chondrocytes.

Cartilage isolated from a "normal" individual, defined herein, also is useful according to the invention for isolation and analysis of "normal" chondrocytes.

Cartilage isolated from a patient diagnosed with any one of: mild, moderate, marked and severe osteoarthritis also is useful in the present invention.

In order to classify cartilage according to disease state, a scoring system is used, whereby subjective decisions by the arthroscopist are minimized. The scoring system which defines disease states described herein is that of Marshall, supra, incorporated herein by reference. According to this method, each of the 6 articular surfaces (patella, femoral trochlea, medial femoral condyle, medial tibial plateau, lateral femoral condyle and lateral tibial plateau) is assigned a cartilage grade based on the worst lesion present on that specific surface. A scoring system is then applied in which each articular surface receives an osteoarthritis severity number value that reflects the cartilage severity grade for that surface, as described in Table 1.

TABLE 1

Articular Cartilage Grading System

| Grade | Articular Cartilage | Points |
|---|---|---|
| 0 | Normal | 0 |
| I | Surface intact-softening, edema | 1 |
| II | Surface-disrupted-partial thickness lesions (no extension to bone) | 2 |
| III | Full thickness lesions-extensions to intact bone | 3 |
| IV | Bone erosion or eburnation | 4 |

For example, if the medial femoral condyle has a grade I lesion as its most severe cartilage damage, a value of 1 is assigned. A total score for the patient is then derived from the sum of the scores of the 6 articular surfaces. Based on the total score, each patient is placed into one of 4 osteoarthritis groups: mild (1-6), moderate (7-12), marked (13-18) and severe (>18).

RNA Preparation

In one aspect, RNA is isolated from cartilage samples from various disease or developmental stages as described herein. Samples can be from single patients or can be pooled from multiple patients.

In another aspect, RNA is isolated directly from synovial fluid of persons with various disease or developmental stages of osteoarthritis as described herein. Samples can be from single patients or can be pooled from multiple patients.

In another aspect, RNA is isolated directly from blood samples of persons with various disease or developmental stages of osteoarthritis as described herein. Samples can be from single patients or can be pooled from multiple patients.

Total RNA is extracted from the cartilage samples according to methods well known in the art. In one embodiment, RNA is purified from cartilage tissue according to the following method. Following removal of a tissue of interest from an individual or patient, the tissue is quick frozen in liquid nitrogen, to prevent degradation of RNA. Upon the addition of a volume of tissue guanidinium solution, tissue samples are ground in a tissuemizer with two or three 10-second bursts. To prepare tissue guanidinium solution (1 L) 590.8 g guanidinium isothiocyanate is dissolved in approximately 400 ml DEPC-treated $H_2O$. 25 ml of 2 M Tris-Cl, pH 7.5 (0.05 M final) and 20 ml $Na_2EDTA$ (0.01 M final) is added, the solution is stirred overnight, the volume is adjusted to 950 ml, and 50 ml 2-ME is added.

Homogenized tissue samples are subjected to centrifugation for 10 min at 12,000×g at 12° C. The resulting supernatant is incubated for 2 min at 65° C. in the presence of 0.1 volume of 20% Sarkosyl, layered over 9 ml of a 5.7M CsCl solution (0.1 g CsCl/ml), and separated by centrifugation overnight at 113,000×g at 22° C. After careful removal of the supernatant, the tube is inverted and drained. The bottom of the tube (containing the RNA pellet) is placed in a 50 ml plastic tube and incubated overnight (or longer) at 4° C. in the presence of 3 ml tissue resuspension buffer (5 mM EDTA, 0.5% (v/v) Sarkosyl, 5% (v/v) 2-ME) to allow complete resuspension of the RNA pellet. The resulting RNA solution is extracted sequentially with 25:24:1 phenol/chloroform/isoamyl alcohol, followed by 24:1 chloroform/isoamyl alcohol, precipitated by the addition of 3 M sodium acetate, pH 5.2, and 2.5 volumes of 100% ethanol, and resuspended in DEPC water (Chirgwin et al., 1979, *Biochemistry*, 18:5294).

Alternatively, RNA is isolated from cartilage tissue according to the following single step protocol. The tissue of interest is prepared by homogenization in a glass teflon homogenizer in 1 ml denaturing solution (4M guanidinium thiosulfate, 25 mM sodium citrate, pH 7.0, 0.1 M 2-ME, 0.5% (w/v) N-laurylsarkosine) per 100 mg tissue. Following transfer of the homogenate to a 5-ml polypropylene tube, 0.1 ml of 2 M sodium acetate, pH 4, 1 ml water-saturated phenol, and 0.2 ml of 49:1 chloroform/isoamyl alcohol are added sequentially. The sample is mixed after the addition of each component, and incubated for 15 min at 0-4° C. after all components have been added. The sample is separated by centrifugation for 20 min at 10,000×g, 4° C., precipitated by the addition of 1 ml of 100% isopropanol, incubated for 30 minutes at −20° C. and pelleted by centrifugation for 10 minutes at 10,000×g, 4° C. The resulting RNA pellet is dissolved in 0.3 ml denaturing solution, transferred to a microfuge tube, precipitated by the addition of 0.3 ml of 100% isopropanol for 30 minutes at −20° C., and centrifuged for 10 minutes at 10,000×g at 4° C. The RNA pellet is washed in 70% ethanol, dried, and resuspended in 100-200 μl DEPC-treated water or DEPC-treated 0.5% SDS (Chomczynski and Sacchi, 1987, *Anal. Biochem.*, 162: 156).

Preferably, the cartilage samples are finely powdered under liquid nitrogen and total RNA is extracted using TRIzol® reagent (GIBCO/BRL).

Alternatively, RNA is isolated from blood by the following protocol. Lysis Buffer is added to blood sample in a ratio of 3 parts Lysis Buffer to 1 part blood (Lysis Buffer (1 L) 0.6 g EDTA; 1.0 g $KHCO_2$, 8.2 g $NH_4Cl$ adjusted to pH 7.4 (using NaOH)). Sample is mixed and placed on ice for 5-10 minutes until transparent. Lysed sample is centrifuged at 1000 rpm for 10 minutes at 4° C., and supernatant is aspirated. Pellet is resuspended in 5 ml Lysis Buffer, and centrifuged again at 1000 rpm for 10 minutes at 4° C. Pelleted cells are homogenized using TRIzol® (GIBCO/BRL) in a ratio of approximately 6 ml of TRIzol® for every 10 ml of the original blood sample and vortexed well. Samples are left for 5 minutes at room temperature. RNA is extracted using 1.2 ml of chloroform per 1 ml of TRIzol®. Sample is centrifuged at 12,000×g for 5 minutes at 4° C. and upper layer is collected. To upper layer, isopropanol is added in ratio of 0.5 ml per 1 ml of TRIzol®. Sample is left overnight at −20° C. or for one hour at −20° C. RNA is pelleted in accordance with known methods, RNA pellet air dried, and pellet resuspended in DEPC treated $ddH_2O$. RNA samples can also be stored in 75% ethanol where the samples are stable at room temperature for transportation.

Alternatively, RNA is isolated from synovial fluid using TRIzol® reagent (GIBCO/BRL).

Purity and integrity of RNA is assessed by absorbance at 260/280 nm and agarose gel electrophoresis followed by inspection under ultraviolet light.

Construction of cDNA Libraries cDNA libraries are constructed according to methods well known in the art (see for example Ausubel, supra, and Sambrook, supra, incorporated herein by reference).

In one aspect, cDNA samples, i.e., DNA that is complementary to RNA such as mRNA are prepared. The preparation of cDNA is well-known and well-documented in the prior art.

cDNA may be prepared according to the following method. Total cellular RNA is isolated (as described) and passed through a column of oligo(dT)-cellulose to isolate polyA RNA. The bound polyA mRNAs are eluted from the column with a low ionic strength buffer. To produce cDNA molecules, short deoxythymidine oligonucleotides (12-20 nucleotides)

are hybridized to the polyA tails to be used as primers for reverse transcriptase, an enzyme that uses RNA as a template for DNA synthesis. Alternatively, or additionally, mRNA species are primed from many positions by using short oligonucleotide fragments comprising numerous sequences complementary to the mRNA of interest as primers for cDNA synthesis. The resultant RNA-DNA hybrid is converted to a double stranded DNA molecule by a variety of enzymatic steps well-known in the art (Watson et al., 1992, *Recombinant DNA*, 2nd edition, Scientific American Books, New York).

To construct a cDNA library, the poly (A)⁺ RNA fraction may be isolated by oligo-dT cellulose chromatography (Pharmacia), and 3-5 ug poly (A)⁺ RNA is used to construct a cDNA library in the λ ZAP Express vector (Stratagene). Alternatively, cDNA libraries may be constructed into λTriplEx2 vector through a PCR-based method, using SMART (Switching Mechanism At 5' end of RNA Transcript) cDNA Library Construction Kit (Clontech). First-strand cDNA is synthesized with an Xho I-oligo (dT) adapter-primer in the presence of 5'-methyl dCTP. After second-strand synthesis and ligation of EcoRI adapters, the cDNAs are digested with Xho I, resulting in cDNA flanked by EcoRI sites at the 5'-ends and Xho I sites at the 3' ends. Digested cDNAs are size-fractionated in Sephacryl S-500 spin columns (Stratagene), then ligated into the λ ZAP Express vector predigested with EcoRI and Xho I. The resulting DNA/cDNA concatomers are packaged using Gigapack Gold packaging extracts. After titration, aliquots of primary packaging mix are stored in 7% DMSO at −80° C. as primary library stocks, and the rest are amplified to establish stable library stocks.

From the amplified library, phage plaques are plated onto an appropriate medium. Preferably, phage plaques are plated at a density of 200-500 pfu/150 mm plate onto an *Escherichia coli* XL1-blue MRF' lawn with IPTG/X-gal for color selection. The plaques are then randomly picked and positive inserts are identified by polymerase chain reaction (PCR), according to methods well known in the art and described hereinbelow. Preferably, plaques are picked into 75 ul suspension media buffer (100 mM NaCl, 10 mM MgSO₄, 1 mM Tris, pH7.5, 0.02% gelatin). Phage elutes (5 ul) may be used for PCR reactions (50 ul total volume) with 125 umol/L of each dNTP (Pharmacia), 10 pmol each of modified T3 (5'-GCCAAGCTCGAAATTAACCCTCACTAAAGGG-3') (SEQ ID NO: 58,993) and T7 (5'-CCAGTGAATTG-TAATACGACTCACTATAGGGCG-3') (SEQ ID NO: 58,994) primers, and 2 U of Taq DNA polymerase (Pharmacia). Reactions are cycled in a DNA Thermal Cycler (Perkin-Elmer) [denaturation at 95° C. for 5 minutes, followed by 30 cycles of amplification (94° C., 45 seconds; 55° C., 30 seconds; 72° C., 3 minutes) and a terminal isothermal extension (72° C., 3 minutes)]. Agarose gel electrophoresis is used to assess the presence and purity of inserts.

The PCR product is then subjected to DNA sequencing using known methods (see Ausubel et al., supra and Sambrook et al., supra). Methods of sequencing employ such enzymes as the Klenow fragment of DNA polymerase I, Sequenase® (US Biochemical Corp, Cleveland, Ohio), Taq polymerase (Perkin Elmer, Norwalk, Conn.), thermostable T7 polymerase (Amersham, Chicago, Ill.), or combinations of recombinant polymerases and proofreading exonucleases such as the ELONGASE Amplification System (Gibco BRL, Gaithersburg, Md.). Preferably, the process is automated with machines such as the Hamilton Micro Lab 2200 (Hamilton, Reno Nev.), Peltier Thermal Cycler (PTC200; MJ Research, Watertown, Mass.), the ABI 377 DNA sequencers (Perkin Elmer), and the PE Biosystems ABI Prism 3700 DNA Analyzer.

PCR products are first subjected to DNA sequencing reactions using specific primers, BigDye™ Terminator Cycle Sequencing v2.0 Ready Reaction (PE Biosystems), Tris MgCl buffer and water in a thermocycler. Sequencing reactions were incubated at 94° C. for 2 minutes, followed by 25 cycles of 94° C., 30 seconds; 55° C., 20 seconds; and 72° C., 1 minute; and 15 cycles of 94° C., 30 seconds; and 72° C. for 1 minute; and 72° C. for 5 minutes. Reactions were then put on hold at 4° C. until purified using methods well known in the prior art (i.e. alcohol precipitation or ethanol precipitation). Automated sequencing is preferably carried out with a PE Biosystems ABI Prism 3700 DNA Analyzer.

PCR

In one aspect, nucleic acid sequences of the invention are amplified by the polymerase chain reaction (PCR). PCR methods are well-known to those skilled in the art.

PCR provides a method for rapidly amplifying a particular nucleic acid sequence by using multiple cycles of DNA replication catalyzed by a thermostable, DNA-dependent DNA polymerase to amplify the target sequence of interest. PCR requires the presence of a nucleic acid to be amplified, two single-stranded oligonucleotide primers flanking the sequence to be amplified, a DNA polymerase, deoxyribonucleoside triphosphates, a buffer and salts.

The method of PCR is well known in the art. PCR, is performed as described in Mullis and Faloona, 1987, *Methods Enzymol.*, 155: 335, herein incorporated by reference.

PCR is performed using template DNA (at least 1 fg; more usefully, 1-1000 ng) and at least 25 pmol of oligonucleotide primers. A typical reaction mixture includes: 2 μl of DNA, 25 pmol of oligonucleotide primer, 2.5 μl of 10H PCR buffer 1 (Perkin-Elmer, Foster City, Calif.), 0.4 μl of 1.25 μM dNTP, 0.15 μl (or 2.5 units) of Taq DNA polymerase (Perkin Elmer, Foster City, Calif.) and deionized water to a total volume of 25 μl. Mineral oil is overlaid and the PCR is performed using a programmable thermal cycler.

The length and temperature of each step of a PCR cycle, as well as the number of cycles, are adjusted according to the stringency requirements in effect. Annealing temperature and timing are determined both by the efficiency with which a primer is expected to anneal to a template and the degree of mismatch that is to be tolerated. The ability to optimize the stringency of primer annealing conditions is well within the knowledge of one of moderate skill in the art. An annealing temperature of between 30° C. and 72° C. is used. Initial denaturation of the template molecules normally occurs at between 92° C. and 99° C. for 4 minutes, followed by 20-40 cycles consisting of denaturation (94-99° C. for 15 seconds to 1 minute), annealing (temperature determined as discussed above; 1-2 minutes), and extension (72° C. for 1 minute). The final extension step is generally carried out for 4 minutes at 72° C., and may be followed by an indefinite (0-24 hour) step at 4° C.

Several techniques for detecting PCR products quantitatively without electrophoresis may be useful according to the invention. One of these techniques, for which there are commercially available kits such as Taqman™ (Perkin Elmer, Foster City, Calif.), is performed with a transcript-specific antisense probe. This probe is specific for the PCR product (e.g. a nucleic acid fragment derived from a gene) and is prepared with a quencher and fluorescent reporter probe complexed to the 5' end of the oligonucleotide. Different fluorescent markers are attached to different reporters, allowing for measurement of two products in one reaction. When Taq DNA polymerase is activated, it cleaves off the fluorescent reporters of the probe bound to the template by virtue of its 5'-to-3' exonuclease activity. In the absence of the quenchers, the reporters now fluoresce. The color change in the reporters is proportional to the amount of each specific product and is measured by a fluorometer; therefore, the amount of each color is measured and the PCR product is quantified. The PCR reactions are performed in 96 well plates so that samples derived from many individuals are processed and measured simultaneously. The Taqman™ system has the additional advantage of not requiring gel electrophoresis and allows for quantification when used with a standard curve.

Nucleic acid Sequences Useful According to the Invention

The invention provides for isolated nucleic acid sequences including ESTs which can be used as probes, arrayed on microarrays, and/or used for the development of therapies to treat osteoarthritis.

In one aspect, cartilage gene expression profiles at different developmental stages are identified. Another aspect of the invention is to monitor cartilage gene expression profiles of osteoarthritis patients diagnosed with different stages of osteoarthritis. A third aspect of the invention is to screen for potential therapeutic agents which alter the gene expression profile of diseased cartilage cells. The invention therefore provides for nucleic acid sequences that are present at each of the following developmental and disease stages: normal, fetal, mild osteoarthritic, moderate osteoarthritic, marked osteoarthritic and severe osteoarthritic. The invention also provides for nucleic acid sequences that are differentially expressed in any two of the following developmental and disease stages: normal, fetal, mild osteoarthritic, moderate osteoarthritic, marked osteoarthritic and severe osteoarthritic.

Nucleic acids useful according to the invention are prepared by isolating cartilage tissue samples from a developmental or disease stage (normal, fetal, mild osteoarthritic, moderate osteoarthritic, marked osteoarthritic and severe osteoarthritic), preparing a cDNA library (as described above), and performing large-scale partial sequencing (described herein) of the cDNA library to generate Expressed Sequence Tags (ESTs). An EST useful according to the invention is preferably in the range of 50-1000 nucleotides and most preferably 50-500 nucleotides in length.

The invention provides for nucleic acid sequences or ESTs that are categorized as "novel" or "known", including "known sequences with a function" and "known sequences without a known function", all defined herein.

Nucleic Acid Members and Probes

In one aspect, the invention provides nucleic acid members and probes that bind specifically to a target nucleic acid sequence (e.g., present in a cartilage nucleic acid sample).

Nucleic acid members are stably associated with a solid support to comprise an array according to the invention. The length of a nucleic acid member can range from 50 to 6000 nucleotides, 100 to 500 nucleotides, and in other embodiments, from 500 to 1500 nucleotides. The nucleic acid members may be single or double stranded, and/or may be PCR fragments amplified from cDNA.

The invention also provides for nucleic acid sequences comprising a probe. In a certain embodiment, a probe is labeled, according to methods known in the art. A probe according to the invention is 50 to 5000 nucleotides, more preferably 100-500 nucleotides and most preferably 50 to 250 nucleotides in length. The probe may be single or double stranded, and may be a PCR fragment amplified from cDNA.

The nucleic acid members and probes according to the invention can be used to detect target sequences such as chondrocyte enriched or chondrocyte-specific sequences, and preferably sequences whose presence in a sample are indicative, or diagnostic or prognostic, of a stage of osteoarthritis.

The target nucleic acid sequences to be analyzed are preferably from human cartilage, blood or synovial fluid and preferably comprise RNA or nucleic acid corresponding to RNA, (i.e., cDNA or amplified products of RNA or cDNAs).

Data Acquisition and Analysis of EST Sequences

The invention provides for EST sequences including "novel sequences", "novel expressed sequence tags (ESTs)" and "known sequences" including "known sequences with a function" and "known sequences with no known function".

The generated EST sequences are searched against available databases, including the "nt", "nr", "est", "gss" and "htg" databases available through NCBI to determine putative identities for ESTs matching to known genes or other ESTs. Relative EST frequency level can then be calculated using known methods. Functional characterization of ESTs with known gene matches are made according to any known method. Preferably, generated EST sequences are compared to the non-redundant Genbank/EMBL/DDBJ and dbEST databases using the BLAST algorithm (8). A minimum value of $P=10^{-10}$ and nucleotide sequence identity >95%, where the sequence identity is non-contiguous or scattered, are required for assignments of putative identities for ESTs matching to known genes or to other ESTs. Construction of a non-redundant list of genes represented in the EST set is done with the help of Unigene, Entrez and PubMed at the National Center for Biotechnology Information (NCBI) site (at www.ncbi.nlm.nih.gov/). Relative gene expression frequency is calculated by dividing the number of EST copies for each gene by the total number of ESTs analyzed.

Genes are identified from ESTs according to known methods. To identify novel genes from an EST sequence, the EST should preferably be at least 100 nucleotides in length, and more preferably 150 nucleotides in length, for annotation. Preferably, the EST exhibits open reading frame characteristics (i.e., can encode a putative polypeptide).

Because of the completion of the Human Genome Project, a specific EST which matches with a genomic sequence can be mapped onto a specific chromosome based on the chromosomal location of the genomic sequence. However, no function may be known for the protein encoded by the sequence and the EST would then be considered "novel" in a functional sense. In one aspect, the invention is used to identify a novel EST which is part of a larger known sequence for which no function is known is used to determine the function of a gene comprising the EST (e.g., such as the role of expression products produced by the gene in chondrogenesis and/or in a pathology affecting chondrocytes). Alternatively, or additionally, the EST can be used to identify an mRNA or polypeptide encoded by the larger sequence as a diagnostic or prognostic marker of chondrogenesis and/or of a pathology affecting chondrocytes.

Having identified an EST corresponding to a larger sequence as chondrocyte enriched or chondrocyte-specific, other portions of the larger sequence which comprises the EST can be used in assays to elucidate gene function, e.g., to isolate polypeptides encoded by the gene, to generate antibodies specifically reactive with these polypeptides, to identify binding partners of the polypeptides (receptors, ligands, agonists, antagonists and the like) and/or to detect the expression of the gene (or lack thereof) in chondrocytes in fetal, adult, normal, and/or diseased individuals.

In another aspect, the invention provides for nucleic acid sequences that do not demonstrate a "significant match" to any of the publicly known sequences in sequence databases at the time a query is done. Longer genomic segments comprising these types of novel EST sequences can be identified by probing genomic libraries, while longer expressed sequences can be identified in cDNA libraries and/or by performing polymerase extension reactions (e.g., RACE) using EST sequences to derive primer sequences as is known in the art. Longer fragments can be mapped to particular chromosomes by FISH and other techniques and their sequences compared to known sequences in genomic and/or expressed sequence databases and further functional analysis can be performed as described above.

Using the methods according to the invention, out of a total of 57,422 ESTs from the four cDNA libraries, no significant match was found for 618 sequences. The remaining sequences were characterized as shown in Table 12.

Identified genes can be catalogued according to their putative function. Functional characterization of ESTs with known gene matches is preferably made according to the categories described by Hwang et al (5). The distribution of genes in each of the subcellular categories is indicative of the dynamic state of the tissue and will provide important insights into the osteoarthritis disease process. The results of this analysis are provided in Table 19 where the total number of ESTs identified by the method in different human cartilage libraries are characterized based on the functional classification of known genes identified in each library.

Alternative methods for analyzing ESTs are also available. For example, the ESTs from each library may be assembled into contigs with sequence alignment, editing, and assembly programs such as PHRED and PHRAP (Ewing, et al., 1998, Genome Res. 3:175, incorporated herein; world wide web bozeman.genome.washington.edu/).Contig redundancy is reduced by clustering nonoverlapping sequence contigs using the EST clone identification number, which is common for the nonoverlapping 5' and 3' sequence reads for a single EST cDNA clone. In one aspect, the consensus sequence from each cluster is compared to the non-redundant Genbank/EMBL/DDBJ and dbEST databases using the BLAST algorithm with the help of unigene, Entrez and PubMed at the NCBI site.

Known Nucleic acid Sequences or ESTs and Novel Nucleic Acid Sequences or ESTs

An EST that exhibits a significant match (>65%, and preferably 90% or greater, identity) to at least one existing sequence in an existing nucleic acid sequence database is characterized as a "known" sequence according to the invention. Within this category, some known ESTs match to existing sequences which encode polypeptides with known function(s) and are referred to as a "known sequence with a function". Other "known" ESTs exhibit significant match to existing sequences which encode polypeptides of unknown function(s) and are referred to as a "known sequence with no known function".

In one aspect, the invention also provides for known nucleic acid sequences that are chondrocyte enriched or chondrocyte-specific.

EST sequences which have no significant match (less than 65% identity) to any existing sequence in the above cited available databases are categorized as novel ESTs. These novel ESTs are considered chondrocyte-specific since they are not matched to any other genes or ESTs derived from any other tissue. To identify a novel gene from an EST sequence, the EST is preferably at least 150 nucleotides in length. More preferably, the EST encodes at least part of an open reading frame, that is, a nucleic acid sequence between a translation initiation codon and a termination codon, which is potentially translated into a polypeptide sequence.

The invention provides for known and novel nucleic acid sequences that are uniquely expressed in normal, fetal, mild osteoarthritic, moderate osteoarthritic, marked osteoarthritic and severe osteoarthritic cartilage. Tables 13 and 25 show unique known genes and names of the novel sequences identified to date in the fetal, normal, mild osteoarthritic and severe osteoarthritic cDNA libraries using the methods according to the invention.

The invention also provides for known and novel nucleic acid sequences that are upregulated and downregulated in normal, fetal, mild osteoarthritic, moderate osteoarthritic, marked osteoarthritic and severe osteoarthritic cartilage. In one aspect, nucleic acid sequences are enriched in chondrocytes compared to cells which are non-chondrocytes, or in chondrocytes from individuals with osteoarthritis compared to normal individuals, or in chondrocytes from particular stages of development or disease compared to particular other stages of development or disease.

The invention also provides for nucleic acid sequences that are differentially expressed in cartilage from any two of the following developmental and disease stages: fetal, normal, mild osteoarthritic, moderate osteoarthritic, marked osteoarthritic and severe osteoarthritic.

Relative EST frequency is calculated by dividing the number of EST copies for each gene by the total number of ESTs analyzed. The chondrocyte-specific expression of a number of novel ESTs has been confirmed by methods known in the art. Useful methods for measuring gene expression in a tissue include RT PCR, Northern blot, etc.

Novel Nucleic Acid Molecules

Many of the novel nucleic acid molecules of the present invention are differentially expressed between the mild and severe osteoarthritis disease states and are thus useful as potential drug targets or markers for the osteoarthritis disease process. The invention also provides one or more nucleic acid molecules that are differentially expressed in two or more of the following developmental and disease stages: fetal, normal, mild osteoarthritic, moderate osteoarthritic, marked osteoarthritic and severe osteoarthritic. The invention further provides for one or more novel clones that are differentially expressed in two or more of the following developmental and disease stages: fetal, normal, mild osteoarthritic, moderate osteoarthritic, marked osteoarthritic and severe osteoarthritic.

Microarrays

Nucleic Acid Microarrays

Any combination of the nucleic acid sequences generated from any of the chondrocyte cDNA libraries are used for the construction of a microarray. In one embodiment, the microarray is chondrocyte-specific and is anticipated to encompass the entire spectrum of genes that are important in the osteoarthritis disease process. A microarray according to the invention preferably comprises between 10 and 20,000 nucleic acid members, and more preferably comprises at least 5000 nucleic acid members. The nucleic acid members are known or novel nucleic acid sequences described herein, or any combination thereof. A microarray according to the invention is used to confirm differential gene expression profiles of genes that are specifically expressed at different cartilage development and osteoarthritis disease stages.

The invention also provides for a microarray comprising genes that are differentially expressed between normal and mild osteoarthritis patients to allow for the identification of early risk factors for osteoarthritis development. The invention also provides for a microarray for osteoarthritis diagnosis comprising one or more nucleic acid sequences that are differentially expressed between a normal individual and a patient diagnosed with mild, moderate, marked or severe osteoarthritis. Such arrays also may be used for prognostic methods to monitor a patient's response to therapy. Preferably, an array for osteoarthritis diagnosis comprises 10-20,000 nucleic acid members and more preferably 50-15,000 nucleic acid members. In one embodiment, the above microarrays are used to identify a therapeutic agent that modulates the anabolic activity of a chondrocyte or changes (e.g., increases or decreases) the level of expression of at least one nucleic acid sequence that is differentially expressed in a chondrocyte derived from any of the following chondrocyte disease or developmental stages: fetal, normal, mild osteoarthritic, moderate osteoarthritic, marked osteoarthritic and severe osteoarthritic.

The target nucleic acid samples that are hybridized to and analyzed with a microarray of the invention are preferably from human cartilage, blood or synovial fluid. A limitation for this procedure lies in the amount of RNA available for use as a target nucleic acid sample. Preferably, at least 1 microgram of total RNA is obtained for use according to this invention. This is advantageous because the amount of RNA in synovial fluid and in many cartilage biopsy samples is very minimal.

Construction of a Microarray

In one aspect, cDNAs generated from human cartilage cDNA libraries are arrayed on a microarray. Preferably, a microarray according to the invention comprises chondrocyte enriched or chondrocyte-specific genes and includes the whole spectrum of genes that are important in the osteoarthritis disease process.

The EST frequency analysis in Table 13 (and portions thereof shown in Tables 27 and 28) shows the differential gene expression profiles for known genes. Table 13 lists the unique known genes (5,807) identified in the four cDNA libraries to date according to one embodiment of the invention. Table 27, lists genes that have been identified through EST frequency analysis as being differentially expressed between fetal and normal cDNA libraries according to one embodiment of the invention. Table 28 lists genes that have been identified through EST frequency analysis as being differentially expressed between mild and severe osteoarthritis cDNA libraries according to one embodiment of the invention. Microarrays according to the invention may be used to confirm these profiles and may also be used to show differential expression profiles between different developmental stages and osteoarthritis disease states for novel EST sequences. These novel EST sequences may be further characterized by cluster and alignment analyses to determine how many unique genes are represented by the novel EST sequences. The novel unique genes identified may provide a basis for identifying key markers in osteoarthritis disease progression and treatment.

In the subject methods, an array of nucleic acid members stably associated with the surface of a substantially solid support is contacted with a sample comprising target nucleic acids under hybridization conditions sufficient to produce a hybridization pattern of complementary nucleic acid members/target complexes in which one or more complementary nucleic acid members at unique positions on the array specifically hybridize to target nucleic acids. The identity of target nucleic acids which hybridize can be determined with reference to location of nucleic acid members on the array.

The nucleic acid members may be produced using established techniques such as polymerase chain reaction (PCR) and reverse transcription (RT). These methods are similar to those currently known in the art (see e.g., *PCR Strategies*, Michael A. Innis (Editor), et al. (1995) and *PCR: Introduction to Biotechniques Series*, C. R. Newton, A. Graham (1997)).

Amplified nucleic acids are purified by methods well known in the art (e.g., column purification or alcohol precipitation). A nucleic acid is considered pure when it has been isolated so as to be substantially free of primers and incomplete products produced during the synthesis of the desired nucleic acid. Preferably, a purified nucleic acid will also be substantially free of contaminants which may hinder or otherwise mask the specific binding activity of the molecule.

A microarray according to the invention comprises a plurality of unique nucleic acids attached to one surface of a solid support at a density exceeding 20 different nucleic acids/cm$^2$, wherein each of the nucleic acids is attached to the surface of the solid support in a non-identical pre-selected region. Each associated sample on the array comprises a nucleic acid composition, of known identity, usually of known sequence, as described in greater detail below. Any conceivable substrate may be employed in the invention.

In one embodiment, the nucleic acid attached to the surface of the solid support is DNA. In a preferred embodiment, the nucleic acid attached to the surface of the solid support is cDNA or RNA. In another preferred embodiment, the nucleic acid attached to the surface of the solid support is cDNA synthesized by polymerase chain reaction (PCR). Preferably, a nucleic acid member in the array, according to the invention, is at least 50 nucleotides in length. In one embodiment, a nucleic acid member is at least 150 nucleotides in length. Preferably, a nucleic acid member is less than 1000 nucleotides in length. More preferably, a nucleic acid member is less than 500 nucleotides in length. In one embodiment, an array comprises at least 10 different nucleic acids attached to one surface of the solid support. In another embodiment, the array comprises at least 100 different nucleic acids attached to one surface of the solid support. In yet another embodiment, the array comprises at least 10,000 different nucleic acids attached to one surface of the solid support. In yet another embodiment, the array comprises at least 15,000 different nucleic acids attached to one surface of the solid support.

In the arrays of the invention, the nucleic acid compositions are stably associated with the surface of a solid support, where the support may be a flexible or rigid solid support. By "stably associated" is meant that each nucleic acid member maintains a unique position relative to the solid support under hybridization and washing conditions. As such, the samples are non-covalently or covalently stably associated with the support surface. Examples of non-covalent association include non-specific adsorption, binding based on electrostatic interactions (e.g., ion pair interactions), hydrophobic interactions, hydrogen bonding interactions, specific binding through a specific binding pair member covalently attached to the support surface, and the like. Examples of covalent binding include covalent bonds formed between the nucleic acids and a functional group present on the surface of the rigid support (e.g., —OH), where the functional group may be naturally occurring or present as a member of an introduced linking group, as described in greater detail below The amount of nucleic acid present in each composition will be sufficient to provide for adequate hybridization and detection of target nucleic acid sequences during the assay in which the array is employed. Generally, the amount of each nucleic acid member stably associated with the solid support of the array is at least about 0.001 ng, preferably at least about 0.02 ng and more preferably at least about 0.05 ng, where the amount may be as high as 1000 ng or higher, but will usually not exceed about 20 ng. Where the nucleic acid member is "spotted" onto the solid support in a spot comprising an overall circular dimension, the diameter of the "spot" will generally range from about 10 to 5,000 μm, usually from about 20 to 2,000 μm and more usually from about 100 to 200 μm.

Control nucleic acid members may be present on the array including nucleic acid members comprising oligonucleotides or nucleic acids corresponding to genomic DNA, housekeeping genes, vector sequences, plant nucleic acid sequence, negative and positive control genes, and the like. Control nucleic acid members are calibrating or control genes whose function is not to tell whether a particular "key" gene of interest is expressed, but rather to provide other useful information, such as background or basal level of expression.

Other control nucleic acids are spotted on the array and used as target expression control nucleic acids and mismatch control nucleotides to monitor non-specific binding or cross-hybridization to a nucleic acid in the sample other than the target to which the probe is directed. Mismatch probes thus indicate whether a hybridization is specific or not. For example, if the target is present, the perfectly matched probes should be consistently brighter than the mismatched probes. In addition, if all control mismatches are present, the mismatch probes are used to detect a mutation.

Solid Substrate

An array according to the invention comprises either a flexible or rigid substrate. A flexible substrate is capable of being bent, folded or similarly manipulated without breakage. Examples of solid materials which are flexible solid supports with respect to the present invention include membranes, e.g., nylon, flexible plastic films, and the like. By "rigid" is meant that the support is solid and does not readily bend, i.e., the support is not flexible. As such, the rigid substrates of the subject arrays are sufficient to provide physical support and structure to the associated nucleic acids present thereon under the assay conditions in which the array is employed, particularly under high throughput handling conditions.

The substrate may be biological, non-biological, organic, inorganic, or a combination of any of these, existing as particles, strands, precipitates, gels, sheets, tubing, spheres, beads, containers, capillaries, pads, slices, films, plates, slides, chips, etc. The substrate may have any convenient shape, such as a disc, square, sphere, circle, etc. The substrate is preferably flat or planar but may take on a variety of alternative surface configurations. The substrate may be a polymerized Langmuir Blodgett film, functionalized glass, Si, Ge, GaAs, GaP, $SiO_2$, $SIN_4$, modified silicon, or any one of a wide variety of gels or polymers such as (poly)tetrafluoroethylene, (poly)vinylidenedifluoride, polystyrene, polycarbonate, or combinations thereof. Other substrate materials will be readily apparent to those of skill in the art upon review of this disclosure.

In a preferred embodiment the substrate is flat glass or single-crystal silicon. According to some embodiments, the surface of the substrate is etched using well-known techniques to provide for desired surface features. For example, by way of formation of trenches, v-grooves, mesa structures, or the like, the synthesis regions may be more closely placed within the focus point of impinging light, be provided with reflective "mirror" structures for maximization of light collection from fluorescent sources, etc.

Surfaces on the solid substrate will usually, though not always, be composed of the same material as the substrate. Alternatively, the surface may be composed of any of a wide variety of materials, for example, polymers, plastics, resins, polysaccharides, silica or silica-based materials, carbon, metals, inorganic glasses, membranes, or any of the above-listed substrate materials. In some embodiments the surface may provide for the use of caged binding members which are attached firmly to the surface of the substrate. Preferably, the surface will contain reactive groups, which are carboxyl, amino, hydroxyl, or the like. Most preferably, the surface will be optically transparent and will have surface Si—OH functionalities, such as are found on silica surfaces.

The surface of the substrate is preferably provided with a layer of linker molecules, although it will be understood that the linker molecules are not required elements of the invention. The linker molecules are preferably of sufficient length to permit nucleic acids of the invention and on a substrate to hybridize to other nucleic acid molecules and to interact freely with molecules exposed to the substrate.

Often, the substrate is a silicon or glass surface, (poly) tetrafluoroethylene, (poly)vinylidendifluoride, polystyrene, polycarbonate, a charged membrane, such as nylon 66 or nitrocellulose, or combinations thereof. In a preferred embodiment, the solid support is glass. Preferably, at least one surface of the substrate will be substantially flat. Preferably, the surface of the solid support will contain reactive groups, including, but not limited to, carboxyl, amino, hydroxyl, thiol, or the like. In one embodiment, the surface is optically transparent. In a preferred embodiment, the substrate is a poly-lysine coated slide or Gamma amino propyl silane-coated Corning Microarray Technology-GAPS or CMT-GAP2 coated slides.

Any solid support to which a nucleic acid member may be attached may be used in the invention. Examples of suitable solid support materials include, but are not limited to, silicates such as glass and silica gel, cellulose and nitrocellulose papers, nylon, polystyrene, polymethacrylate, latex, rubber, and fluorocarbon resins such as TEFLON™.

The solid support material may be used in a wide variety of shapes including, but not limited to slides and beads. Slides provide several functional advantages and thus are a preferred form of solid support. Due to their flat surface, probe and hybridization reagents are minimized using glass slides. Slides also enable the targeted application of reagents, are easy to keep at a constant temperature, are easy to wash and facilitate the direct visualization of RNA and/or DNA immobilized on the solid support. Removal of RNA and/or DNA immobilized on the solid support is also facilitated using slides.

The particular material selected as the solid support is not essential to the invention, as long as it provides the described function. Normally, those who make or use the invention will select the best commercially available material based upon the economics of cost and availability, the expected application requirements of the final product, and the demands of the overall manufacturing process.

Spotting Method

In one aspect, the invention provides for arrays where each nucleic acid member comprising the array is spotted onto a solid support.

Preferably, spotting is carried out as follows. PCR products (~40 ul) of cDNA clones from osteoarthritis, fetal or normal cartilage cDNA libraries, in the same 96-well tubes used for amplification, are precipitated with 4 ul (1/10 volume) of 3M sodium acetate (pH 5.2) and 100 ul (2.5 volumes) of ethanol and stored overnight at −20° C. They are then centrifuged at 3,300 rpm at 4° C. for 1 hour. The obtained pellets are washed with 50 ul ice-cold 70% ethanol and centrifuged again for 30 minutes. The pellets are then air-dried and resuspended well in 20 ul 3×SSC or in 50% dimethylsulfoxide (DMSO) overnight. The samples are then spotted, either singly or in duplicate, onto slides using a robotic GMS 417 or 427 arrayer (Affymetrix, Ca).

The boundaries of the spots on the microarray may be marked with a diamond scriber (as the spots become invisible after post-processing). The arrays are rehydrated by suspending the slides over a dish of warm particle free ddH$_2$0 for approximately one minute (the spots will swell slightly but will not run into each other) and snap-dried on a 70-80° C. inverted heating block for 3 seconds. Nucleic acid is then UV crosslinked to the slide (Stratagene, Stratalinker, 65 mJ—set display to "650" which is 650×100 uJ) or the array is baked at 80 C for two to four hours prior to hybridization. The arrays are placed in a slide rack. An empty slide chamber is prepared and filled with the following solution: 3.0 grams of succinic anhydride (Aldrich) was dissolved in 189 ml of 1-methyl-2-pyrrolidinone (rapid addition of reagent is crucial); immediately after the last flake of succinic anhydride is dissolved, ~21.0 ml of 0.2 M sodium borate is mixed in and the solution is poured into the slide chamber. The slide rack is plunged rapidly and evenly in the slide chamber and vigorously shaken up and down for a few seconds, making sure the slides never leave the solution, and then mixed on an orbital shaker for 15-20 minutes. The slide rack is then gently plunged in 95° C. ddH$_2$0 for 2 minutes, followed by plunging five times in 95% ethanol. The slides are then air dried by allowing excess ethanol to drip onto paper towels. The arrays are stored in the slide box at room temperature until use.

Numerous methods may be used for attachment of the nucleic acid members of the invention to the substrate (a process referred to as "spotting"). For example, nucleic acids are attached using the techniques of, for example U.S. Pat. No. 5,807,522, which is incorporated herein by reference, for teaching methods of polymer attachment.

Alternatively, spotting may be carried out using contact printing technology as is known in the art.

Kits

The invention provides for kits for performing expression assays using the arrays of the present invention. Such kits according to the subject invention will at least comprise the arrays of the invention having associated nucleic acid members and packaging means therefore. The kits may further comprise one or more additional reagents employed in the various methods, such as: 1) primers for generating test nucleic acids; 2) dNTPs and/or rNTPs (either premixed or separate), optionally with one or more uniquely labeled dNTPs and/or rNTPs (e.g., biotinylated or Cy3 or Cy5 tagged dNTPs); 3) post synthesis labeling reagents, such as chemically active derivatives of fluorescent dyes; 4) enzymes, such as reverse transcriptases, DNA polymerases, and the like; 5) various buffer mediums, e.g., hybridization and washing buffers; 6) labeled probe purification reagents and components, like spin columns, etc.; and 7) signal generation and detection reagents, e.g., streptavidin-alkaline phosphatase conjugate, chemifluorescent or chemiluminescent substrate, and the like.

Use of a Microarray

Nucleic acid arrays according to the invention can be used in high throughput techniques that can assay a large number of nucleic acids in a sample comprising one or more target nucleic acid sequences. The arrays of the subject invention find use in a variety of applications, including gene expression analysis, diagnosis of osteoarthritis and prognosis of osteoarthritis, monitoring a patient's response to therapy, drug screening, and the like.

In one aspect, the arrays of the invention are used in, among other applications, differential gene expression assays. For example, arrays are useful in the differential expression analysis of: (a) diseased osteoarthritis and normal tissue; (b) tissues representing different stages of osteoarthritis; (c) developing cartilage (e.g., fetal cartilage); (d) chondrocyte responses to external or internal stimuli; (e) cartilage/chondrocyte response to treatment; (f) cartilage tissue engineering; (g) pharmacogenomics; and the like. The arrays are also useful in broad scale expression screening for drug discovery and research, such as the effect of a particular active agent on the expression pattern of genes in a particular cell, where such information is used to reveal drug efficacy and toxicity, environmental monitoring, disease research and the like. For example, high expression of a particular nucleic acid sequence in an osteoarthritis sample (mild, moderate, marked, or severe), which is not observed in a corresponding normal cell, can indicate an osteoarthritis-specific gene product.

For example, arrays useful in the invention can include sequences which demonstrate increased or decreased expression in patient's having osteoarthritis as compared to normal individuals. More particularly, an array useful in accordance with the invention include sequences which demonstrate increased or decreased expression in patients identified as having a particular stage of progression of the disease, for example mild osteoarthritis but not demonstrating increased or decreased expression in another stage of progression of the disease, for example severe osteoarthritis.

Arrays can be made using at least one, more preferably a majority of these sequences, as a means of diagnosing osteoarthritis, or for purposes of monitoring efficacy of treatment and of osteoarthritis.

For example an array of the invention can be used to diagnose an individual having osteoarthritis by hybridizing a sample complementary to a patient's RNA to an array comprising sequences identified as having increased or decreased expression, and comparing the level of intensity of hybridization as between this sample and a sample complementary to RNA isolated from normal individuals to a similar or identical second array.

Similarly, an array of the invention can be used to monitor the efficacy of treatment in patients who have osteoarthritis by hybridizing a sample complementary to a patient's RNA, wherein the patient has been treated so as to reduce the progression of osteoarthritis, and determining the intensity of the hybridization as compared with the intensity of hybridization of a standard sample hybridized to another array of the invention.

Additionally, an array of the invention can be utilized to identify an agent that increases or decreases the expression of a polynucleotide sequence of the invention by incubating a chondrocyte derived from a normal individual with a candidate agent, wherein said chondrocyte is isolated from a cartilage sample obtained from said normal individual less than 14 hours post-mortem; hybridizing a sample complementary to a patient's RNA to an array of the invention, and hybridizing a sample useful as a standard to another array of the invention and comparing the intensity of expression between corresponding unique positions on the arrays.

The choice of a standard sample would be well understood by a person skilled in the art, and would include a sample complementary to RNA isolated from one or more normal individuals, wherein a normal individual is an individual not suffering from osteoarthritis. A standard sample would include a sample complementary to RNA isolated from chondrocytes, or from blood, or from synovial fluid.

Target Preparation

The targets for the microarrays according to the invention are preferably derived from human cartilage, blood or synovial fluid.

A target nucleic acid is capable of binding to a nucleic acid probe or nucleic acid member of complementary, sequence through one or more types of chemical bonds, usually through complementary base pairing, usually through hydrogen bond formation.

As used herein, a "nucleic acid derived from an mRNA transcript: or a "nucleic acid corresponding to an mRNA" refers to a nucleic acid for which synthesis of the mRNA transcript or a sub-sequence thereof has ultimately served as a template. Thus, a cDNA reverse transcribed from an mRNA, an RNA transcribed from that cDNA, a DNA amplified from the cDNA, an RNA transcribed from the amplified DNA, etc., are all derived from or correspond to the mRNA transcript and detection of such derived or corresponding products is indicative of or proportional to the presence and/or abundance of the original transcript in a sample. Thus, suitable target nucleic acid samples include, but are not limited to, mRNA transcripts of a gene or genes, cDNA reverse transcribed from the mRNA, cRNA transcribed from the cDNA, DNA amplified from a gene or genes, RNA transcribed from amplified DNA, and the like. The nucleic acid targets used herein are preferably derived from human cartilage, blood or synovial fluid. Preferably, the targets are nucleic acids derived from human cartilage, blood or synovial fluid extracts. Nucleic acids can be single- or double-stranded DNA, RNA, or DNA-RNA hybrids synthesized from human cartilage, blood or synovial fluid mRNA extracts using methods known in the art, for example, reverse transcription or PCR.

In the simplest embodiment, such a nucleic acid target comprises total mRNA or a nucleic acid sample corresponding to mRNA (e.g., cDNA) isolated from cartilage, blood, or synovial fluid samples. In another embodiment, total mRNA is isolated from a given sample using, for example, an acid guanidinium-phenol-chloroform extraction method and polyA+ mRNA is isolated by oligo dT column chromatography or by using (dT)n magnetic beads (see, e.g., Sambrook et al., *Molecular Cloning: A Laboratory Manual* (2nd ed.), Vols. 1-3, Cold Spring Harbor Laboratory, (1989), or Current Protocols in Molecular Biology, F. Ausubel et al., ed. Greene Publishing and Wiley-Interscience, New York (1987). In a preferred embodiment, total RNA is extracted using TRIzol® reagent (GIBCO/BRL, Invitrogen Life Technologies, Cat. No. 15596). Purity and integrity of RNA is assessed by absorbance at 260/280 nm and agarose gel electrophoresis followed by inspection under ultraviolet light.

In some embodiments, it is desirable to amplify the target nucleic acid sample prior to hybridization, for example, when synovial fluid is used. One of skill in the art will appreciate that whatever amplification method is used, if a quantitative result is desired, care must be taken to use a method that maintains or controls for the relative frequencies of the amplified nucleic acids. Methods of "quantitative" amplification are well known to those of skill in the art. For example, quantitative PCR involves simultaneously co-amplifying a known quantity of a control sequence using the same primers. This provides an internal standard that may be used to calibrate the PCR reaction. The high density array may then include probes specific to the internal standard for quantification of the amplified nucleic acid. Detailed protocols for quantitative PCR are provided in *PCR Protocols, A Guide to Methods and Applications*, Innis et al., Academic Press, Inc. N.Y., (1990).

Other suitable amplification methods include, but are not limited to polymerase chain reaction (PCR) (Innis, et al., *PCR Protocols. A Guide to Methods and Application*. Academic Press, Inc. San Diego, (1990)), ligase chain reaction (LCR) (see Wu and Wallace, 1989, *Genomics,* 4:560; Landegren, et al., 1988, *Science,* 241:1077 and Barringer, et al., 1990, *Gene,* 89:117, transcription amplification (Kwoh, et al., 1989, *Proc. Natl. Acad. Sci. USA,* 86: 1173), and self-sustained sequence replication (Guatelli, et al., 1990, *Proc. Nat. Acad. Sci. USA,* 87: 1874).

In a particularly preferred embodiment, the target nucleic acid sample mRNA is reverse transcribed with a reverse transcriptase and a primer consisting of oligo dT and a sequence encoding the phage T7 promoter to provide single-stranded DNA template. The second DNA strand is polymerized using a DNA polymerase. After synthesis of double-stranded cDNA, T7 RNA polymerase is added and RNA is transcribed from the cDNA template. Successive rounds of transcription from each single cDNA template results in amplified RNA. Methods of in vitro transcription are well known to those of skill in the art (see, e.g., Sambrook, supra.) and this particular method is described in detail by Van Gelder, et al., 1990, *Proc. Natl. Acad. Sci. USA,* 87: 1663-1667 who demonstrate that in vitro amplification according to this method preserves the relative frequencies of the various RNA transcripts. Moreover, Eberwine et al. *Proc. Natl. Acad. Sci. USA,* 89: 3010-3014 provide a protocol that uses two rounds of amplification via in vitro transcription to achieve greater than $10^6$ fold amplification of the original starting material thereby permitting expression monitoring even where biological samples are limited.

Labeling of Target or Nucleic Acid Probe

Either the target or the probe can be labeled.

Any analytically detectable marker that is attached to or incorporated into a molecule may be used in the invention. An analytically detectable marker refers to any molecule, moiety or atom which is analytically detected and quantified.

Detectable labels suitable for use in the present invention include any composition detectable by spectroscopic, photochemical, biochemical, immunochemical, electrical, optical or chemical means. Useful labels in the present invention include biotin for staining with labeled streptavidin conjugate, magnetic beads (e.g., Dynabeads™), fluorescent dyes (e.g., fluorescein, texas red, rhodamine, green fluorescent protein, and the like), radiolabels (e.g., $^3$H, $^{125}$I, $^{35}$S, $^{14}$C, or $^{32}$P), enzymes (e.g., horse radish peroxidase, alkaline phosphatase and others commonly used in an ELISA), and colorimetric labels such as colloidal gold or colored glass or plastic (e.g., polystyrene, polypropylene, latex, etc.) beads. Patents teaching the use of such labels include U.S. Pat. Nos. 3,817,837; 3,850,752; 3,939,350; 3,996,345; 4,277,437; 4,275,149; and 4,366,241, the entireties of which are incorporated by reference herein.

Means of detecting such labels are well known to those of skill in the art. Thus, for example, radiolabels may be detected using photographic film or scintillation counters, fluorescent markers may be detected using a photodetector to detect emitted light. Enzymatic labels are typically detected by providing the enzyme with a substrate and detecting the reaction product produced by the action of the enzyme on the substrate, and colorimetric labels are detected by simply visualizing the colored label.

The labels may be incorporated by any of a number of means well known to those of skill in the art. However, in a preferred embodiment, the label is simultaneously incorporated during the amplification step in the preparation of the sample nucleic acids. Thus, for example, polymerase chain reaction (PCR) with labeled primers or labeled nucleotides will provide a labeled amplification product. In a preferred embodiment, transcription amplification, as described above, using a labeled nucleotide (e.g. fluorescein-labeled UTP and/or CTP) incorporates a label into the transcribed nucleic acids.

Alternatively, a label may be added directly to the original nucleic acid sample (e.g., mRNA, polyA mRNA, cDNA, etc.) or to the amplification product after the amplification is completed. Means of attaching labels to nucleic acids are well known to those of skill in the art and include, for example, nick translation or end-labeling (e.g. with a labeled RNA) by kinasing of the nucleic acid and subsequent attachment (ligation) of a nucleic acid linker joining the sample nucleic acid to a label (e.g., a fluorophore).

In a preferred embodiment, the fluorescent modifications are by cyanine dyes e.g. Cy-3/Cy-5 dUTP, Cy-3/Cy-5 dCTP (Amersham Pharmacia) or alexa dyes (Khan, et al., 1998, *Cancer Res.* 58:5009-5013).

In a preferred embodiment, the two target samples used for comparison are labeled with different fluorescent dyes which produce distinguishable detection signals, for example, targets made from normal cartilage are labeled with Cy5 and targets made from mild osteoarthritis cartilage are labeled with Cy3. The differently labeled target samples are hybridized to the same microarray simultaneously. In a preferred embodiment, the labeled targets are purified using methods known in the art, e.g., by ethanol purification or column purification.

In a preferred embodiment, the target will include one or more control molecules which hybridize to control probes on the microarray to normalize signals generated from the microarray. Preferably, labeled normalization targets are nucleic acid sequences that are perfectly complementary to control oligonucleotides that are spotted onto the microarray as described above. The signals obtained from the normalization controls after hybridization provide a control for variations in hybridization conditions, label intensity, "reading" efficiency and other factors that may cause the signal of a perfect hybridization to vary between arrays. In a preferred embodiment, signals (e.g., fluorescence intensity) read from all other probes in the array are divided by the signal (e.g., fluorescence intensity) from the control probes, thereby normalizing the measurements.

Preferred normalization targets are selected to reflect the average length of the other targets present in the sample, however, they are selected to cover a range of lengths. The normalization control(s) also can be selected to reflect the (average) base composition of the other probes in the array, however, in a preferred embodiment, only one or a few normalization probes are used and they are selected such that they hybridize well (i.e., have no secondary structure and do not self hybridize) and do not match any target molecules.

Normalization probes are localized at any position in the array or at multiple positions throughout the array to control for spatial variation in hybridization efficiency. In a preferred embodiment, normalization controls are located at the corners or edges of the array as well as in the middle.

Hybridization Conditions

Nucleic acid hybridization involves providing a denatured probe or target nucleic acid member and target nucleic acid under conditions where the probe or target nucleic acid member and its complementary target can form stable hybrid duplexes through complementary base pairing. The nucleic acids that do not form hybrid duplexes are then washed away leaving the hybridized nucleic acids to be detected, typically through detection of an attached detectable label. It is generally recognized that nucleic acids are denatured by increasing the temperature or decreasing the salt concentration of the buffer containing the nucleic acids. Under low stringency conditions (e.g., low temperature and/or high salt) hybrid duplexes (e.g., DNA:DNA, RNA:RNA, or RNA:DNA) will form even where the annealed sequences are not perfectly complementary. Thus specificity of hybridization is reduced at lower stringency. Conversely, at higher stringency (e.g., higher temperature or lower salt) successful hybridization requires fewer mismatches.

The invention provides for hybridization conditions comprising the Dig hybridization mix (Boehringer); or formamide-based hybridization solutions, for example as described in Ausubel et al., supra and Sambrook et al. supra.

Methods of optimizing hybridization conditions are well known to those of skill in the art (see, e.g., *Laboratory Techniques in Biochemistry and Molecular Biology*, Vol. 24: *Hybridization With Nucleic acid Probes*, P. Tijssen, ed. Elsevier, N.Y., (1993)).

Following hybridization, non-hybridized labeled or unlabeled nucleic acid is removed from the support surface, conveniently by washing, thereby generating a pattern of hybridized target nucleic acid on the substrate surface. A variety of wash solutions are known to those of skill in the art and may be used. The resultant hybridization patterns of labeled, hybridized oligonucleotides and/or nucleic acids may be visualized or detected in a variety of ways, with the particular manner of detection being chosen based on the particular label of the test nucleic acid, where representative detection means include scintillation counting, autoradiography, fluorescence measurement, calorimetric measurement, light emission measurement and the like.

Image Acquisition and Data Analysis

Following hybridization and any washing step(s) and/or subsequent treatments, as described above, the resultant hybridization pattern is detected. In detecting or visualizing the hybridization pattern, the intensity or signal value of the label will be not only be detected but quantified, by which is meant that the signal from each spot of the hybridization will be measured and compared to a unit value corresponding to the signal emitted by a known number of end labeled target nucleic acids to obtain a count or absolute value of the copy number of each end-labeled target that is hybridized to a particular spot on the array in the hybridization pattern.

Methods for analyzing the data collected from hybridization to arrays are well known in the art. For example, where detection of hybridization involves a fluorescent label, data analysis can include the steps of determining fluorescent intensity as a function of substrate position from the data collected, removing outliers, i.e., data deviating from a predetermined statistical distribution, and calculating the relative binding affinity of the test nucleic acids from the remaining data. The resulting data is displayed as an image with the intensity in each region varying according to the binding affinity between associated oligonucleotides and/or nucleic acids and the test nucleic acids.

The following detection protocol is used for the simultaneous analysis of two cartilage samples to be compared, where each sample is labeled with a different fluorescent dye.

Each element of the microarray is scanned for the first fluorescent color. The intensity of the fluorescence at each array element is proportional to the expression level of that gene in the sample.

The scanning operation is repeated for the second fluorescent label. The ratio of the two fluorescent intensities provides a highly accurate and quantitative measurement of the relative gene expression level in the two tissue samples.

In a preferred embodiment, fluorescence intensities of immobilized target nucleic acid sequences were determined from images taken with a custom confocal microscope equipped with laser excitation sources and interference filters appropriate for the Cy3 and Cy5 fluors. Separate scans were taken for each fluor at a resolution of 225 $\mu m^2$ per pixel and 65,536 gray levels. Image segmentation to identify areas of hybridization, normalization of the intensities between the two fluor images, and calculation of the normalized mean fluorescent values at each target are as described (Khan, et al., 1998, *Cancer Res.* 58:5009-5013. Chen, et al., 1997, *Biomed. Optics* 2:364-374). Normalization between the images is used to adjust for the different efficiencies in labeling and detection with the two different fluors. This is achieved by equilibrating to a value of one the signal intensity ratio of a set of internal control genes spotted on the array.

In another preferred embodiment, the array is scanned in the Cy 3 and Cy5 channels and stored as separate 16-bit TIFF images. The images are incorporated and analysed using software which includes a gridding process to capture the hybridization intensity data from each spot on the array. The fluorescence intensity and background-subtracted hybridization intensity of each spot is collected and a ratio of measured mean intensities of Cy5 to Cy3 is calculated. A liner regression approach is used for normalization and assumes that a scatter plot of the measured Cy5 versus Cy3 intensities should have a scope of one. The average of the ratios is calculated and used to rescale the data and adjust the slope to one. A post-normalization cutoff of greater than 1.0 fold up- or down-regulation is used to identify differentially expressed genes.

Following detection or visualization, the hybridization pattern is used to determine quantitative information about the genetic profile of the labeled target nucleic acid sample that was contacted with the array to generate the hybridization pattern, as well as the physiological source from which the labeled target nucleic acid sample was derived. By "genetic profile" is meant information regarding the types of nucleic acids present in the sample, e.g., such as the types of genes to which they are complementary, and/or the copy number of each particular nucleic acid in the sample. From this data, one can also derive information about the physiological source from which the target nucleic acid sample was derived, such as the types of genes expressed in the tissue or cell which is the physiological source of the target, as well as the levels of expression of each gene, particularly in quantitative terms.

Where one uses the subject methods to compare target nucleic acids from two or more physiological sources, the hybridization patterns may be compared to identify differences between the patterns. Where arrays in which each of the different nucleic acid members corresponds to a known gene are employed, any discrepancies are related to a differential expression of a particular gene in the physiological sources being compared. Thus, the subject methods find use in differential gene expression assays, where one may use the subject methods in the differential expression analysis of: (a) diseased vs. normal tissue, e.g., osteoarthritic and normal tissue, (b) tissue derived from different stages of osteoarthritis; and the like.

In a particularly preferred embodiment, where it is desired to quantify the transcription level (and thereby expression) of one or more nucleic acid sequences in a sample, the target nucleic acid sample is one in which the concentration of the mRNA transcript(s) of the gene or genes, or the concentration of the nucleic acids derived from the mRNA transcript(s), is proportional to the transcription level (and therefore expression level) of that gene. Similarly, it is preferred that the hybridization signal intensity be proportional to the amount of hybridized nucleic acid. While it is preferred that the proportionality be relatively strict (e.g., a doubling in transcription rate results in a doubling in mRNA transcript in the sample nucleic acid pool and a doubling in hybridization signal), one of skill will appreciate that the proportionality can be more relaxed and even non-linear and still provide meaningful results. Thus, for example, an assay where a 5 fold difference in concentration of the target mRNA results in a 3- to 6-fold difference in hybridization intensity is sufficient for most purposes. Where more precise quantification is required, appropriate controls are run to correct for variations introduced in sample preparation and hybridization as described herein. In addition, serial dilutions of "standard" target mRNAs are used to prepare calibration curves according to methods well known to those of skill in the art. Of course, where simple detection of the presence or absence of a transcript is desired, no elaborate control or calibration is required.

For example, if a microarray nucleic acid member is not labeled after hybridization, this indicates that the gene comprising that nucleic acid member is not expressed in either sample. If a nucleic acid member is labeled with a single color, it indicates that a labeled gene was expressed only in one sample. The labeling of a nucleic acid member comprising an array with both colors indicates that the gene was expressed in both samples. Even genes expressed once per cell are detected (1 part in 100,000 sensitivity). A difference in expression intensity in the two samples being compared is indicative of differential expression, the ratio of the intensity in the two samples being not equal to 1.0, preferably less than 0.7 or greater than 1.2, more preferably less than 0.5 or greater than 1.5.

Many human genes are expressed at different levels in cartilage of different developmental (fetal vs. mature) or disease states. In some cases, a gene is not expressed at all in some developmental or disease states, and at high levels in others. Differential analysis of chondrocyte gene expression in differing cartilage states using an EST-based approach is used to identify genes that may play important roles in osteoarthritis pathogenesis and cartilage repair. The advantage of this method is that it can provide gene expression information on a larger scale than other methods. The cDNA clones generated by this approach is useful for future functional studies of certain genes. This type of genomic-based approach can provide important novel insights into our understanding of the osteoarthritis disease process and provide for novel diagnostic, prognostic and therapeutic approaches.

Diagnostic or Prognostic Tests

The invention also provides for diagnostic tests for detecting osteoarthritis. The invention also provides for prognostic tests for monitoring a patient's response to therapy.

According to the method of the invention, mild, moderate, marked or severe osteoarthritis is detected by obtaining a cartilage sample from a patient. In alternative embodiments, a blood or synovial fluid sample is obtained from a patient. A sample comprising nucleic acid corresponding to RNA (i.e., RNA or cDNA) is prepared from the patient cartilage (or blood or synovial fluid) sample. The sample comprising nucleic acid corresponding to RNA is hybridized to an array comprising a solid substrate and a plurality of nucleic acid members, where at least one member is differentially expressed in cartilage isolated from a patient diagnosed with mild, moderate, marked or severe osteoarthritis, as compared to a "normal individual", according to the invention. According to this diagnostic test, hybridization of the sample comprising nucleic acid corresponding to RNA to one or more nucleic acid members on the array is indicative of disease.

A patient response to therapy is monitored by using a prognostic test according to the invention. In one aspect, a prognostic test according to the invention comprises obtaining a cartilage sample from a patient prior to treatment, during the course of treatment and after treatment. Preferably, the patient is treated for at least 12 hours before a sample is taken. In alternative embodiments, blood or synovial fluid samples are obtained from a patient prior to treatment, during the course of treatment and after treatment. A sample comprising nucleic acid corresponding to RNA (i.e., RNA or cDNA) is prepared from the patient cartilage (or blood or synovial fluid) samples. The samples comprising nucleic acid corresponding to RNA are hybridized to an array comprising a solid substrate and a plurality of nucleic acid members, wherein at least one member is differentially expressed in cartilage isolated from a patient diagnosed with mild, moderate, marked or severe osteoarthritis, as compared to a normal individual, according to the invention. Arrays are selected in accordance with the diagnostic state of the patient whose treatment is being monitored. According to this prognostic test, differential hybridization of the samples comprising nucleic acid corresponding to RNA isolated prior to and after treatment to one or more nucleic acid members on the array is indicative of an effective treatment. Preferably, gene expression profiles in patients being treated changes to resemble more closely gene expression profiles in patients with less severe forms of the disease or more preferably more closely resembles gene expression profiles in normal patients. The extent of change in a gene expression profile can be further correlated with various therapeutic endpoints such as a decrease in the severity and/or occurrence of one or more symptoms associated with the disease.

Therapeutic Agents

A useful therapeutic agent according to the invention can increase or decrease the anabolic and/or the catabolic activity of a chondrocyte. Preferably, a therapeutic agent can increase or decrease the anabolic and/or catabolic activity of a chondrocyte by greater than 1.0-fold, more preferably, 1.5-5-fold, and most preferably, 5-100-fold, as compared to an untreated chondrocyte.

In one embodiment, a therapeutic agent changes (e.g., increases or decreases) the level of expression of at least one nucleic acid sequence that is differentially expressed in a chondrocyte derived from any of the following chondrocyte disease or developmental stages: fetal, normal, mild osteoarthritic, moderate osteoarthritic, marked osteoarthritic and severe osteoarthritic. Preferably, a therapeutic agent causes a change in the level of expression of a nucleic acid sequence or increase or decrease in the expression of a nucleic acid sequence that is differentially expressed in a chondrocyte derived from any of the following chondrocyte disease or developmental stages: fetal, normal, mild osteoarthritic, moderate osteoarthritic, marked osteoarthritic and severe osteoarthritic, where the change is greater than 1.0-fold, more preferably 1.5-5-fold, and most preferably 5-100-fold, more or less than the level of expression in the absence of a candidate therapeutic agent.

In another embodiment, a therapeutic agent according to the invention can ameliorate at least one of the symptoms and/or changes associated with osteoarthritis including cartilage degeneration, or pain, swelling, weakness and/or loss of functional ability in the afflicted joints, associated with cartilage degeneration.

The candidate therapeutic agent may be a synthetic compound, or a mixture of compounds, or may be a natural product (e.g. a plant extract or culture supernatant).

Candidate therapeutic agents or compounds from large libraries of synthetic or natural compounds can be screened. Numerous means are currently used for random and directed synthesis of saccharide, peptide, and nucleic acid-based compounds. Synthetic compound libraries are commercially available from a number of companies including Maybridge Chemical Co. (Trevillet, Cornwall, UK), Comgenex (Princeton, N.J.), Brandon Associates (Merrimack, N.H.), and Microsource (New Milford, Conn.). A rare chemical library is available from Aldrich (Milwaukee, Wis.). Combinatorial libraries are available and are prepared. Alternatively, libraries of natural compounds in the form of bacterial, fungal, plant and animal extracts are available from e.g., Pan Laboratories (Bothell, Wash.) or MycoSearch (NC), or are readily produceable by methods well known in the art. Additionally, natural and synthetically produced libraries and compounds are readily modified through conventional chemical, physical, and biochemical means.

Useful compounds may be found within numerous chemical classes. Useful compounds may be organic compounds, or small organic compounds. Small organic compounds have a molecular weight of more than 50 yet less than about 2,500 daltons, preferably less than about 750, more preferably less than about 350 daltons. Exemplary classes include heterocycles, peptides, saccharides, steroids, and the like. The compounds may be modified to enhance efficacy, stability, pharmaceutical compatibility, and the like. Structural identification of an agent may be used to identify, generate, or screen additional agents. For example, where peptide agents are identified, they may be modified in a variety of ways to enhance their stability, such as using an unnatural amino acid, such as a D-amino acid, particularly D-alanine, by functionalizing the amino or carboxylic terminus, e.g. for the amino group, acylation or alkylation, and for the carboxyl group, esterification or amidification, or the like.

A therapeutic agent, according to the invention, can be a gene corresponding to an EST sequence identified from any of the cDNA libraries constructed from cartilage of different development and disease stages.

Each cDNA library revealed a number of EST sequences specific to the particular stage. The ESTs are first characterized according to their putative function (Tables 2-6) and their expression is confirmed by using microarrays, as described herein. Since osteoarthritis is a chronic disease caused by an imbalance between catabolic activity and anabolic activity, that is, an increase in catabolic activity and/or a decrease in anabolic activity, normal- or fetal-specific ESTs may be important in maintaining the normal metabolic function of cartilage so as to maintain a balance between the catabolic activity and the anabolic activity. Therefore, an increased expression of a full length gene sequence corresponding to one or more of these ESTs may restore the anabolic activity in disease cartilage. Therapy involving altered gene expression (e.g., gene therapy, gene disruption, antisense therapy, and the like) is useful according to the invention.

A full-length gene sequence corresponding to one of the normal- or fetal-specific genes is cloned by methods known in the art (e.g., Ausubel et al., John Weley & Sons, Inc., 1997, *Current Protocols in Molecular Biology*). A cloned sequence is transfected into disease chondrocytes isolated from any stage of osteoarthritis (e.g., mild, moderate, marked, and severe). The ability of normal- or fetal-specific genes to complement the anabolic defect in the disease chondrocytes is accessed.

In one embodiment, this is achieved by examining the expression profile of disease chondrocytes transfected with a normal- or fetal-specific gene. A normal- or fetal-specific gene which is capable of restoring the expression profile of disease chondrocytes to more closely resemble that of normal or fetal chondrocytes is a useful candidate for treatment of osteoarthritis.

In another embodiment, the anabolic activity of disease chondrocytes transfected with a normal- or fetal-specific gene is measured as described by Westacott et al. (1996, *Semin Arthritis Rheum,* 25:254-72). A normal- or fetal-specific gene which increases the anabolic activity is useful for treatment of osteoarthritis.

Once a therapeutic gene is defined, the gene sequence is subcloned into a vector suitable for the purpose of gene therapy. Murine leukemia virus (MLV)-based retroviral vectors are one of the most widely, used gene delivery vehicles in gene therapy clinical trials and have been employed in almost 70% of approved protocols (Ali, M. et al., 1994, *Gene Ther.,* 1:367-384; Marshall, 1995, *Science,* 269:1050-1055, 1995). Other useful vectors are also known in the art (e.g., Carter and Samulski, 2000, *Int. J. Mol. Med.* 6:17-27; Lever et al., 1999, *Biochem. Soc. Trans.* 27: 841-7). Methods for gene therapy of human diseases are described in U.S. Pat. Nos. 6,190,907; 6,187,305; 6,140,087; and 6,129,705, for example, the entireties of which are incorporated by reference herein.

Dosage and Administration

Therapeutic agents of the invention are administered to a patient, preferably in a biologically compatible solution or a pharmaceutically acceptable delivery vehicle, by ingestion, injection, inhalation or any number of other methods routine in the art. The dosages administered will vary from patient to patient. A "therapeutically effective dose" is determined, for example, by the level of enhancement of function (e.g., increased or decreased chondrocyte anabolic activity, or an increase or decrease in the expression of at least one nucleic acid sequence that is differentially expressed in a chondrocyte derived from any of the following chondrocyte disease or developmental stages: fetal, normal, mild osteoarthritic, moderate osteoarthritic, marked osteoarthritic or severe osteoarthritic).

A therapeutic agent according to the invention is administered in a single dose. This dosage may be repeated daily, weekly, monthly, yearly, or as considered appropriate by the treating physician.

Pharmaceutical Compositions

The invention provides for compositions comprising a therapeutic agent according to the invention admixed with a physiologically compatible carrier. As used herein, "physiologically compatible carrier" refers to a physiologically acceptable diluent such as water, phosphate buffered saline, or saline, and further may include an adjuvant. Adjuvants such as incomplete Freund's adjuvant, aluminum phosphate, aluminum hydroxide, or alum are materials well known in the art.

The invention also provides for pharmaceutical compositions. In addition to the active ingredients, these pharmaceutical compositions may contain suitable pharmaceutically acceptable carrier preparations which is used pharmaceutically.

Pharmaceutical compositions for oral administration are formulated using pharmaceutically acceptable carriers well known in the art in dosages suitable for oral administration. Such carriers enable the pharmaceutical compositions to be formulated as tablets, pills, dragees, capsules, liquids, gels, syrups, slurries, suspensions and the like, for ingestion by the patient.

Pharmaceutical preparations for oral use are obtained through a combination of active compounds with solid excipient, optionally grinding a resulting mixture, and processing the mixture of granules, after adding suitable auxiliaries, if desired, to obtain tablets or dragee cores. Suitable excipients are carbohydrate or protein fillers such as sugars, including lactose, sucrose, mannitol, or sorbitol; starch from corn, wheat, rice, potato, or other plants; cellulose such as methyl cellulose, hydroxypropylmethyl-cellulose, or sodium carboxymethyl cellulose; and gums including arabic and tragacanth; and proteins such as gelatin and collagen. If desired, disintegrating or solubilizing agents may be added, such as the cross-linked polyvinyl pyrrolidone, agar, alginic acid, or a salt thereof, such as sodium alginate.

Dragee cores are provided with suitable coatings such as concentrated sugar solutions, which may also contain gum arabic, talc, polyvinylpyrrolidone, carbopol gel, polyethylene glycol, and/or titanium dioxide, lacquer solutions, and suitable organic solvents or solvent mixtures. Dyestuffs or pigments may be added to the tablets or dragee coatings for product identification or to characterize the quantity of active compound, i.e., dosage.

Pharmaceutical preparations which are used orally include push-fit capsules made of gelatin, as well as soft, sealed capsules made of gelatin and a coating such as glycerol or sorbitol. Push-fit capsules can contain active ingredients mixed with a filler or binders such as lactose or starches, lubricants such as talc or magnesium stearate, and, optionally, stabilizers. In soft capsules, the active compounds may be dissolved or suspended in suitable liquids, such as fatty oils, liquid paraffin, or liquid polyethylene glycol with or without stabilizers.

Pharmaceutical formulations for parenteral administration include aqueous solutions of active compounds. For injection, the pharmaceutical compositions of the invention may be formulated in aqueous solutions, preferably in physiologically compatible buffers such as Hank's solution, Ringer' solution, or physiologically buffered saline. Aqueous injection suspensions may contain substances which increase the viscosity of the suspension, such as sodium carboxymethyl cellulose, sorbitol, or dextran. Additionally, suspensions of the active solvents or vehicles include fatty oils such as sesame oil, or synthetic fatty acid esters, such as ethyl oleate or triglycerides, or liposomes. Optionally, the suspension may also contain suitable stabilizers or agents which increase the solubility of the compounds to allow for the preparation of highly concentrated solutions.

For nasal administration, penetrants appropriate to the particular barrier to be permeated are used in the formulation. Such penetrants are generally known in the art.

The pharmaceutical compositions of the present invention may be manufactured in a manner known in the art, e.g. by means of conventional mixing, dissolving, granulating, dragee-making, levitating, emulsifying, encapsulating, entrapping or lyophilizing processes.

The pharmaceutical composition may be provided as a salt and are formed with many acids, including but not limited to hydrochloric, sulfuric, acetic, lactic, tartaric, malic, succinic, etc. Salts tend to be more soluble in aqueous or other protonic solvents that are the corresponding free base forms. In other cases, the preferred preparation may be a lyophilized powder in 1 mM-50 mM histidine, 0.1%-2% sucrose, 2%-7% mannitol at a pH range of 4.5 to 5.5 that is combined with buffer prior to use.

After pharmaceutical compositions comprising a therapeutic agent of the invention formulated in a acceptable carrier have been prepared, they are placed in an appropriate container and labeled for treatment of an indicated condition with information including amount, frequency and method of administration.

Efficacy of Osteoarthritis Therapy Using Defined Therapeutic Agents

The efficacy of the therapy using any of the therapeutic agents according to the invention is determined by a medical practitioner. This determination may be related to alleviating osteoarthritis symptoms such as pain, swelling, weakness and loss of functional ability in the afflicted joint(s), and/or criteria for osteoarthritis diagnosis and staging described in Marshall (1996, supra).

The above disclosure generally describes the present invention. A more complete understanding can be obtained by reference to the following specific examples, which are provided herein for purposes of illustration only and are not intended to limit the scope of the invention.

EXAMPLES

The examples below are non-limiting and are merely representative of various aspects and features of the present invention

Example 1

RNA Extraction And Fetal cDNA Library Construction

A cDNA library was prepared from fetal cartilage. ESTs were obtained from the cDNA library and evaluated to create one or more gene expression profiles for fetal chondrocytes.

Human fetal femoral cartilage RNA was extracted from pooled specimens of aborted fetuses (8-12 weeks). Samples were finely powdered under liquid nitrogen, and total RNA was extracted using TRIzol® reagent (GIBCO/BRL). Purity and integrity of RNA was assessed by absorbance at 260/280 nm and agarose gel electrophoresis. The poly (A)+ RNA fraction was isolated by oligo-dT cellulose chromatography (Pharmacia), and 3-5 ug poly (A)+ RNA was used to construct a cDNA library in the λ ZAP Express vector (Stratagene). First-strand cDNA was synthesized with an Xho I-oligo (dT) adapter-primer in the presence of 5'-methyl dCTP. After second-strand synthesis and ligation of EcoRI adapters, the cDNA was digested with Xho I, resulting in cDNA flanked by EcoRI sites at the 5'-ends and Xho I sites at the 3'-ends. Digested cDNAs were size-fractionated in Sephacryl S-500 spin columns (Stratagene), then ligated into the λ ZAP Express vector predigested with EcoRI and Xho I. The resulting DNA/cDNA concatomers were packaged using Gigapack Gold packaging extracts. After titration, aliquots of primary packaging mix were stored in 7% DMSO at −80° C. as primary library stocks, and the rest were amplified to establish stable library stocks.

Large-Scale Sequencing of cDNA Inserts

From the amplified λ ZAP Express library, phage plaques were plated at a density of 200-500 pfu/150 mm plate onto Escherichia coli XL1-blue MRF' lawn with IPTG/X-gal for color selection. Plaques were picked into 75 ul suspension media buffer (100 mM NaCl, 10 mM MgSO$_4$, 1 mM Tris, pH7.5, 0.02% gelatin). Phage elutes (5 ul) were used for PCR reactions (50 ul total volume) with 125 umol/L of each dNTP (Pharmacia), 10 pmol each of modified T3 (5'-GC-CAAGCTCGAAATTAACCCTCACTAAAG GG-3') (SEQ ID NO: 58,993) and T7 (5'-CCAGTGAATTGTAATAC-GACTCACTATAGGGCG-3') (SEQ ID NO: 58,994) primers, and 2 U of Taq DNA polymerase (Pharmacia). Reactions were cycled in a DNA Thermal Cycler (Perkin-Elmer) [denaturation at 95° C. for 5 minutes, followed by 30 cycles of amplification (94° C., 45 seconds; 55° C., 30 seconds; 72° C., 3 minutes) and a terminal isothermal extension (72° C., 3 minutes)]. Agarose gel electrophoresis was used to assess the presence and purity of inserts. PCR products are subjected to DNA sequencing reactions using specific primers, BigDye™ Terminator Cycle Sequencing v2.0 Ready Reaction (PE Biosystems), Tris MgCl buffer and water in a thermocycler. Sequencing reactions were incubated at 94° C. for 2 minutes, followed by 25 cycles of 94° C., 30 seconds; 55° C., 20 seconds; and 72° C., 1 minute; and 15 cycles of 94° C., 30 seconds; and 72° C. for 1 minute; and 72° C. for 5 minutes. Reactions were then put on hold at 4° C. until purified through methods well known in the prior art (i.e. column purification or alcohol precipitation). Automated sequencing was carried out with a PE Biosystems ABI Prism 3700 DNA Analyzer.

Sequences were manually edited or edited using Sequencher software (GeneCodes). All edited EST sequences were compared to the non-redundant Genbank/EMBL/DDBJ and dbEST databases using the BLAST algorithm (8). A minimum value of $P=10^{-10}$ and nucleotide sequence identity >95% were required for assignments of putative identities for ESTs matching to known genes or to other ESTs. Construction of a non-redundant list of genes represented in the EST set was done with the help of Unigene, Entrez and PubMed at the National Center for Biotechnology Information (NCBI) site (at www.ncbi.nlm.nih.gov/). Relative gene expression frequency was calculated by dividing the number of EST copies for each gene by the total number of ESTs analyzed. Functional characterization of ESTs with known gene matches was made according to the categories described by Hwang et al., "A Genome-Based Resource for Molecular Cardiovascular Medicine: Toward a Compendium of Cardiovascular Genes."*Circulation* 1997; 96:4146-203).

A total of 13,398 ESTs were obtained from the human fetal cartilage cDNA library. Of these, 5,747 ESTs (41.8%) matched to known gene sequences, 1,855 ESTs (13.4%) matched to other ESTs, and 3,053 (22.0%) matched to mitochondrial, ribosomal, vector and cDNA/hypothetical protein sequences. The 209 ESTs (4.7%) that did not match to any known sequences were designated as novel. The remainder matched to genomic DNA sequences (1,948 ESTs, 13.8%) and repetitive sequences (586 ESTs, 4.3%).

The 13,398 EST sequences in the fetal library were characterized based on the functional classification of the 2,579 unique known genes they represented. The following table sets out the results of this analysis.

TABLE 2

Fetal Cartilage Library

| Putative Function | Percent (%) of Representation in the Library | Number of genes |
|---|---|---|
| Cell division | 7.06 | 182 |
| Cell signaling/communication | 15.01 | 387 |
| Cell structure/motility | 10.90 | 281 |
| Cell/organism defense | 7.60 | 196 |
| Gene/protein expression | 22.22 | 573 |
| Metabolism | 14.89 | 384 |
| Unclassified | 22.33 | 576 |
| Total known/unique genes analyzed | 100.00 | 2,579 |

Example 2

RNA Extraction and Normal Adult cDNA Library Construction

A cDNA library was prepared from normal adult cartilage. ESTs were obtained from the cDNA library and characterized to create one or more gene expression profiles for normal adult chondrocytes.

Large-Scale Sequencing of cDNA Inserts cDNA libraries were constructed into λTripleEx2 vector through a PCR-based method, using SMART (Switching Mechanism At 5' end of RNA Transcript) cDNA Library Construction Kit (Clontech). Phage plaques were randomly picked and positive inserts were identified by PCR. Agarose gel electrophoresis was used to assess the presence and purity of inserts. PCR product was then subjected to automated DNA sequencing with a 5' vector-specific forward primer and sequenced by ABI PRISM 377 DNA sequencer (Perkin Elmer) and ABI PRISM 3700 DNA Analyzer (Applied Biosystems). All generated EST sequences were searched against the nonredundant Genebank/EMBL/DDBL, dbEST and GSS databases. A minimum value of $p=10^{-10}$ and nucleotide sequence identity >90% were required for assignments of putative identities for EST-matching to known genes or other ESTs. Relative EST frequency level was calculated by dividing the EST number matched to that gene into the total number of ESTs obtained from the library.

Sequences were manually edited or edited using Sequencher software (GeneCodes). All edited EST sequences were compared to the non-redundant Genbank/EMBL/DDBJ and dbEST databases using the BLAST algorithm (8). A minimum value of $P=10^{-10}$ and nucleotide sequence identity >95% were required for assignments of putative identities for ESTs matching to known genes or to other ESTs. Construction of a non-redundant list of genes represented in the EST set was done with the help of Unigene, Entrez and PubMed at the National Center for Biotechnology Information (NCBI) site (at www.ncbi.nlm.nih.gov/). Relative gene expression frequency was calculated by dividing the number of EST copies for each gene by the total number of ESTs analyzed. Functional characterization of ESTs with known gene matches was made according to the categories described by Hwang et al (Hwang D M, Dempsey A A, Wang R X, Rezvani M, Barrans J D, Dai K S, et al. A Genome-Based Resource for Molecular Cardiovascular Medicine Toward a Compendium of Cardiovascular Genes. Circulation 1997; 96:4146-203).

A total of 17,151 ESTs were obtained from the normal cartilage cDNA library. Of these, 6,755 ESTs (44.2%) matched to 2,518 known genes. 1.4% (132 ESTs) showed no significant match and were thus designated as novel. Characterization of the 17,151 EST sequences based on functional classification of known/unique genes resulted in the following table:

TABLE 3

Normal Adult Cartilage Library

| Putative function | Percent (%) of representation in the library | Number of genes |
| --- | --- | --- |
| Cell division | 6.13 | 160 |
| Cell signaling/communication | 13.52 | 353 |
| Cell structure/motility | 9.00 | 235 |
| Cell/organism defense | 7.51 | 196 |
| Gene/protein expression | 20.08 | 524 |
| Metabolism | 13.14 | 343 |
| Unclassified | 27.09 | 707 |
| Total known/unique genes analyzed | 100.00 | 2518 |

Example 3

RNA Extraction and cDNA Library Construction from Mild Osteoarthritic Chondrocytes and Severe Osteoarthritic Chondrocytes A cDNA library was prepared from mild osteoarthritic cartilage and severe osteoarthritic cartilage. ESTs were obtained from the cDNA libraries and characterized to create one or more gene expression profiles for mild osteoarthritic chondrocytes and severe osteoarthritic chondrocytes.

Articular cartilage was obtained during either arthroscopic knee surgery or total knee replacement. The cartilage samples were obtained from either areas of very early cartilage degeneration (mild) or from sites of end stage disease (severe). cDNA libraries were constructed as described for normal adult samples (Example 2).

Large-Scale Sequencing of cDNA Inserts cDNA libraries were constructed into λTripleEx2 vector through a PCR-based method, using SMART (Switching Mechanism At 5' end of RNA Transcript) cDNA Library Construction Kit (Clontech). Phage plaques were randomly picked and positive inserts were identified by PCR. Agarose gel electrophoresis was used to assess the presence and purity of inserts. PCR product was then subjected to automated DNA sequencing with a 5' vector-specific forward primer and sequenced by ABI PRISM 377 DNA sequencer (Perkin Elmer) and ABI PRISM 3700 DNA Analyzer (Applied Biosystems). All generated EST sequences were searched against the nonredundant Genebank/EMBL/DDBL, dbEST and GSS databases. A minimum value of $p=10^{-10}$ and nucleotide sequence identity >90% were required for assignments of putative identities for EST-matching to known genes or other ESTs. Relative EST frequency level was calculated by dividing the EST number matched to that gene into the total number of ESTs obtained from the library.

Sequences were manually edited or edited using Sequencher software (GeneCodes). All edited EST sequences were compared to the non-redundant Genbank/EMBL/DDBJ and dbEST databases using the BLAST algorithm (8). A minimum value of $P=10^{-10}$ and nucleotide sequence identity >95% were required for assignments of putative identities for ESTs matching to known genes or to other ESTs.

Construction of a non-redundant list of genes represented in the EST set was done with the help of Unigene, Entrez and PubMed at the National Center for Biotechnology Information (NCBI) site (http://www.ncbi.nlm.nih.gov/). Relative gene expression frequency was calculated by dividing the number of EST copies for each gene by the total number of ESTs analyzed.

Functional characterization of ESTs with known gene matches was made according to the categories described by Hwang et al (Hwang D M, Dempsey A A, Wang R X, Rezvani M, Barrans J D, Dai K S, et al. A Genome-Based Resource for Molecular Cardiovascular Medicine: Toward a Compendium of Cardiovascular Genes. Circulation 1997; 96:4146-203).

A total of 12,651 ESTs and 14,222 ESTs were obtained from the mild and severe OA cDNA libraries (Table 4 and Table 5), respectively. About 43% of mild and 51% of severe OA ESTs matched to known genes in the database. Approximately 2.6% and 1.5% of the ESTs, respectively, resulted in no significant match and were thus designated as novel.

Characterization of the 12,651 EST sequences from the mild OA library and of the 14,222 EST sequences from the severe OA library based on functional characterization of the known genes represented resulted in the following tables:

TABLE 4

Mild OA Cartilage Library

| Putative Function | Percent (%) of Representation in the Library | Number of Genes |
|---|---|---|
| Cell division | 6.39 | 127 |
| Cell signaling/communication | 15.31 | 304 |
| Cell structure/motility | 9.16 | 182 |
| Cell/organism defense | 8.41 | 167 |
| Gene/protein expression | 21.60 | 429 |
| Metabolism | 13.95 | 277 |
| Unclassified | 22.76 | 452 |
| Total known/unique genes analyzed | 100.00 | 1938 |

TABLE 5

Severe OA Cartilage Library

| Putative Function | Percent (%) of Representation in the Library | Number of genes |
|---|---|---|
| Cell division | 6.81 | 157 |
| Cell signaling/communication | 14.14 | 326 |
| Cell structure/motility | 8.50 | 196 |
| Cell/organism defense | 7.98 | 184 |
| Gene/protein expression | 22.94 | 529 |
| Metabolism | 13.53 | 312 |
| Unclassified | 23.94 | 552 |
| Total known/unique genes analyzed | 100.00 | 2256 |

Example 4

Identification of Differentially Expressed Genes in Fetal, Normal Mild Osteoarthritic, and Severe Osteoarthritic Cartilage Genes that are differentially expressed as defined herein between normal, mild, severe and fetal cartilage were identified through relative EST frequency analysis (see Table 13). Of the 5,807 known unique genes identified in Table 13, 405 genes were found to be expressed in all four tissue types. Examples of the possible subanalyses are shown in Tables 27 and 28. Some of these genes with particularly marked differential expression are shown in FIG. 4 and Table 11. The relative frequency of ESTs representing collagens (FIG. 2 and Table 9, and FIG. 3 and Table 10) and selected extracellular matrix proteins (see FIG. 1 and Table 8) were also analyzed.

Example 5

Microarray Construction

A microarray according to the invention was constructed as follows.

PCR products (~40 ul) of cDNA clones from OA cartilage cDNA libraries, in the same 96-well tubes used for amplification, are precipitated with 4 ul (1/10 volume) of 3M sodium acetate (pH 5.2) and 100 ul (2.5 volumes) of ethanol and stored overnight at −20° C. They are then centrifuged at 3,300 rpm at 4° C. for 1 hour. The obtained pellets were washed with 50 ul ice-cold 70% ethanol and centrifuged again for 30 minutes. The pellets are then air-dried and resuspended well in 50% dimethylsulfoxide (DMSO) or 20 ul 3×SSC overnight. The samples are then deposited either singly or in duplicate onto Gamma Amino Propyl Silane (Corning CMT-GAPS or CMT-GAP2, Catalog No. 40003, 40004) or polylysine-coated slides (Sigma Cat. No. P0425) using a robotic GMS 417 or 427 arrayer (Affymetrix, CA). The boundaries of the DNA spots on the microarray are marked with a diamond scriber. The invention provides for arrays where 10-20,000 PCR products are spotted onto a solid support to prepare an array.

The arrays are rehydrated by suspending the slides over a dish of warm particle free $ddH_2O$ for approximately one minute (the spots will swell slightly but not run into each other) and snap-dried on a 70-80° C. inverted heating block for 3 seconds. DNA is then UV crosslinked to the slide (Stratagene, Stratalinker, 65 mJ—set display to "650" which is 650×100 uJ) or baked at 80 C for two to four hours. The arrays are placed in a slide rack. An empty slide chamber is prepared and filled with the following solution: 3.0 grams of succinic anhydride (Aldrich) is dissolved in 189 ml of 1-methyl-2-pyrrolidinone (rapid addition of reagent is crucial); immediately after the last flake of succinic anhydride dissolved, 21.0 ml of 0.2 M sodium borate is mixed in and the solution is poured into the slide chamber. The slide rack is plunged rapidly and evenly in the slide chamber and vigorously shaken up and down for a few seconds, making sure the slides never leave the solution, and then mixed on an orbital shaker for 15-20 minutes. The slide rack is then gently plunged in 95° C. $ddH_2O$ for 2 minutes, followed by plunging five times in 95% ethanol. The slides are then air dried by allowing excess ethanol to drip onto paper towels. The arrays are then stored in the slide box at room temperature until use.

Example 6

Target Nucleic Acid Preparation and Hybridization

Preparation of Fluorescent DNA Probe from mRNA

Fluorescently labeled target nucleic acid samples are prepared for analysis with an array of the invention.

2 μg Oligo-dT primers are annealed to 2 ug of mRNA isolated from a cartilage sample from patient diagnosed with osteoarthritis or suspected of having osteoarthritis in a total volume of 15 ul, by heating to 70° C. for 10 min, and cooled on ice. The mRNA is reverse transcribed by incubating the sample at 42° C. for 1.5-2 hours in a 100 μl volume containing a final concentration of 50 mM Tris-HCl (pH 8.3), 75 mM KCl, 3 mM MgCl2, 25 mM DTT, 25 mM unlabeled dNTPs, 400 units of Superscript II (200 U/uL, Gibco BRL), and 15 mM of Cy3 or Cy5 (Amersham). RNA is then degraded by addition of 15 μl of 0.1N NaOH, and incubation at 70° C. for 10 min. The reaction mixture is neutralized by addition of 15 μl of 0.1N HCL, and the volume is brought to 500 μl with TE (10 mM Tris, 1 mM EDTA), and 20 μg of Cot1 human DNA (Gibco-BRL) is added.

The labeled target nucleic acid sample is purified by centrifugation in a Centricon-30 micro-concentrator (Amicon). If two different target nucleic acid samples (e.g., two samples derived from different patients) are being analyzed and compared by hybridization to the same array, each target nucleic acid sample is labeled with a different fluorescent label (e.g., Cy3 and Cy5) and separately concentrated. The separately concentrated target nucleic acid samples (Cy3 and Cy5 labeled) are combined into a fresh centricon, washed with 500 μl TE, and concentrated again to a volume of less than 70 μL of 10μ g/μl polyA RNA (Sigma, #P9403) and 1 μl of 10 μg/ul tRNA (Gibco-BRL, #15401-011) is added and the volume is adjusted to 9.5 μl with distilled water. For final target nucleic acid preparation 2.1 μl 20×SSC (1.5M NaCl, 150 mM NaCltrate (pH8.0)) and 0.35 μl 10% SDS is added.

Hybridization

Labeled nucleic acid is denatured by heating for 2 min at 100° C., and incubated at 37° C. for 20-30 min before being placed on a nucleic acid array under a 22 mm×22 mm glass cover slip. Hybridization is carried out at 65° C. for 14 to 18 hours in a custom slide chamber with humidity maintained by a small reservoir of 3×SSC. The array is washed by submersion and agitation for 2-5 min in 2×SSC with 0.1% SDS, followed by 1×SSC, and 0.1×SSC. Finally, the array is dried by centrifugation for 2 min in a slide rack in a Beckman GS-6 tabletop centrifuge in Microplus carriers at 650 RPM for 2 min.

Example 7

Signal Detection and Data Generation

Following hybridization of an array with one or more labeled target nucleic acid samples, arrays are scanned immediately using a GMS Scanner 418 and Scanalyzer software (Michael Eisen, Stanford University), followed by Gene-Spring software (Silicon Genetics, CA) analysis. Alternatively, a GMS Scanner 428 and Jaguar software may be used followed by GeneSpring software analysis If one target nucleic acid sample is analyzed, the sample is labeled with one fluorescent dye (e.g., Cy3 or Cy5).

After hybridization to a microarray as described in Example 6, fluorescence intensities at the associated nucleic acid members on the microarray are determined from images taken with a custom confocal microscope equipped with laser excitation sources and interference filters appropriate for the Cy3 or Cy5 fluors.

The presence of Cy3 or Cy5 fluorescent dye on the microarray indicates hybridization of a target nucleic acid and a specific nucleic acid member on the microarray. The intensity of Cy3 or Cy5 fluorescence represents the amount of target nucleic acid which is hybridized to the nucleic acid member on the microarray, and is indicative of the expression level of the specific nucleic acid member sequence in the target sample.

When two target nucleic acid samples are being analyzed and compared (e.g., mild osteoarthritic vs severe osteoarthritic), one target nucleic acid sample (for example, mild osteoarthritic) is labeled with fluorescent dye Cy3, the other target nucleic acid sample (for example, severe osteoarthritis) is labeled with fluorescent dye Cy5.

After hybridization as described in Example 6, fluorescence intensities at the associated nucleic acid members on the microarray are determined from images taken with a custom confocal microscope equipped with laser excitation sources and interference filters appropriate for the Cy3 and Cy5 fluors. Separate scans are taken for each fluor at a resolution of 225 μm$^2$ per pixel and 65,536 gray levels. Normalization between the images is used to adjust for the different efficiencies in labeling and detection with the two different fluors. This is achieved by manual matching of the detection sensitivities to bring a set of internal control genes to nearly equal intensity followed by computational calculation of the residual scalar required for optimal intensity matching for this set of genes.

The presence of Cy3 or Cy5 fluorescent dye on the microarray indicates hybridization of a target nucleic acid and a specific nucleic acid member on the microarray. The intensities of Cy3 or Cy5 fluorescence represent the amount of target nucleic acid which is hybridized to the nucleic acid member on the microarray, and is indicative of the expression level of the specific nucleic acid member sequence in the target sample. If a nucleic acid member on the array shows no color, it indicates that the gene in that element is not expressed in either sample. If a nucleic acid member on the array shows a single color, it indicates that a labeled gene is expressed only in that cell sample. The appearance of both colors indicates that the gene is expressed in both tissue samples. The differences in Cy3 and Cy5 fluorescence intensities, after normalization, are indicative of differences of expression levels of the associated nucleic acid member sequence in the two samples for comparison. Differences in expression intensity between the two samples greater than 1.0 fold are used as an indication of differential gene expression.

The array is scanned in the Cy 3 and Cy5 channels and stored as separate 16-bit TIFF images. The images are incorporated and analysed using Scanalyzer software which includes a gridding process to capture the hybridization intensity data from each spot on the array. The fluorescence intensity and background-subtracted hybridization intensity of each spot is collected and a ratio of measured mean intensities of Cy5 to Cy3 is calculated. A liner regression approach is used for normalization and assumes that a scatter plot of the measured Cy5 versus Cy3 intensities should have a scope of one. The average of the ratios is calculated and used to rescale the data and adjust the slope to one. A post-normalization cutoff of greater than 1.0 fold up- or down-regulation is used to identify differentially expressed genes.

Analysis of a microarray comprising some of the sequences in Table 26, resulted in 36 candidate upregulated genes in the mild OA library that showed a greater than 2-fold median ratio and 47 candidate downregulated genes that showed a less than 0.2-fold median ratio (Tables 21 and 22, respectively,). A total of 38 candidate upregulated genes were also identified in the severe OA library that showed a greater than 2-fold median ratio and 51 candidate downregulated genes that showed a less than 0.2-fold median ratio (Tables 23 and 24, respectively,). According to this embodiment, the microarray was hybridized with a target nucleic acid sample derived from an individual diagnosed with mild osteoarthritis and a target nucleic acid sample derived from an individual diagnosed with severe osteoarthritis. As would be clear to a person skilled in the art, similar analysis can be performed for any of the sequences identified in Table 25, or the sequences identified in Table 14 which correspond to the genes disclosed in Table 13 using the methods disclosed herein. Table 14 lists the names of the EST sequences identified in the four cDNA libraries that represent each of the unique known genes identified in Table 13.

Example 8

Chondrocyte-Specific Gene Microarray and Diagnosis Microarray Construction

A collection of nucleic acid members are spotted on a glass slide as described in Example 5 for the construction of a mild OA diagnosis microarray. A collection of nucleic acid members are spotted on a glass slide as described in Example 5 for the construction of a severe OA diagnosis microarray. A collection of chondrocyte specific nucleic acid members are spotted on a glass slide as described in Example 5 for the construction of a chondrocyte-specific gene microarray. The nucleic acid members spotted onto the microarrays described are selected from those named in Tables 15, 16, 17 and 18. Table 15 lists the names of all of the EST sequences identified from the cDNA library constructed from fetal cartilage tissue according to one embodiment of the invention. Table 16 lists the names of all of the EST sequences identified from the cDNA library constructed from normal cartilage tissue where such tissue is obtained less than 14 hours post-mortem according to one embodiment of the invention. Table 17 lists the names of all of the EST sequences identified from the cDNA library constructed from cartilage of patients with mild osteoarthritis according to one embodiment of the invention. Table 18 lists the names of all of the EST sequences identified from the cDNA library constructed from cartilage of patients with severe osteoarthritis according to one embodiment of the invention.

Table 26 contains all of the EST identified from the four human cartilage cDNA libraries according to one embodiment of the invention. A subset of sequences in this Table was filed as a CD ROM in U.S. provisional application 60/271, 955, filed Feb. 28, 2001 and as a hard copy in U.S. provisional application 60/275,017, filed Mar. 12, 2001. The names of all of the EST sequences in Table 26 are listed in Tables 15, 16, 17 and 18.

Example 9

Diagnosis

Target nucleic acid samples are prepared from cartilage RNA extracts of an individual (as described in Example 6) and hybridized to a microarray comprising a collection of nucleic acid members where at least one member is differentially expressed in cartilage isolated from a patient diagnosed with mild, moderate, marked or severe osteoarthritis, as compared to cartilage isolated from a normal individual as defined herein (as described in Example 6). A hybridization pattern is generated and analyzed as in Example 7. For example, the hybridization of target nucleic acid samples to one or more nucleic acid members on the microarray comprising a collection of nucleic acid members where at least one member is differentially expressed in mild osteoarthritis cartilage as compared to a normal individual is indicative of a mild osteoarthritis of the individual from whom the target nucleic acid sample is derived. The hybridization of target nucleic acid samples to one or more nucleic acid members on the microarray comprising a collection of nucleic acid members differentially expressed in severe osteoarthritis cartilage as compared to the normal individual is indicative of severe osteoarthritis of the individual from whom the target nucleic acid sample is derived.

When diagnosing mild osteoarthritis, the array preferably comprises at least one sequence selected from Table 29, Table 33, Table 40 and Table 44, more preferably a majority of sequences selected from Table 29, Table 33, Table 40 and Table 44 are chosen. More preferably the array comprises at least one sequence selected from Table 33 and Table 44, more preferably the array comprises a majority of sequences selected from Table 33 and Table 44. When diagnosing severe osteoarthritis, the array preferably comprises at least one sequences selected from the sequences of Table 29, Table 37, Table 40 and Table 48. More preferably the array comprises a majority of sequences selected from Table 29, Table 37, Table 40 and Table 48. More preferably, the array comprises at least one sequence selected from the sequences of Table 37 and Table 48, more preferably, the array comprises a majority of sequences selected from the sequences of Table 37 and Table 48.

Example 10

Therapeutic Agent Screening

A candidate therapeutic agent that increases or decreases the expression of one or more nucleic acid sequences that are differentially expressed in a chondrocyte derived from any of the following chondrocyte disease or developmental stages: fetal, mild osteoarthritic, moderate osteoarthritic, marked osteoarthritic and severe osteoarthritic, is screened according to the following method.

Chondrocytes are isolated from a "normal" individual and are incubated in the presence and absence of a candidate agent for varying amounts of time (i.e., 30 min, 1 hr, 5 hr, 24 hr, 48 hr and 96 hrs). When screening for therapeutic genes, a clone of a full gene sequence corresponding to an EST in Table 14 or Table 25 is used to transfect chondrocytes. The transfected chondrocytes are cultured for varying amounts of time (i.e., 1, 2, 3, 5, 7, 10, or 14 days). Following incubation, target nucleic acid samples are prepared from the chondrocytes and hybridized to a nucleic acid probe corresponding to a nucleic acid sequence which is differentially expressed in a chondrocyte derived from at least any two of the following of: fetal, normal, mild osteoarthritic, moderate osteoarthritic and severe osteoarthritic. The nucleic acid probe is labeled, for example with a radioactive label, according to methods well-known in the art and described herein. Hybridization is carried out by northern blot, for example as described in Ausubel et al., supra or Sambrook et al., supra). The differential hybridization, as defined herein, of the probe to the target nucleic acid samples from normal relative to RNA from any one of fetal, mild osteoarthritic, moderate osteoarthritic, marked osteoarthritic and severe osteoarthritic is indicative of the level of expression of RNA corresponding to a differentially expressed chondrocyte specific nucleic acid sequence. A change in the level of expression of the probe sequence as a result of the incubation step in the presence of the candidate agent, is indicative of an agent that increases or decreases the expression of the corresponding chondrocyte specific nucleic acid sequence.

Example 11

Assessing the Integrity of Cartilage RNA Isolated Post-Mortem

The following Baboon cartilage study was preformed to evaluate the quality of freshly isolated RNA and RNA isolated at various times post-mortem.

Nine vials of baboon cartilage were obtained, and stored in liquid nitrogen till use.

Baboon cartilage from each vial was weighed and finely powdered under liquid nitrogen. The sample was then homogenized in TRIzol® reagent (0.1 g/ml TRIzol®) and total RNA was extracted. The quantity of RNA was calculated according to the $OD_{260}$ value. The appearance of two sharp bands on the RNA gel indicated that the RNA was of good quality.

RT-PCR was performed for the gene expression of collagen type II (COL2A 1), B-actin and GAPDH, using 0.1 ug total RNA from each sample.

The RNA gel pattern clearly shows that the RNA was not degraded up to 12 hours post-mortem (Table 6). Therefore stable RNA should be expected from the biopsy sample within 12 hours after death.

TABLE 6

Integrity Of Cartilage RNA Isolated Post-Mortem

| Sample No. | Time Taken | Weight (g) | Total RNA (ug)- Based on OD260 | RNA Gel (non Dil) | Col2A1 | b-actin | GAPDH |
|---|---|---|---|---|---|---|---|
| 1 | Fresh | 0.175 | 8 | OK | ++ | ++ | ++ |
| 2 | 1 hr pm | 0.29 | 9 | OK | ++ | ++ | ++ |
| 3 | 2 hr | 0.29 | 11.36 | OK | ++ | +/− | +/− |
| 4 | 3 hr | 0.25 | 2.8 | OK | ++ | +/− | +/− |
| 5 | 6 hr | 0.53 | 8.0 | OK | ++ | + | +/− |
| 6 | 8 hr | 0.18 | 5.26 | OK | ++ | + | − |
| 7 | 10 hr | 0.38 | 9.35 | OK | ++ | + | +/− |
| 8 | 12 hr | 0.20 | 6.7 | OK | ++ | +/− | − |
| 9 | 24 hr | 0.41 | 9.35 | SMEAR | +/− | − | − |

Collagen type II is abundant and specific to normal articular cartilage. Its mRNA level was comparable among all the samples except #9 (24 hours post-mortem). It should be noted that samples taken earlier will better reflect the natural in vivo state.

Example 12

Expressed Sequence Tags (ESTs) Analysis of Human Chondrocyte Gene Expression in Mild and Severe Osteoarthritic Cartilage Large-scale partial sequencing of cDNA libraries obtained from human fetal cartilage was performed to identify expressed sequence tags (ESTs) corresponding to genes that might play critical roles in OA progression. Large scale sequencing of cDNA libraries from human normal, mild and severe OA cartilage was also performed and a total of over 44,000 ESTs from the three cDNA libraries were analyzed.

Normal cartilage was obtained from the donor program of Department of Orthopaedics and Rehabilitation, University of Miami. OA cartilage samples were obtained from either areas of very early cartilage degeneration (mild) or from sites of end stage disease (severe) during either arthroscopic knee surgery or total knee replacement. Total RNA from cartilage was extracted using TRIzol® reagent (GIBCO). cDNA libraries were constructed into λTriplEx2 vector through a PCR-based method, using SMART (switching Mechanism At 5' end of RNA Transcript) cDNA Library Construction Kit (Clontech) as described above. Phage plaques were randomly picked and positive inserts were identified by PCR. Agarose gel electrophoresis was used to assess the presence and purity of inserts. PCR product was then subjected to automated DNA sequencing with a 5' vector-specific forward primer and sequenced by ABI PRISM 377 DNA sequencer (Perkin Elmer) and ABI PRISM 3700 DNA Analyzer (Applied Biosystems). All generated EST sequences were searched against the nonredundant Genebank/EMBL/DDBL, dbEST and GSS databases. A minimum value of $p=10^{-10}$ and nucleotide sequence identity >90% were required for assignments of putative identities for EST-matching to known genes or other ESTs. Relative EST frequency level was calculated by dividing the EST number matched to that gene into the total number of ESTs obtained from the library.

A total of 17,151 ESTs, 12,651 ESTs and 14,222 ESTs were obtained from normal, mild and severe OA cDNA libraries respectively and used for gene expression profiling. About 44% of the total ESTs from these three cDNA libraries matched to known genes in the database, and about 0.9% of the ESTs (409) resulted in no significant match to known sequences and were thus designated as novel. Nonredundancy analysis of the known gene matches resulted in the identification of 2,518 unique genes in normal, 1,938 in mild and 2,256 in severe OA cartilage. Differentially expressed known genes amongst fetal (22), normal, mild, and severe OA cartilage (23) were identified by examining relative EST frequency levels as shown in Table 13.

Some of the genes with particularly marked differential expression are shown in FIG. 4 and Table 11 provided herewith. Heat shock protein 90 (HSP90) was the gene with the most abundant ESTs matches in mild OA. Its transcript level was low in fetal cartilage. Beta-2 microglobulin (B2M) level was higher in diseased cartilage than normal cartilage, and significantly higher in diseased cartilage than in fetal cartilage. Its EST levels in mild and severe OA were similar. Osteoblast specific factor 2 (OSF-2 pl) was highly expressed in severe OA compared to fetal, mild and normal cartilage. Another differentially expressed gene was megakaryocyte stimulating factor (MSF, also known as superficial zone protein, or proteoglycan 4). It had a significantly higher expression in mild OA than in severe OA.

Figure 3:
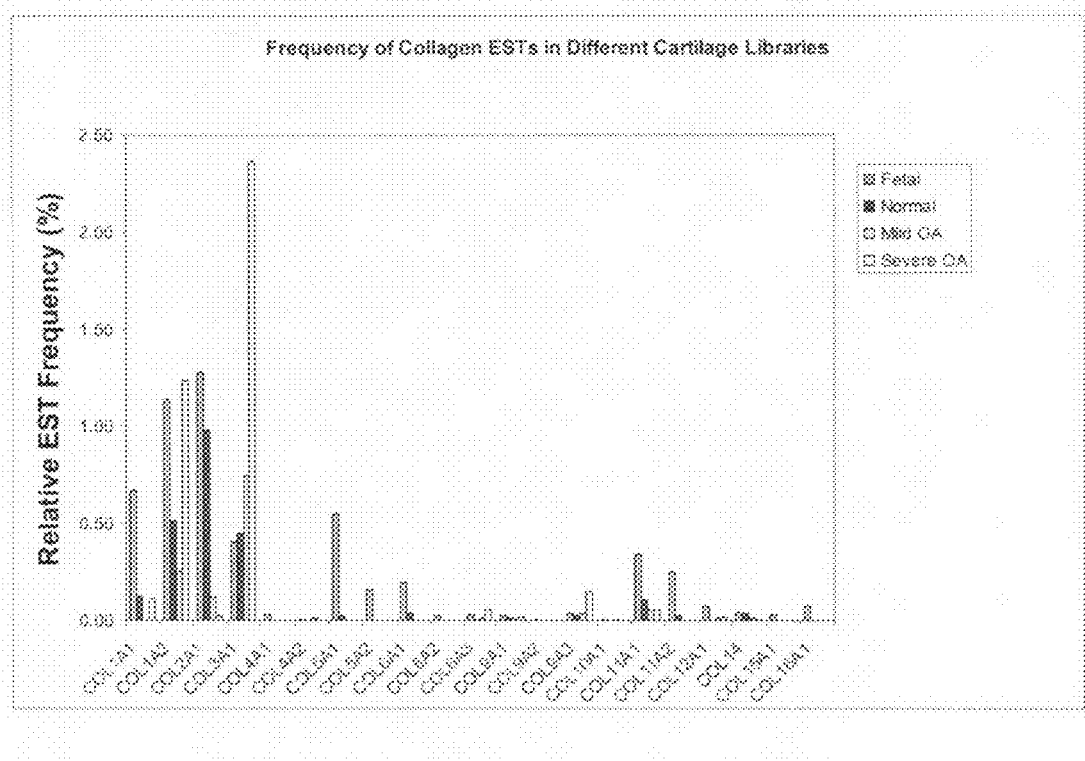
FIG. 3 is a graph according to one embodiment of the invention showing the relative EST levels of specific collagen types among the fetal, normal, mild osteoarthritic and severe osteoarthritic cartilage cDNA libraries.
Figure 4:
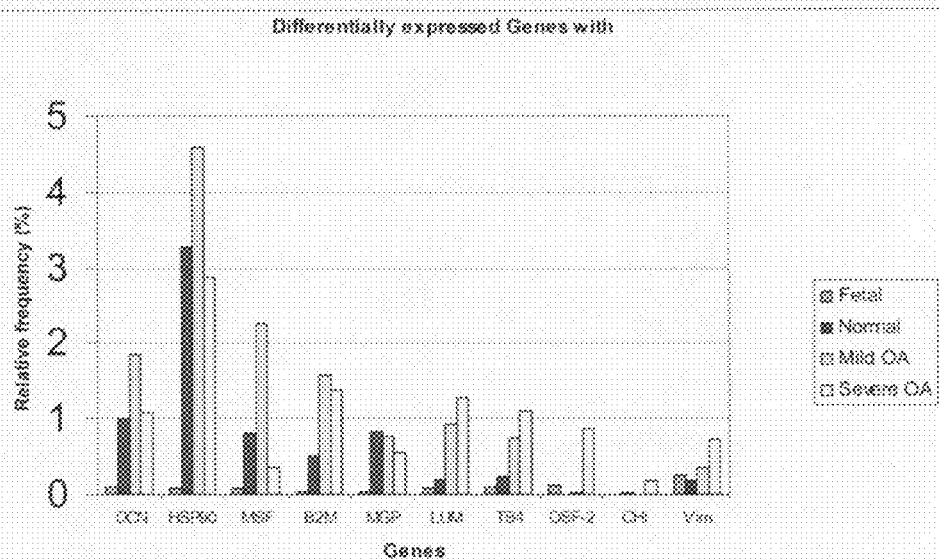
FIG. 4 is a graph according to one embodiment of the invention showing the relative EST frequency level of selected chondrocyte genes among the fetal, normal, mild osteoarthritic and severe osteoarthritic cDNA libraries. Legend: DCN=decorin/chondroitin dermatan sulfate proteoglycan (PG40), HSP90=heatshock protein 90/alpha gene sequence, MSF=megakaryocyte stimulating factor/proteoglycan 4/superficial zone protein, B2M=beta 2 microglobulin, MGP=matrix Gla protein, LUM=lumican, TB4=thymosin beta 4, OSF-2=mRNA for osteoblast specific factor 2, CHI=chitinase, Vim=vimentin.
Figure 5:
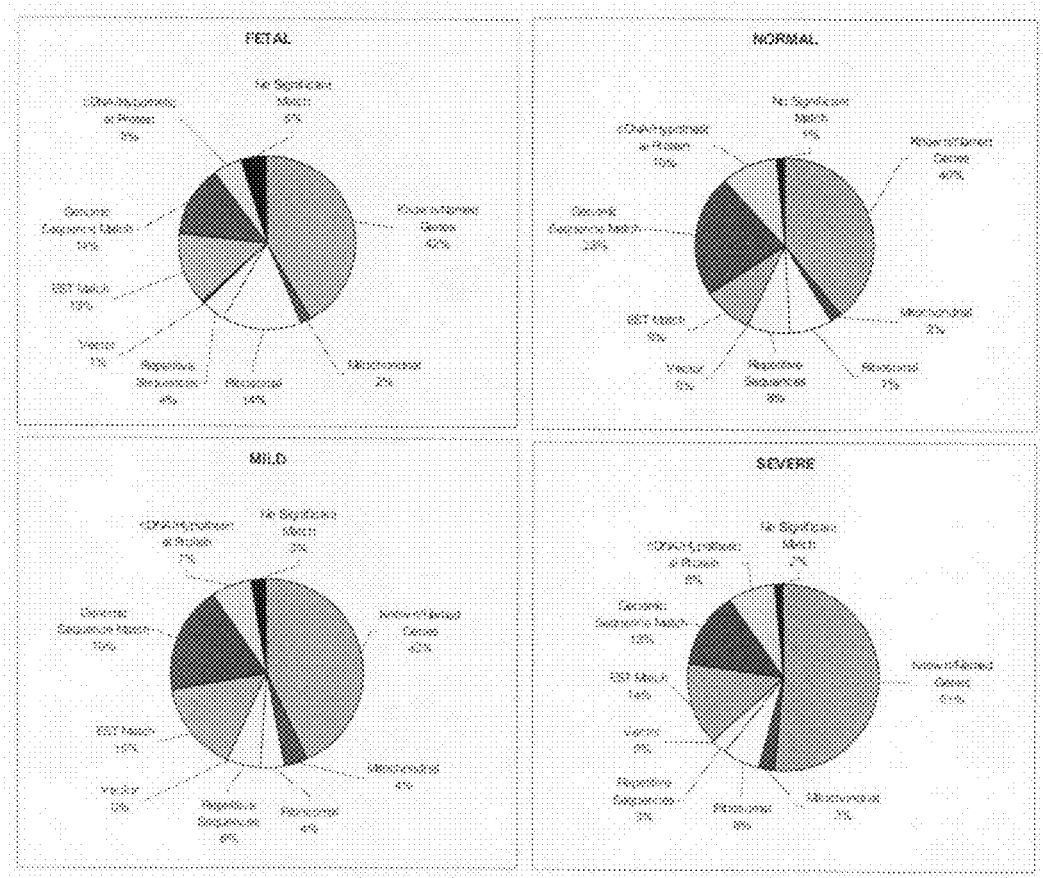
FIG. 5 is a graphical representation of the data presented in Table 12 according to one embodiment of the invention.
Figure 6:
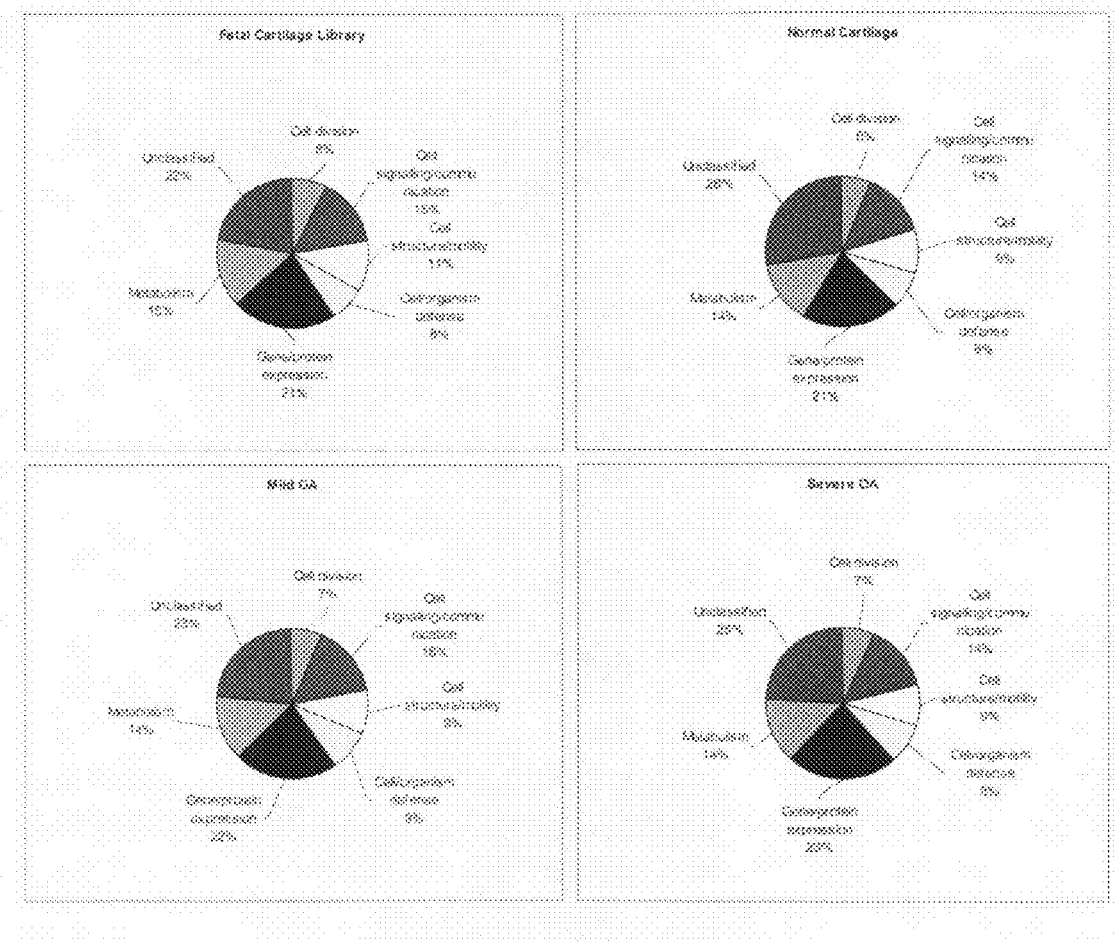
FIG. 6 is a graphical representation of the data presented in Table 19 according to one embodiment of the invention.

The relative frequency of ESTs representing the collagens was also analyzed as shown in FIG. 3 and Table 10.

Figure 2:
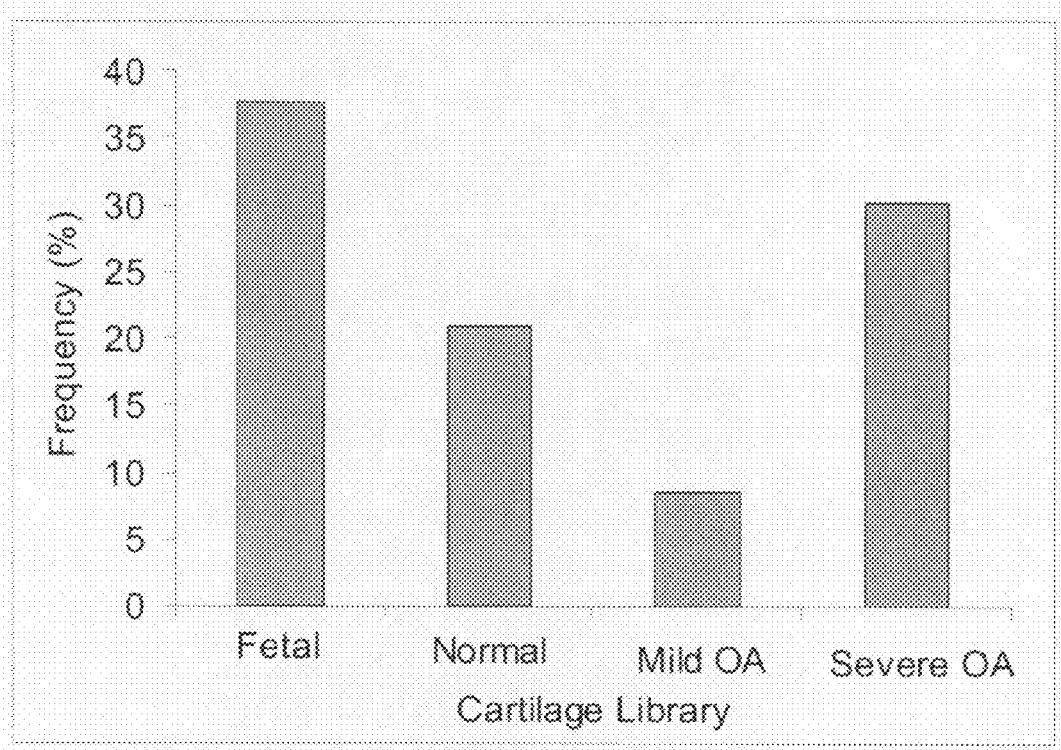
FIG. 2 is a graph according to one embodiment of the invention showing the relative EST frequency level of collagens among the fetal, normal, mild osteoarthritic and severe osteoarthritic cartilage cDNA libraries.

Noncollagenous matrix protein profiles showed higher EST levels of decorin (DCN), fibronectin (FN), lumican (LUM) and matrix Gla protein (MGP) in both mild and severe OA cartilage as shown in FIG. 1 and Table 8, and in FIG. 4 and Table 11 provided herewith.

Example 13

Microarray Analysis of Beta-2 Microglobulin (B2M) Expression in Human Osteoarthritis As discussed above, Beta-2 microglobulin (B2M) had a high EST expression level in mild and severe OA cartilage. B2M is a nonglycosylated polypeptide that is elevated in inflammatory and malignant diseases. It has been shown to induce stromelysin and cyclooxygenase-2 synthesis in human synovial fibroblasts (24, 25).

B2M expression during different stages of osteoarthritis was evaluated. Human OA synovial fluid (SF) was collected from human knee joint by aspiration at arthroscopy or total knee replacement. Normal samples were collected from volunteers with no history of knee injury or arthritis. Organ culture was performed as follows: human severe OA cartilage slices were cultured at one slice/well in a 24-well plate in DMEM (Dulbecco's modified Eagle medium), with 10% FCS, 100 units/ml penicillin and 100 mg/ml streptomycin (DMEM++) at 37° C. in a humidified atmosphere of 5% $CO_2$. Cultured medium (20 ul) was then collected at different time points for B2M testing. B2M levels in synovial fluid and cartilage organ cultured medium were measured using a B2M enzyme immunoassay test kit (ALPCO). Statistical significance was assessed by Student's t-test with P values less than 0.05 being considered significant. Cell culture of chondrocytes from patients with severe OA was performed as follows. Chondrocytes were derived from cartilage from patients with severe OA through collagenase type II digestion. Cells were then seeded at $6.5 \times 10^4$/well ($3.2 \times 10^4$/ml) in a 6-well plate and treated with or without 10 ug/ml B2M (Sigma) for 72 hr. Microarrays containing 5184 chondrocyte-specific cDNA clones were used for gene expression profiling.

Figure 7:
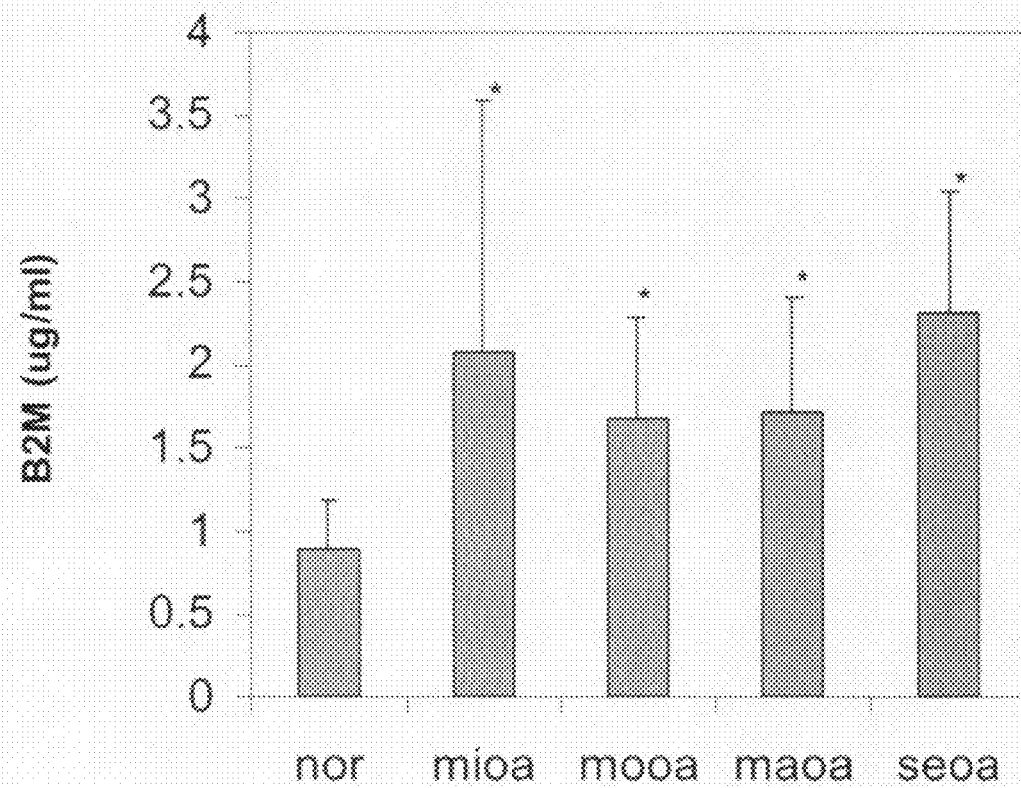
FIG. 7 is a bar graph showing the level of beta-2 microglobulin (B2M) in synovial fluid from normal individuals and patients with different stages of osteoarthritis according to one embodiment of the invention. Legend: nor=normal individual, mioa=patient with mild osteoarthritis, mooa=patient with moderate osteoarthritis, maoa=patient with marked osteoarthritis, seoa=patient with severe osteoarthritis.

The average B2M levels detected in normal (nor), mild (mioa), moderate (mooa), marked (maoa) and severe OA (seoa) synovial fluid are shown in FIG. 7. B2M in osteoarthritis synovial fluid is significantly higher than that in normal. However, no significant difference was found in B2M levels among different osteoarthritis stages.

Figure 8:
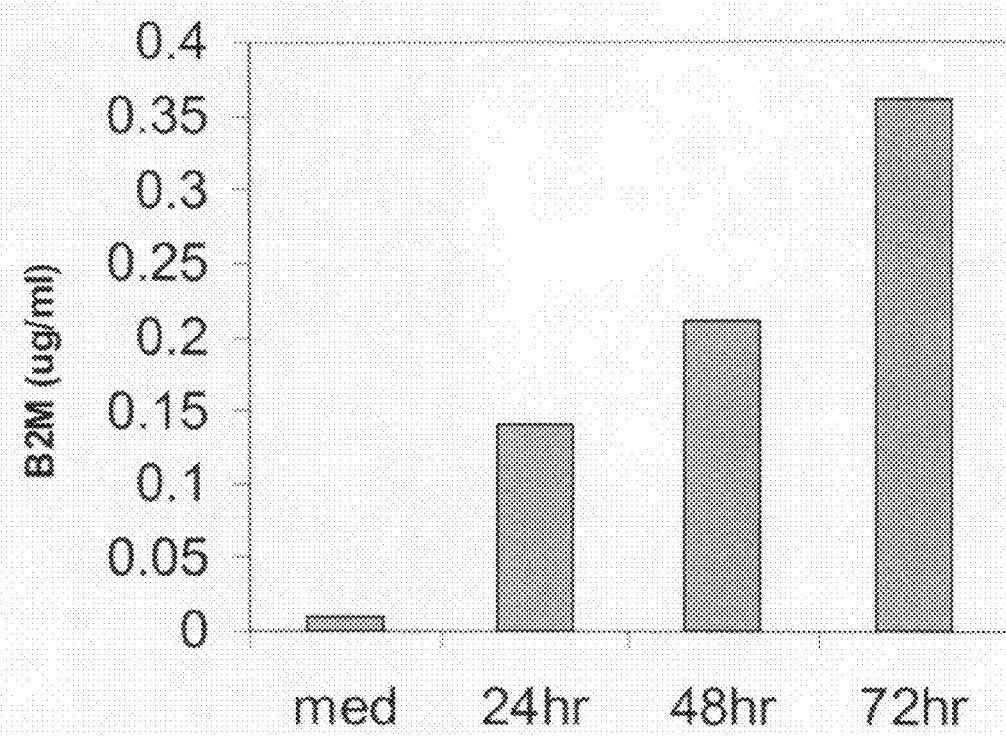
FIG. 8 is a bar graph showing the level of beta 2 microglobulin (B2M) in medium cultured from cartilage from patients with severe osteoarthritis at varying time periods during culturing according to one embodiment of the invention.

To assess if chondrocytes contribute B2M secretion, medium from cultured severe OA cartilage was collected and tested for B2M. FIG. 8 shows the release of B2M is detectable after 24 hour culture and continues to increase during the 72 hour study period. At 72 hours, the accumulation of B2M was about 2.1 ug/g cartilage. Similar results were obtained across three experimental runs, each using cartilage from a different donor.

Figure 9:
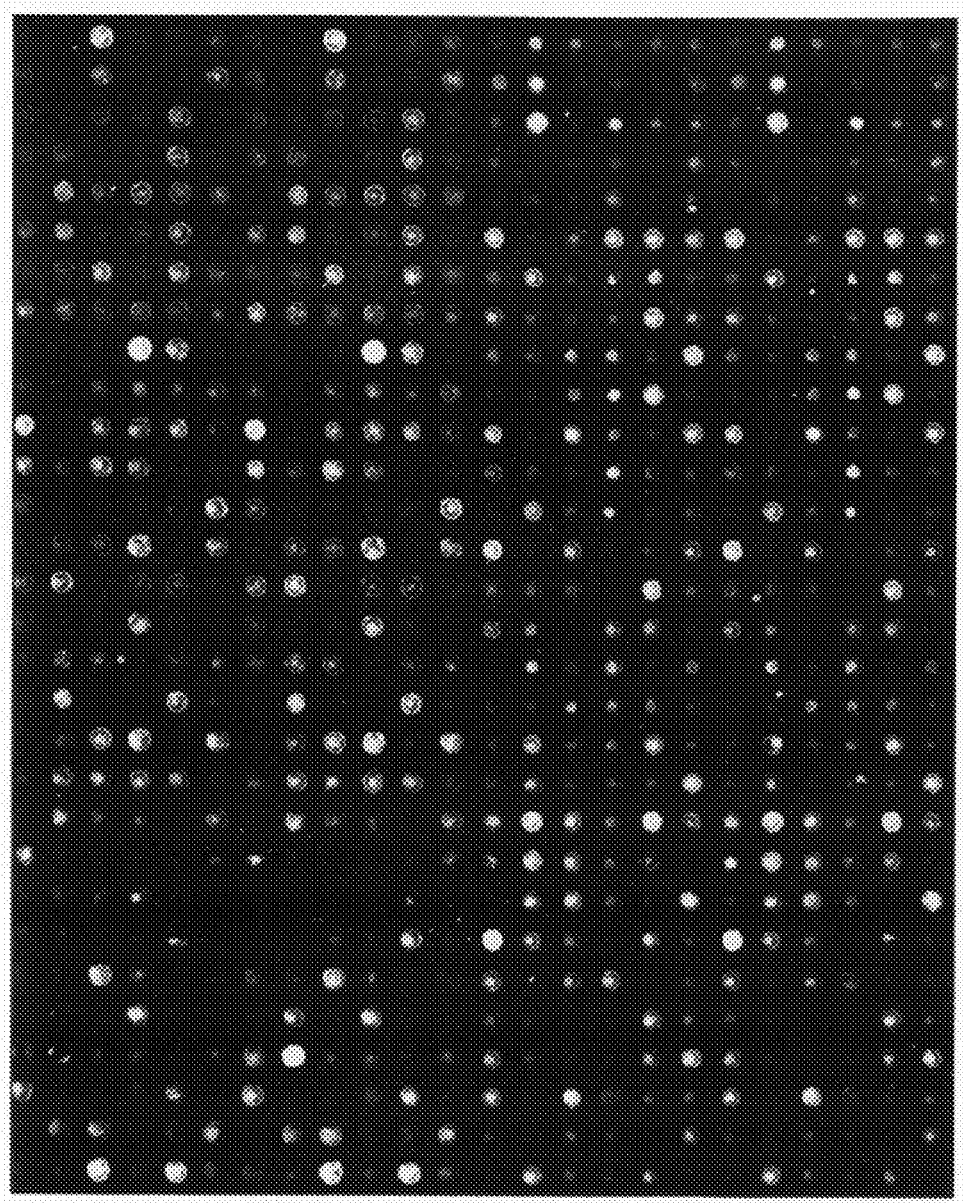
FIG. 9 is a black and white representation of a two-color fluorescent scan according to one embodiment of the invention showing genes preferentially expressed in non-B2M-treated chondrocytes and genes preferentially expressed in B2M-treated chondrocytes. B2M=beta 2 microglobulin.

Genes regulated by B2M were detected through microarray technology as described above. FIG. 9 shows a black and white representation of a two-color fluorescent scan. Cy3 labeling (which would appear as green spots) correspond to genes preferentially expressed in non-B2M treated chondrocytes, while Cy5 labeling (which would appear as reddish spots) represent genes preferentially expressed in B2M treated chondrocytes. Genes expressed at approximately equal levels would appear as yellow spots. The identity of genes was determined by the location of nucleic acid members on the array. Some of the genes that were up or down-regulated at least two-fold by B2M are listed in Table 7.

TABLE 7

Genes Regulated by B2M

| Up-Regulated | Down-Regulated |
|---|---|
| Adrenomedullin | hypothetical protein (KIAA0102) |
| chitinase precursor = YKL-39 | intersectin short form |
| collagen type III, alpha 1 | KARP-1 binding protein 2 (KAB2) |
| manganese superoxide dismutase (SOD-2) | peripheral myelin protein 22 (PMP22) |
| syntaxin 7 | putative GTP binding protein |

Example 14

Hybridization Analysis Identifying up Regulated and Down Regulated Genes in Mild and Severe Osteoarthritis Normal cartilage samples for use as a standard for determining differential expression were provided by the donor program at the Department of Orthopaedics and Rehabilitation, University of Miami. The samples were harvested within 12 hr, from the femoral condyle of patients who had died of a blunt head injury and an acute myocardial infarction.

OA cartilage samples were obtained from knee joints at arthroscopy or total knee replacement (mild n=1, severe n=2). Sequences to be tested were spotted onto a microarray as described herein.

Cartilage samples were ground into a very fine powder, and subjected to RNA isolation using TRIzol® (GIBCO). One microgram total RNA was then amplified one round using RiboAmp™ RNA Amplification Kit (Arcturus) according to the manufacturer's specifications. Two micrograms of the amplified RNA (aRNA) from each sample were used for subsequent microarray hybridization.

For each hybridization, cartilage aRNA was labeled with Cy5 while amplified human universal reference RNA (Stratagene) was parallel labeled with Cy3. The two labels were then mixed and hybridized to the 15K ChondroChip™ for overnight. The next day, the slides were washed and scanned with a GMS 428 Array Scanner (Affymetrix).

Raw scanned images of Cy3 and Cy5 fluorescence were processed using ScanAlyze 2.44 microarray image analysis software. The mean value of net intensity obtained from 72 negative control spots was used as cut-off value. Spots whose net fluorescence intensity value was less than the cut-off value in both Cy3 and Cy5 were excluded. Furthermore, to account for the incomplete hybridization on each spot, only the spots in which at least 50% of pixels (within the defined area of the spot) had fluorescence at least 1.5 times greater than local background in both Cy3 and Cy5 were considered for further analysis. To determine genes that were up- and down-regulated in normal, mild and severe OA cartilage samples, the median ratio for each spot (MART:calculated as the ratio of the median fluorescence from each pixel, minus background, in Cy5 to that in Cy3) from all the hybridizations were submitted to GeneSpring 4.1.5 (Silicon Genetics). A cut-off of two-fold up- or down-regulation relative to normal cartilage samples was used to define differentially expressed genes.

Example 15

Monitoring Drug Efficacy

The drug efficacy was monitored by comparing the expression profile of one or more differentially expressed genes between any two cartilage samples from normal and different stages of osteoarthritic. Cartilage or blood samples were taken from an individual during or after the treatment of a candidate drug as described herein above. As a comparison, cartilage or blood samples were also taken from either the same individual prior to the treatment of the drug or from another individual not treated with the drug. Nucleic acids were extracted from the samples as described and hybridized to an array of the present invention. If one or more nucleic acid members on the array were found to be expressed at different levels in the sample taken from the treated individual compared to the sample taken from the untreated individual, it was indicative of the efficacy of the drug for the treatment of osteoarthritis. Follow-up analysis (e.g., by PCR or Western blot analysis) were then followed to verify the expression differences.

Variations, modifications, and other implementations of what is described herein will occur to those of ordinary skill in the art without departing from the spirit and scope of the invention. The references provided below and referred to herein above are incorporated herein by reference in their entireties.

REFERENCES

1. Zaleske D J. Cartilage and Bone Development. Instr Course Lect 1998; 47:461
2. Buckwalter J A, Mankin H J. Articular Cartilage: Tissue Design and Chondrocyte-Matrix Interactions. Instr Course Lect 1998; 47:477-86.

3. Westacott C I, Sharif M. Cytokines in Osteoarthritis: Mediators or Markers of Joint Destruction? Semin Arthritis Rheum 1996; 25:254-72
4. Adams M D, Kerlavage A R, Fleischmann R D, Fuldner R A, Bult C J, Lee N H, et al. Initial assessment of human gene diversity and expression patterns based upon 83 million nucleotides of cDNA sequence. Nature 1995; 377 Suppl:3-174.
5. Hwang D M, Dempsey A A, Wang R X, Rezvani M, Barrans J D, Dai K S, et al. A Genome-Based Resource for Molecular Cardiovascular Medicine: Toward a Compendium of Cardiovascular Genes. Circulation 1997; 96:4146-203.
6. Mao M, Fu G, Wu J S, Zhang Q H, Zhou J, Kan L X, et al. Identification of genes expressed in human $CD34^+$ hematopoietic stem/progenitor cells by expressed sequence tags and efficient full-length cDNA cloning. Proc Natl Acad Sci 1998; 95:8175-80.
7. Hillier L D, Lennon G, Becker M, Bonaldo M F, Chiapelli B, Chissoe S, et al. Generation and analysis of 280,000 human expressed sequence tags. Genome Res. 1996; 6:807-28.
8. Altschul S F, Gish W, Miller W, Myers E W, Lipman D J. Basic local alignment search tool. J Mol Biol 1990; 215: 403-10.
9. Mundlos S, Zabel B. Developmental Expression of Human Cartilage Matrix Protein. Dev Dyn 1994; 199:241-52.
10. Nakamura S, Kamihagi K, Satakeda H, Katayama M, Pan H, Okamoto H, et al. Enhancement of SPARC (osteonectin) synthesis in arthritic cartilage. Increased levels in synovial fluids from patients with rheumatoid arthritis and regulation by growth factors and cytokines in chondrocyte cultures. Arthritis Rheum 1996; 39:539-51.
11. Eyre D R, The Collagens of Articular Cartilage. Semin Arthritis Rheum 1991; 21 (3 Suppl 2):2-11.
12. Okihana H, Yamada K. Preparation of a cDNA Library and Preliminary Assessment of 1400 Genes from Mouse Growth Cartilage. J Bone Miner Res 1999; 14:304-10.
13. Morrison E H, Ferguson M W J, Bayliss M T, Archer C W. The developmental of articular cartilage: I. The spatial and temporal patterns of collagen types. J Anat 1996; 189:9-22.
14. Treilleux I, Mallein-Gerin F, le Guellec D, Herbage D. Localization of the Expression of Type I, II, III Collagens, and Aggrecan Core Protein Genes in Developing Human Articular Cartilage. Matrix 1992; 12:221-32.
15. Eyre D R, Wu J J, Niyibizi C. The collagens of bone and cartilage: Molecular diversity and supramolecular assembly. In Cohn D V, Glorieux F H, Martin T J, editors. Calcium Regulation and Bone Metabolism. Amsterdam. The Netherlands: Elsevier; 1990. p. 188-94.
16. Birnbacher R. Amann G, Breitschopf H, Lassmann H, Suchanek G, Heinz-Erian P. Cellular localization of insulin-like growth factor II mRNA in the human fetus and the placenta: detection with a digoxigenin-labeled cRNA probe and immunocytochemistry. Pediatr Res 1998; 43:614-20.
17. Wang E, Wang J, Chin E, Zhou J, Bondy C A. Cellular patterns of insulin-like growth factor system gene expression in murine chondrogenesis and osteogenesis. Endocrinology 1995; 136:2741-51.
18. van Kleffens M, Groffen C, Rosato R R, van den Eijnde S M, van Neck J W, Lindenbergh-Kortleve D J, et al. mRNA expression patterns of the IGF system during mouse limb bud development, determined by whole mount in situ hybridization. Mol Cell Endocrinol 1998; 138:151-61.
19. Braulke T, Gotz W, Claussen M. Immunohistochemical localization of insulin-like growth factor binding protein-1, -3, and -4 in human fetal tissues and their analysis in media from fetal tissue explants. Growth Regul 1996; 6:55-65.
20. Kessler E, Takahara K, Biniaminov L, Brusel M, Greenspan D S. Bone Morphogenetic Protein-1: The Type I Procollagen C-Proteinase. Science 1996; 271:360-2.
21. Ausubel et al., John Weley & Sons, Inc., 1997, Current Protocols in Molecular Biology
22. Marshall, K. et al., 2000, 46th Annual Meeting, ORS, paper No. 919.
23. Kumar, S., et al., 2000, 46th Annual Meeting, ORS, paper No. 1031.
24. Marshall K., et al., 2002, 48th Annual meeting, ORS (submitted).
25. Migita K., et al., Biochem Biophys Res Commun 1997, 239:621-625.
26. Migita K., et al., Kidney Int 1999, 55:572-578.

Lengthy table referenced here

US07906278-20110315-T00001

Please refer to the end of the specification for access instructions.

Lengthy table referenced here

US07906278-20110315-T00002

Please refer to the end of the specification for access instructions.

Lengthy table referenced here

US07906278-20110315-T00003

Please refer to the end of the specification for access instructions.

Lengthy table referenced here

US07906278-20110315-T00004

Please refer to the end of the specification for access instructions.

Lengthy table referenced here

US07906278-20110315-T00005

Please refer to the end of the specification for access instructions.

Lengthy table referenced here

US07906278-20110315-T00006

Please refer to the end of the specification for access instructions.

Lengthy table referenced here

US07906278-20110315-T00007

Please refer to the end of the specification for access instructions.

Lengthy table referenced here

US07906278-20110315-T00008

Please refer to the end of the specification for access instructions.

Lengthy table referenced here

US07906278-20110315-T00009

Please refer to the end of the specification for access instructions.

Lengthy table referenced here

US07906278-20110315-T00010

Please refer to the end of the specification for access instructions.

Lengthy table referenced here

US07906278-20110315-T00011

Please refer to the end of the specification for access instructions.

Lengthy table referenced here

US07906278-20110315-T00012

Please refer to the end of the specification for access instructions.

Lengthy table referenced here

US07906278-20110315-T00013

Please refer to the end of the specification for access instructions.

Lengthy table referenced here

US07906278-20110315-T00014

Please refer to the end of the specification for access instructions.

Lengthy table referenced here

US07906278-20110315-T00015

Please refer to the end of the specification for access instructions.

Lengthy table referenced here

US07906278-20110315-T00016

Please refer to the end of the specification for access instructions.

Lengthy table referenced here

US07906278-20110315-T00017

Please refer to the end of the specification for access instructions.

Lengthy table referenced here

US07906278-20110315-T00018

Please refer to the end of the specification for access instructions.

Lengthy table referenced here

US07906278-20110315-T00019

Please refer to the end of the specification for access instructions.

Lengthy table referenced here

US07906278-20110315-T00020

Please refer to the end of the specification for access instructions.

Lengthy table referenced here

US07906278-20110315-T00021

Please refer to the end of the specification for access instructions.

Lengthy table referenced here

US07906278-20110315-T00022

Please refer to the end of the specification for access instructions.

Lengthy table referenced here

US07906278-20110315-T00023

Please refer to the end of the specification for access instructions.

Lengthy table referenced here

US07906278-20110315-T00024

Please refer to the end of the specification for access instructions.

Lengthy table referenced here

US07906278-20110315-T00025

Please refer to the end of the specification for access instructions.

Lengthy table referenced here

US07906278-20110315-T00026

Please refer to the end of the specification for access instructions.

Lengthy table referenced here

US07906278-20110315-T00027

Please refer to the end of the specification for access instructions.

Lengthy table referenced here

US07906278-20110315-T00028

Please refer to the end of the specification for access instructions.

Lengthy table referenced here

US07906278-20110315-T00029

Please refer to the end of the specification for access instructions.

Lengthy table referenced here

US07906278-20110315-T00030

Please refer to the end of the specification for access instructions.

Lengthy table referenced here

US07906278-20110315-T00031

Please refer to the end of the specification for access instructions.

Lengthy table referenced here

US07906278-20110315-T00032

Please refer to the end of the specification for access instructions.

Lengthy table referenced here

US07906278-20110315-T00033

Please refer to the end of the specification for access instructions.

Lengthy table referenced here
US07906278-20110315-T00034

Please refer to the end of the specification for access instructions.

Lengthy table referenced here
US07906278-20110315-T00035

Please refer to the end of the specification for access instructions.

Lengthy table referenced here
US07906278-20110315-T00036

Please refer to the end of the specification for access instructions.

Lengthy table referenced here
US07906278-20110315-T00037

Please refer to the end of the specification for access instructions.

Lengthy table referenced here
US07906278-20110315-T00038

Please refer to the end of the specification for access instructions.

Lengthy table referenced here
US07906278-20110315-T00039

Please refer to the end of the specification for access instructions.

Lengthy table referenced here
US07906278-20110315-T00040

Please refer to the end of the specification for access instructions.

Lengthy table referenced here
US07906278-20110315-T00041

Please refer to the end of the specification for access instructions.

Lengthy table referenced here
US07906278-20110315-T00042

Please refer to the end of the specification for access instructions.

Lengthy table referenced here
US07906278-20110315-T00043

Please refer to the end of the specification for access instructions.

Lengthy table referenced here
US07906278-20110315-T00044

Please refer to the end of the specification for access instructions.

LENGTHY TABLES

The patent contains a lengthy table section. A copy of the table is available in electronic form from the USPTO web site (http://seqdata.uspto.gov/?pageRequest=docDetail&DocID=US07906278B2). An electronic copy of the table will also be available from the USPTO upon request and payment of the fee set forth in 37 CFR 1.19(b)(3).

SEQUENCE LISTING (58996 sequences)

SEQ ID NO: 1 - DNA, 377 bp, Homo sapiens
cggaggtgcaggtcctggtgcttgatggtcgaggccatctcctgggccgcctggcgcaattccgtggctaaacaggtactgctgggccggaaggtggtggtcgtacgctgtgaaggcatcaccatttctggcaatttctacagaaccaagttgaagtacctggctttcctccccaagcggatgaacaccaacccttcccggggcccctatccctttccgggccccaagccgatttttttgggcgacccgggcggggatttctcccaaaaaaccaagcaggccaggccgtctctgaccgttaagggtgtttacggaatccaccgccatcgaatgaaaagcgatgtgttcctgctgcctatggtcgtcgtactaatgca

SEQ ID NO: 2 - DNA, 209 bp, Homo sapiens
ggaaaggaaagctgtgggaccatcctggcaaccccggtgtttggctgggttctagcgtagcggtctgtattcggccggtgggggaccttgcgtcggagtgggagggccagtttgcacccaagaggtggaagaggacgggctttaggctggaagcgccttagaggagccatttttcccaggatgcctgggttgcttttatagtgtaaccc

SEQ ID NO: 3 - DNA, 499 bp, Homo sapiens
tttgatggcgtgatgtctcacagaaagttctccgctcccagacatgggtccctcggcttcctgcctcggaagcgcagagcaggcatcgtgggaaggtgaagagcttccctaaggatgacccgtccaagccggtccaccttacagccttcctgggatacaaggctggcatgactcacatcgtgcggggagtcgacaggcccggatcccaggtgtaacacagaaggaggtggtgtagagctctttccccatttgagacacaccacctatggtgtttgtggactttgtggtcctacgtggacacctctcgaggtctccgcaccctacaagactgtcttttgctgagcacatcagtgatgattgcagaggcgtttctatatgaatttgcataatctaagaggaggctttaccagtacttcagacatgcaggatgaggatgcagagcagctgagaggactcagcagcatgagagatctccaagtcatcgtgtcattgccacacc

SEQ ID NO: 4 - DNA, 406 bp, Homo sapiens
aaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaactgttgctgagggcaacagcaggttcacttacacttgttcttgtagggtgggtgctttaaaagggcaaattgatggggggaggcacatattcgatcacaacacatagagcctacagcttgccttcctttgtattcgccacttgggactaggttggcatcgcccgggtttcttggggactgggccagtcttcacatagaaagctcatatccatagaaaggtagattttggatactccttcttttgctacgc

SEQ ID NO: 5 - DNA, 440 bp, Homo sapiens
gagacttagagccaaactgtttaagctgtatcatcccaacaaagtatcctttcatgaacgggggcatgcaatagcttaagaattgctaggattaaattaaggaaagtaaagctactcagagcagcaggttccacaagcacaaactttacacatttgtacacttttgaaatgcactacattaacacattagagcacacatttgaaatacaggcttctttacatacactgagaggttatacacactcagtttcacacgggcacactctatacctctctaaaggtaatatctcaggtctctataggcagagtattttactctctaaatctgcctctctgaccacaaaaaaaaaaaaaacctggggggtccttctgggcgccggggcccatcgatttccacccgggggggaccaggaagttccccaatcgcctatgtagtcata

SEQ ID NO: 6 - DNA, 403 bp, Homo sapiens
aaaaaatagttttttcattagtatttctcgggaggacccaaaagttaaggtcagcttgttcactgtaatttctggaaggagttcactcagaccttcctgaattcagatcatctcagaagtcttgagggaaatcttgcgaaaccctcgtttgaggacttatgttagtttattgccacctcacttggtgcaccgagaacttacttccttggattaggtcacttctttgatttctaataggatgacttccagagagtgagatttgttatgtctggcttataaaggtaaatataaatatatacatacttaatctaaaaaaaaaaaaaaacctcgggggtctttttggacgccggggcccattcgattccccccgggtggggccaaggtaagtaccccaatcgcctat

SEQ ID NO: 7 - DNA, 231 bp, Homo sapiens
ctttgcagatcttttccgacacacatgtctgaagacttattttcaaagacagcacatttttggaaactaatctcttttccgtaatatttcctttatttcaatgattctcagaaggcccattcaaacaaaccccccatttaagggtctttagggttataggataaaattgggctcctagagtttagcccccagtagagctaggaaagccccactcgtatatttgttcccttc

SEQ ID NO: 8 - DNA, 114 bp, Homo sapiens
tgcttctattaccaggctgtaatagctggtatagttttttatttttctcttaaggtgttcttttattagtctgaggacagccattttttttttttaagggaaaatatcagtcag

SEQ ID NO: 9 - DNA, 166 bp, Homo sapiens
aagtatgatgcttttttggcctcagagtctctgatcaagcagattccacgaatcctcggcccaggtttaaataaggcaggaaagttcccttccctgctcacacaaaaacggaaacatggtggccaaagtggattaggtgaagtccccaatcaagttttcccaatga

SEQ ID NO: 10 - DNA, 297 bp, Homo sapiens
ttttttttttgaataatagaggcaatatttttaatcagttcccagataaggtcaattagaaacatgcactgctaaaatgcaagttacaattcaaatggtaccataaataattagggtacacactgagcattttcaggaatcagcttccatatcttgatccactaaatggggagggtcttcaggacacggtcccttacccctttatacacagagggggaggaatttaagggtcgcctcatggacactttacagtaaatcgggacacatttatttgagtacactatttagacatgtaaa

SEQ ID NO: 11 - DNA, 218 bp, Homo sapiens
cttggatgaagagaggaccgtgagggtccccatgatgtcggaccctaaggctgttttacgctatggcttggattcagatctcagctgcaagattgcccagctgcccttgaccggaaggcatgagtatcatttttttcctgcccctgtaagtgcaccagaatttgaccttgatagaggagagcctcaacctccgagttcattcatgacatagaccgaga

SEQ ID NO: 12 - DNA, 232 bp, Homo sapiens
cttcagggtgatgccaggttctatttgggaatttatatacaacctgcttgggtggagaagccattgtcttcggaaaccttggtgttagttgaacctgataagttacttttgtgacctgaagttcaccattaaaaggggattacccaaggcaaaatcatgggattggtataaaagggattgttgggcaatccattgcaatatattcaaaaattgaataatgggccccataaaa

SEQ ID NO: 13 - DNA, 136 bp, Homo sapiens
gcagaatcacatggcaaaagctttgaaaatcataaagatataagttggtgtggctaagatggaaacagggctgattcttgattcccaattctcaactctccttttcctatttgaatttctttggggctgtagaaac

SEQ ID NO: 14 - DNA, 251 bp, Homo sapiens
cttttatgtatccatcccatctaaaaactcttcaaactccacttgttcagtctgaaatgcagctccctgtccaagtgccttggagaactcacagcagcacggcttaatcaaagggttttaccagcccttggacactattgggaggagggcaagagtacaccaatttgttaaaagcaaggaaaccacagatgtctcttcactagtcatttagagcatggttatcatccaagactactctaccctgcaacaat

SEQ ID NO: 15 - DNA, 251 bp, Homo sapiens
cagagatgtactgttattagctgggaagaccaattctaacagcaaataacagtctgagactcctcataccctcagtggttagaagcatgtctctcttgagctacagtagagggggagggatttttgtgtagtcaagtcaccatgctggaatgtacactgattcctctatgatgactgcttaactccccactgtcctgtcccagagaggctttccaatgtagctcagtaattcctcttactctacagacagg

SEQ ID NO: 16 - DNA, 162 bp, Homo sapiens
attgcatgcaagtttgctgagctgaaggaaaagattgatcgcccgttctgggtaaaaatgctggaaggatgggccctaaaattcttgaagtctgggtgatgctgcccattgttgatatgggtcccgggcaagcccatttttttttgagaggcttctcagact

SEQ ID NO: 17 - DNA, 225 bp, Homo sapiens
gcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacatatgtagttattttcaaatctttgctttataagtattaagagatatgtg

SEQ ID NO: 18 - DNA, 215 bp, Homo sapiens
ccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgcttcagccttggcaccttagaatgtatttagtacggctttaagcagtgtgttattacaccaca

SEQ ID NO: 19 - DNA, 285 bp, Homo sapiens
gtcgccgctgcgaagggagccgccgccatgtctgcgcatctgcaatggatggtcgtgcggaactgctccagtttcctgatcaagaggataagcagacctacagcactgagcccaataacttgaaggcccgcaatttcttccgctacaacggacttattcaacgccaagactgtgggcgtggagcccgcagaccgacggcaaaaggtgttcgttggtgggtcaataagcggagattcccgccagcggaagccttccaccttctatgtgcggagcaccaataacaag

SEQ ID NO: 20 - DNA, 307 bp, Homo sapiens
ctcgtgccgaattcggcacgagcggcacgagctggagttggcgacttcgatattaacaaggatggcggcggccgcagcaagtcggataagtcgggccaaagctgggcctaccgtaagattcgcatccacttatgtcagcgctcgcccggcagccagggcgtcagggacttcattgagaaccgctacgtggagctgaggagggcgaatcccgacctacccatcctaatccgcgaattctccgatgtgcagcccaagctctggcccgctacgcatttggccagagacgaatgtcctttgacaacttcag

SEQ ID NO: 21 - DNA, 138 bp, Homo sapiens
gtcgcggcgacatggccaaacgtaccaagaaagtcgggatcgtcggtaaatacggggacccgctattggggccttccttcggaaaattgtgtaaggaaaattgaaattcagccagcacggccaagtgacactttgctc

SEQ ID NO: 22 - DNA, 138 bp, Homo sapiens
aaagaagtagcaaattatcttcagtataatccatggtaatgtatgcagtaattcaaattgatctctctctcaatagggttcttaacaatcttaaacttggaacatcaatggttaattttcagggacctttttgggttt

SEQ ID NO: 23 - DNA, 132 bp, Homo sapiens
ccctacgacaagaaaaagcggatggtggtttctgctgcctcaaggtcgtgcgtcttaaggcctacaaggaaaggttggctaatcttgggcggcttgcttaagaaggttgcttgaagtaccaagcagttacaa

SEQ ID NO: 24 - DNA, 247 bp, Homo sapiens
ctcacgcaagcatggttaacgtccctaaaacccgccggactttctgtaagaagtgtggcaagcaccaaccccataaagtgacacagtacaaggagggcaaggattctctgtacggccagggaaagccgccttatgacaagaagcagagatggttattgttggcaaactaagccgattttccggaaaaaggctaaaactacacagaagagttgtgctaaggctctagtgcgctgagccccactccaga

SEQ ID NO: 25 - DNA, 213 bp, Homo sapiens
gtttgagaagtcccccctgcgggtgaagaacttcgggatctggctgcgctatgacttccggagcggcacccacaacatgtaccgggaataccgggacctgaacaacgcaggcgctgtcacccagtgctaccgagacatgggtgcccggcaccgcggccgagcccacttcattcagatcatgtaaggttgaggagatcgcggccagcaagtgtc

SEQ ID NO: 26 - DNA, 237 bp, Homo sapiens
gaaaaatgagtatgttccttctcaggagagctcttagacaacaagcaaagaatgtcaatgaaatttttaagtgctcagtgttccaggccagagtacagagggagggacactttgctgtctttcagtcctttctttttaattgtattgattcttttcctcggtaataaataagtgcatactagtgtttattaaggaaagacaggtacaagccaaattgtattcatttaatcatattcg

SEQ ID NO: 27 - DNA, 132 bp, Homo sapiens
cctgtgccgaaattcggcacgaggcttgcgggaatcccattcacccttgtccttctcacctaaatcctgcagcctggcttcctgacccaatgaatcccttaggtgaatttcgtcagttcaagagccccttgg

SEQ ID NO: 28 - DNA, 110 bp, Homo sapiens
cagagatgaactgaggtccttgttttgttttgttcataatacaaaggtgctaattaatagtatttcagatacttgaggaatgttgatggtcctagaggaatttgagaggg

SEQ ID NO: 29 - DNA, 257 bp, Homo sapiens
gccgttctggtaaaaagctggaagatggccctaaattcttgaagtctggtgatgctgccattgttgatatgggttcctggcaagcccatgtgtgttgaggagcttctcaagctatccacctttgggtcggtttgctgttcgggatatgaggacaagacaagtgcggggggtgtcatcaaaggcaggtggcaaggaggctgctgggagctggcaaggtcacaagtctgcccagaaagctcagagggctaaatgaatat

SEQ ID NO: 30 - DNA, 361 bp, Homo sapiens
tgtcaatcttgcctggacagcaggaaacagtaacacgcgcttcggaatagcagccaagactcagattgaccctgacggctgcttctcggctaaagtgaacaacttcacgcctgataggtttagggatacaactcaggactctaaagccaggtattaaactgacaactgtcagctcttctgaatggcaagaacgtcaatgctggtggccacaagcttggtctaggactggaatttcaagcataaatgaatactgtacattgtttaattttaaactatttgcagcatagctaccttcagagtgtagtgtatctttaatgttgtatgtctgtatgcagtattgctaatatgttagccctcagat

SEQ ID NO: 31 - DNA, 398 bp, Homo sapiens
ccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggaggaggagaaacctggacaggcacggaagatgccaggtgctcctgagatcttggaaatagcagacacaccagtgagacaaacttccttgagacacgtttcatgacgatctctctaccggagctatcgaacctccgagagtcttcaggagttcatcaagatgacactatgacgtgagacacatcagaggagatgtctgggatgtaggaatgcatttgtg

SEQ ID NO: 32 - DNA, 210 bp, Homo sapiens
cggcacgagtagtgacagaccgttggcatgttagaactaaggaagggggaaaacttatgaagccctgttctttcactaaattacctgcgtgtatttgaccaatgcaaataaaccaggcaatatccagtgtttggaatattaaagtaattcatggattaatttttagtgggttagagcctctaattaaagcttaatatatattaagtgcac

SEQ ID NO: 33 - DNA, 275 bp, Homo sapiens
ggcttgtgcagcaatggccaagatcaaggctcgagatcttcgcgggaagaagaaggaggagctgctgaaacagctggacgacctgaaggtggagctgttcccagctgcgcgtcgccaaagtacaggcggtcggcctccaagctctctaagatccgagtcgtccggaaatccattgcccgttttctaacagttattaaccagactcagaaggaaacctcaggaaattctacaaggcaagaggtacaagcccttggacctgcggcctaagagacacg

SEQ ID NO: 34 - DNA, 131 bp, Homo sapiens
cagtcttgctttattcatcctccatctcaaaatgaacttggaattaaatattgtaagatatgtataatgctggccattttaaaggggttttctcaaaaggtaaaccttttgttattgacttgtgtttttgc

SEQ ID NO: 35 - DNA, 155 bp, Homo sapiens
gtggcgataagggagagcccggtgaaaaggggcccagaggtcttcctggcttaaaggggacacaatggattgcaaggtctgcctgggtatcggctggtcaaccatgggtgatcaagggtgcctcctggctccgtggggtcctcttggtccttggg

SEQ ID NO: 36 - DNA, 150 bp, Homo sapiens
gtcagctctgaatgaggaggggagaagcccctggggtctttctttgaaaggaatcccgctgcttgagggcttgcctcccttcaatggtgttccgtttcgtttcttttccctgaccggacttttttatattcaagaggtacctattgcaaa

SEQ ID NO: 37 - DNA, 199 bp, Homo sapiens
ctgaaatctagcagagtttaactcttctgcctccatgtctgtcacttataattcaggttctgctgttggcttcagaacatgagcaggaggatcgttttatgctaggttattgcaatcaatggtgaaactcaacttagggaaagggttccaatgtataaggcaatgggctgcttctccccaatcctccctaacaatttgt

SEQ ID NO: 38 - DNA, 315 bp, Homo sapiens
catcatctcctgtgatcgaggatgctcgacacccacacaaataccgcatgctcatcgcaatggtggatgtgatctatcctgaatgtggcccagccagtcccagaccccgagttgtggcccttaatgcccacaccttccctgcgtaatggaggacaatttgtgatttccattaaggccaacctcaattacttcacaagcgtaagccgaggccggtgttttcctccgaagtgaaaaggatgcaacaaggagacaatgaggccgcaggagcaggttgacccttagccaatattaaagagaccaattccgtgccgtggg

SEQ ID NO: 39 - DNA, 160 bp, Homo sapiens
ctaactcctctgacacgtccttcgcagttcttgagcgcttgtgcattactttcctatgagggtctgtgcttcacagcaacctgacagtggcgttcgggggcgttgttcccgtacgtagaggacgtggagcgtcacaacaggcagtggagcccaacgtcag

SEQ ID NO: 40 - DNA, 220 bp, Homo sapiens
gtaagattggcctaagagccctgcctgaccacgtgagcattgtggacccaagatgagatactgcccaccacccccatctcagaacagaagggtggggagccagagcccgcctgccatgccccagccagtcccaacagcataacagggtcttcttggcagctgtattctggagtctggatgttgctctgtaaggacctttagtaaaattttgtacaaagac

SEQ ID NO: 41 - DNA, 355 bp, Homo sapiens
cctcgtccgaggtcacaccttcaaatcctgtctctaaggccagaaccaaagtgggccttctgtgaacaggtccttgggtcacttctcaccttcctaagctgatggaggcctggcttagcagccggaagcctaccaggcactgtgcactatgagcatgtgtkcaaagagtactctctctgagccaaagcatgcctgctcatctcccctgtggcagaagggagccctgagggggcctcttccataggctgggcccgagcattgagtccaggtggctgggtaggctttggccgcacctcagaggtccagacatactttgatgagtaatttccccatctgggtactatttcctggaagg

SEQ ID NO: 42 - DNA, 330 bp, Homo sapiens
gcctatctggacgaagcagctggcaacctcaagaaggccctgctcatccagggctccaatgacgtggagatccgggcagagggcaatagcaggttcacgtacactgccctgaaggattggctgcacgraacataccggtaagttgggcaagacttttatcgagtaccggtcacagaagacctcacgcctccccatcatttacatttcacccatggacataggagggcccgagcaggaattcggttttgacatagggccggtcttctttttgtaaaacctgaacccagaaacaacacattctttgcaaaccaaaggaccaagtatttccat

SEQ ID NO: 43 - DNA, 210 bp, Homo sapiens
  misc_feature 18: n = A,T,C or G
gggacagtcagccgcatnttcttttgcgtcgcagccgagccacatcgctcagacaccatggggaaggtgaaggtcggrgtcaacggatttggtcgtattgggcgcctggtcaccagggctgcttttaactctggtaaagtggatatttttgccatcaatgacccttcaattgacctaacttacatggtttacatttcccaatatgttccc

SEQ ID NO: 44 - DNA, 240 bp, Homo sapiens
gtgaacactgagaatactgagtcaggattagctcttcacacttttccacccttttctgagcatgtagttggtgggttgacctgtcaaggtcatcctggatgatctagacttgtttctctcttcttttcccttcagtatgccttagggatcacagggatgaatatagggtcaccgtttatacctaaggatccaccttatactttccttagggttcacacattagggttttaaggaaagggg

SEQ ID NO: 45 - DNA, 139 bp, Homo sapiens
acttctgaagatgtccttgatgtgcagctggcattccttcgacttctctccaaccgagcttcccagaacatacacatatcactgccaaaaatagcattgcatacatggatcaggccagtgggaatgtaaagaaggccct

SEQ ID NO: 46 - DNA, 320 bp, Homo sapiens
gttcccaaggcagtcacggcttgaagtgaggccagtgccacaaccgggggatgaattttagtttttacttttaataaatttgagtagccacttgtgttggtggccactgaacctacggggcagtgcagccatagtgactcctactatacggagccgtcttcccacatccttccttagctgtcacttctcctggagcaggagacagctccaggtcctgcgaagtgtgggcagttcttacctcctggggctgagctcatgtggaaaacctttgtgcaggttcatgggggctgaccagccggaccggaggaatcctaggttag

SEQ ID NO: 47 - DNA, 136 bp, Homo sapiens
ctcagtggaagactcagagtctgaaccctggtcagcctgacgttagagcctccgatggttcagccactgggctatatctgcctctgttgtcatgtctgttcacaacagggaggggaaagacatctgtatttccttt

SEQ ID NO: 48 - DNA, 198 bp, Homo sapiens
ggccgcggactgctgcagtcttcgcgcctctcgccctcccacgacatcatgctcagttcctgcttggatttacactgggcaacgtggttggaatgtatctggctcagacctatgatataccaaacctggctaaaaaacttgaagaaattaaaaaggactttgatgccaagaagaaaccccctagtgcatgagacttcc

SEQ ID NO: 49 - DNA, 231 bp, Homo sapiens
ggtcactgagcagcaccggcagatgggcaagggtggcaagcatcaccttggcctggaggagccaagaagctgcgaccaccccctgccaggactccctgccaacaggaactggaccaggtcctggagcggatctccaccatgcgccttccggatgagcggggccctctggagcacctttacttcctgcacatcccaactgtgacaagcatggcctgtacaacctcaaacagt

SEQ ID NO: 50 - DNA, 265 bp, Homo sapiens
cctgtccccatcagcaaccatgttcttgcaggctgggggcaagggattctgctcatgtgtttgcagaccggctgggatagcctccccaccccttatcagagccaagacacctgctgcagctctccacctagctgcagatagctcccaaagagaaatcagtgtgtctctttcaccatcagctcctccctttcaccaccagctcctctccacttcccaagggagactccggcaaccttcagcaacatatatcctcgaccagatgcag

SEQ ID NO: 51 - DNA, 266 bp, Homo sapiens
aaaccaaacacctcccttgaataaatttatactcctgttcccaggatcttgagctttagtgtgctatacctatgtgtcttatcgtgggccactgtgccaataaacaaaaacaactgtttggtttacctcagttgcagtagttattttcatttagaagttgttctcagattattgtttcagttatatagaggattactagactagttatgaggaaaccccactacattcaatggaattgtgcttaaaatctcatcgatgtgctgtct

SEQ ID NO: 52 - DNA, 235 bp, Homo sapiens
cttgggtgtcagcctccaatagggaagagcagcccaggacacctggaccctgccatacatgcacaatttttccttaagcctcagtttccccacctgtataacatggggagtggcccagctgctccctaaggatccatgtggtttaggggtttaggactcaggcctgagttagagagccccaaggtcaaatctgggctctgtcaacaaaaccaacaaacctttagataggctgatt

SEQ ID NO: 53 - DNA, 570 bp, Homo sapiens
cggcacgagtagtgacagaccgttggcatgttagaactaagaaggaggaaaacttatgaagccctgttctttcactaaattacctgcgtgtatttgaacaatgcaaataaaacaggcaatatccagtgtttggaatattaaagtaattcatggattaatttttagtggtgtagaagcctctgattaaagcttaatatatattaaatgcactttcttcatttatgcagatatgaggaatggtccagataagtataagtcttgagtaactacaaaaatctagaaatgttgcagtgattcttttggtaaaacactgtattgagtttatcttttacatcaacagtaagtacttaggaatgatggaagtgagatacttaaaactcaatccagtgcgggaagttacatattcttaaatatcacttctaactttctattttgtggatacaaacatttacttggtaggcataatggttatttaaactcttctttgggcttatttgacatatatttaagactaagcaagctgctgagataaaggtcagtggacctttttatgttaagaaagaaaattaa

SEQ ID NO: 54 - DNA, 205 bp, Homo sapiens
gtcacaggcgctcgtgaggctgccttccggaacattaagaccattgctgagtgcctggcagatgagctcatcaatgctgccaagggtcctcgaactcctatgccattaagaagaaggacgagcttgagcgtgtggccaagtccaaccgctgattttcccagctgctgcccaataaacctgtctgccctttgggcagttcccagcc

SEQ ID NO: 55 - DNA, 262 bp, Homo sapiens
ggacgctgctgcccctttctttttttcaggcggccaggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaatgccccttcactggtaatgtgtccattcgaggccggatcctctct

SEQ ID NO: 56 - DNA, 261 bp, Homo sapiens
gtaaagccaataatatatcattttataggagcattgtcttcttgtgtttttcaagttgactatgtagttcaatgtcagtctccattttaatatcttgtttgtttatcagcctgagcatatttcattttaaaatgtatttgttgagaggtcatggtggttttttgttttccacaggtcaggtggcttgaccactatcacttgtccaatggggaagttgatgcttatctttatggcaaatgcttggttgattaatatatttgc

SEQ ID NO: 57 - DNA, 261 bp, Homo sapiens
cggcacgagacagaatgttatccttacgtcctgagccggtttaagtctgtggaaaaggaagcacgggagaaatccacgtaacctttgctttctttttaagggaagcggttccgccgtgaacttggaaccctcagctccgggtgttctcggcagaagggcagctggaagggcacacagtggggcaggctttggggttgctcccttgttctcccccgaggccgggcacgcagggcagcccacgtctccgtggtcccattctgt

SEQ ID NO: 58 - DNA, 254 bp, Homo sapiens
cagctaggcttagccctctgccctcccttcattgtactttatcattaaaaatcaacttccagccctgtctgctgtctacgtggtgggttgtggggatgcagtttggcatctgcagtacaccaagcacatgattcatgtctgagccaggtctgcttattctcccattgggcagctgaggaccgaggcacagaggtgcggtgacttccccggggctccaggtagcctgcaggttaactggcggtaagtgctagact

SEQ ID NO: 59 - DNA, 256 bp, Homo sapiens
ctcgtcaattttcgggcaagggttaaagaccaacaggttcgtatgcccatttgcacagtaacaaaccatttgcagcagagaaagagtttaatcattgcaagtgcagatcagggagataagaggaaaccctcaaatccatctccctgaaggagttctgggctgggatttttaaagggattatgaagagtgaggggctggaaatttgggattcttgattggttggagtaaggaggatgaaatcatcaggttttggaaa

SEQ ID NO: 60 - DNA, 261 bp, Homo sapiens
gtctcctgcacctgagggtgggcgggaggcggccccgcgggtttgtgttgctggaaaaaggggtctcgatccagaccccaagagagggttcttgggtctacttcagggaagaattggaggcgagtcacagagcgcagtgaagggagcaagtttattggaatctactccgttagagagtgcaagtcctcagactgcaggaggaggactccgtccttcggtagtgtcactacttagaggcagctgtgaggagctgtgattaat

SEQ ID NO: 61 - DNA, 260 bp, Homo sapiens
ctagggctggcccttcttggctggaaagtgtccacttcccacataaagtggaaaagtaattgtctgctgggctcaatggtcaaaacaaatcgaagctaaagcaaatattctctcttctcttccattttgtgcaggaaagcaggctccttctcgcacagtttgcagagggatagtgtagaccatgtgcatcctcactaagagggtcctgccctgatccttgtacccgtcatctcacctctactcaatcagccttcagtgca

SEQ ID NO: 62 - DNA, 187 bp, Homo sapiens
ggccagcaaatgttcctttttgttcaaagtctatttttattccttgatatttttctttttttttttttttggggggggggctttttgattttttctaaaggggcctttttaacatgggggggggagcgtgtgcggctccagcccagcccgttgttcattttccaccctttttccacctgcctttggt

SEQ ID NO: 63 - DNA, 263 bp, Homo sapiens
gcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctcgaaaaaatccacctcgatgagaagtctctccgttggttgcacaacgaggaccagatggctgtggagaagctctctgacgggatccgcaagtttgccgctgatgcagtaaagctgga

SEQ ID NO: 64 - DNA, 263 bp, Homo sapiens
  misc_feature 200: n = A,T,C or G
acacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaanctcactgaggatgagaatccacgccagtacaagatccagactggttcttgaacagacagaggh

SEQ ID NO: 65 - DNA, 261 bp, Homo sapiens
cttggatggcggtggtttcaaaggtcaccgcagatttgagaataaatgactatttccttcatagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatccagggaccaac

SEQ ID NO: 66 - DNA, 261 bp, Homo sapiens
cggcacgagtaaatgaggccctttacctttaaaaggaatataatctagtggaagagaggaaacgtatctgtattttttaacagaaaacaaaaggagatcacgtagagtaaggccctgattaatgtacatcatagcctgggtcacgtacctccaccccacaagaccaagaagtgaaatgagggaattgaaggatcaaatagaaaaaggcaaagccaatacaatgatgcactatctagtttgttacttctgaggatgactact

SEQ ID NO: 67 - DNA, 257 bp, Homo sapiens
gtgaatgtttagcctttttgcctaacaaaaagaaaaactgaatttggcgggtttctttctgtaattgttaaaacagtttgtgttagagctgtaattgatttaaagtctaaacctcattcaagagtatgatactacacattagttttcactaaccaaacaaaaccaaagggttagatttttgcctttttgtgtaaccttgtccatcttttagaaaagcagaactagggtggtacaattgaggttctggataactctca

SEQ ID NO: 68 - DNA, 417 bp, Homo sapiens
ttccctgtctggtaattcccaagatttgtttttttttctcctaccctggcatggcccctgctagtcaatgacaactttccataacatgtttctactccccaaatattccccatgaattccagtttctatcaagctgttttcctgcttccaaacaatactacatcacacatagcaggttgcaaaggcagcatgcttttatctaactcatggctttcttgcaataaaagggcatttcccctgttattgtcattaactaccatttagtaaatacctacgatatgccaagcaccgcaataggcattcaacatacaaaatttaggtcttcaaaatagtccatgaaatcagtgttataattctctttttataaatgatggacccagggcaaagaagctaagtagcatacccagtgtttcatcg

SEQ ID NO: 69 - DNA, 435 bp, Homo sapiens
cggtgggtgaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggacataccaagcagtggctggccgatgccctaaaggagaatgaccttccagtgtgcttctcttccttgtaggttccaagaaggatctgagtacccctctcagtattcgctgatgagaaagacgcctccaggtggccaagagatgaagctgagtactggcagctcatcttcactggtagaatgtccagaatcttcttcc

SEQ ID NO: 70 - DNA, 317 bp, Homo sapiens
gggctacaccatctgtatgagggaaaagccttgggggagaggggtggggtcctgcctcctgccgagggtaagcctgcaggtgagagccatcagagggaccttcgctgcctgggagttgggttccctccaagggtgcctctttcagtgttctctctctcacctggggctgccaccctaacaggtggcaactcggcagggctgctggggggcacttcctgcccagtggggggtgccgcccaaccttctccctcccaccccgcccctggggccgttttttaccagggtccgtgcactatttatatttttcaaactgaggt

SEQ ID NO: 71 - DNA, 149 bp, Homo sapiens
  misc_feature 39: n = A,T,C or G
ctcgtccattttcgggcaagggttcccgctttaaggttntcaaagtagccaatgtttctcttttggccctatacaaaggcaagaaggaaagaccaagatcataaatattaatggtgaaaacactgtagtaataaattttcatatgccaa

SEQ ID NO: 72 - DNA, 320 bp, Homo sapiens
tctgggctccaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtggtggtgccaagtgtgcccagggctgcatctgcaaagggacgtcagacaagtgcagctgctgtgcctcatgccaggacagctgtgctctcagatgtaaatagagcacctatataaacctggat

SEQ ID NO: 73 - DNA, 240 bp, Homo sapiens
ggtttttcctttcaaaaaatttgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattga

SEQ ID NO: 74 - DNA, 347 bp, Homo sapiens
ctactcctttcctggaaaactcatgaataattcacctcttgtttagcatataatcaagaaataactcaggccaggcatggtgactcacgcctgtaatccgagcactttgggaggctgaggtgggtggatcacctgaggtgtcaggagttccagaccagactggccaacatggtgaaaccccatctgtactaaaaatacaaaattagtcaggcatagtggcatgcgcctataatcccagctactcaggtggctgagacgagaatcgctttgaacccgggaggtggaggttgcagtgagccgagattgcaccattgcactccagcctgggcaacacagcgagactgtca

SEQ ID NO: 75 - DNA, 389 bp, Homo sapiens
acatcctggagcattgcagagaatgccacccagcaaaataggagctgtccccagcaccagagagggaggccccgcccctcaaagcaccgcaggcatcagcaagcccctccctctcgtttaactaggcaccccctttgtaaagacagctgtaggcgcagtcagaaaatcacctgcatttctttccactgaagtaaaaatacatgaaatgaaatctaatcttcatgaatttttacacgcatgctgctcagggtagacattcggagttgcattttgaaggcttttctttaaatccccatctttgtttcccgggcgacgggtcccagtcgccggcggaatggcacgggcgcccccaggtgtcccgaagtgcggcgtgccggcgttgcacaccg

SEQ ID NO: 76 - DNA, 380 bp, Homo sapiens
ttttcctgcgcaggagccgcaggccgttagagcccaatggcgcccagccggaatggcatggtcttgaagccccacttccacaaggactggcagcggcgcgtggccacgtggttcaaccagccggcccgtaagatccgcagacgtaaggcccggcaagccaaggcgcgccgcatcgccccgcgccccgstcgggtccccatccggcccatcgtgcgctgccccacggttcggtaccacacgaaggtgcgcgccggccgcgctttcagcctggaggagctcagggtggccggcattcacaagaaggtggcccggaccatcggcatttctgtggatccgaggaggcggaacaagtccacggagtccctgcaggccaacgtcaa

SEQ ID NO: 77 - DNA, 143 bp, Homo sapiens
cagacttcaggcacagaccacggacgcttttgtttcctggagttgaggaggtgaccgagacttgggcttttcagccacccgttacgcatttccttcaagccggcccttttaatttgacgtacaacgttacagaaaaagcaagg

SEQ ID NO: 78 - DNA, 179 bp, Homo sapiens
ggacattcagactgagcgtgcctaccaaaagcagccgaccatctttcaaacaagaagagggtcctgcttgggagaaacttggcaaggagaagctcccgcgggtactacaaggaacatcggtcttgggcttcaagacacccaaggggggctattgagggcacctacattgacaaggaatt

SEQ ID NO: 79 - DNA, 109 bp, Homo sapiens
ggcgaaaggcttcatcaacaaatcagaatgaattataagggaagtaaaaaaggaatgttcaagagcgcattaccttttgatgtcaaaggaatacaattctatgctttga

SEQ ID NO: 80 - DNA, 124 bp, Homo sapiens
ctcgtcggaggaacttgagctggtgagagttcatcagtcagatcgtggatacgctggacgtgtcagccaagctggcccaggttgggctgggtgcagtacttcaagctctgtgcgccaagagttc

SEQ ID NO: 81 - DNA, 104 bp, Homo sapiens
gaacccacgaggactctctcattgagatcatctgctccagacccaaccaggagctgcaggaaataaacagagtcttcaagggaaatgtacaggactgatcttgg

SEQ ID NO: 82 - DNA, 106 bp, Homo sapiens
gctcgatcccacctggctcatcagggagggtgcaggaggcttcaagaaaaggaagtcccttgaggactcactgagaggaacgtgcccgtccacttgttcaaatagc

SEQ ID NO: 83 - DNA, 163 bp, Homo sapiens
cccaagcagtccgcttcaacccagcttcttttcacccttcctgacccctcacaaaagctcttccgtgaccagacccaacccaacttgcccctggtcccaagagcagatgagcttcttgggccttccacttggtgttccatgccaggcggacctggaggtgtca

SEQ ID NO: 84 - DNA, 171 bp, Homo sapiens
cggcacgagacttccttaattgtgtactgttgtctttgtgtttgacctgtagcatctaagtactggtttcaaaagttgcctagatgagttcttttctttctttccacctcctgcaaattatgtgatttgcataatttgtacatagttaggttcatttgttagtttgtattc

SEQ ID NO: 85 - DNA, 130 bp, Homo sapiens
aagaattgataagtcagaagaggagcagagcagcagctccgtgaagaaagatgagactatgtgaagattgagtctaaggggggtgcagatgactcttcttaaggagggggacctacttggatgatgatga

SEQ ID NO: 86 - DNA, 112 bp, Homo sapiens
attacatttgactaccacaactcaacggctacatagaaaaatccaccccttacggagtgccggcttcgaccctatatccccccgcccgcgtccctttcttcataaaaatact

SEQ ID NO: 87 - DNA, 154 bp, Homo sapiens
cccaggccgtgggcccatggcgccagcggaattgcatggtcttgaggcccacttccacagggacttgcagcggcgctggccacgtggttcaaccagccggcccgtaagatccgcagacgtaaggcccggccaagccaaggcgcgcgcatcgccc

SEQ ID NO: 88 - DNA, 103 bp, Homo sapiens
gtcatctcttgggagatggataacaatagtatctccatcgtcagtctttatgctactgggctggcagttaagtaggaagttatgatccatgtatgactgagct

SEQ ID NO: 89 - DNA, 121 bp, Homo sapiens
tatcagtgggtagaggtcaaagatgctgttaaacatcctacactgcatggagcagcttctcacactaaagaatgatcttgttccacmaatatctattgcactctacttgggaaaaccctgg

SEQ ID NO: 90 - DNA, 140 bp, Homo sapiens
cgcctcctttcatccggctaatatttgctttactttccactgggagacacggtattcctccgaaacccacctcagccggctccgtgtggtccttttctggcatcgtaggaggtggcctcctgatgctcctcccaccattt

SEQ ID NO: 91 - DNA, 205 bp, Homo sapiens
tcttggctacgtgaatcaccatgtaattgcattcattgccatggttttaaaggtccgctatgtgctgtacgatgtccacacctgttttcctggaattcacacagccagctccctgcttagcatctgcccttgaggatctcaggagaatctgaaactcaacatgttcaaggcagaactcctgatctcaccctcatgtaaaatctgt

SEQ ID NO: 92 - DNA, 310 bp, Homo sapiens
cggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagacccagtcgtgatgtggaggagagccacctccaagatggacacgagccacaagctgcactgtgaacctgggcactccgcgccgatgccacccgcctgtgggtctctg

SEQ ID NO: 93 - DNA, 210 bp, Homo sapiens
cagacacagtcaatcttcaccgaaagcccaagcctagctcatcttgctgttgattgttagattgttgatgcattctaaccacctcacacatatacacaaaatcaccatgggggatggagaggagaattagcgtttgcagcagtgtatcatctcctaataaaattaacctaatgttgctgcttcattagttggtgggagaagggccacatc

SEQ ID NO: 94 - DNA, 305 bp, Homo sapiens
ctcggggtcaccgacgatggcatggctgtggccacgggctcctgggactccttcctcaagatctggaactaatggccccacccccactgggcccaggccaggaggggccctgccatgcccacactacaggccagggctgcggggctggcgcaatcccagcccccttccccgggccacggggcctttgggtccctgccctcccacccaggtttggttcctcccggggcccccactgtggagataagaaggggatggaatgggggaagaggaggagcaggaggccctcatccttctgctgccctggg

SEQ ID NO: 95 - DNA, 306 bp, Homo sapiens
cacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctcccgatg

SEQ ID NO: 96 - DNA, 305 bp, Homo sapiens
agttggtccagcatattggaatccctgccagtaagatcatctgcgccaacccctgtaagcaaattgcacagatcaaatatgctgccaagcatgggatccagctgctgagctttgacaatgagatggagctggcaaaggtggtaaagagccaccccagtgccaagatggttctgtgcattgctaccgatgactcccactccctgagctgcctgagcctaaagtttggagtgtcactgaaatcctgcagacacctgcttgaaaatgcggagaagcaccatgtggagggtggtgggtgttgagttttc

SEQ ID NO: 97 - DNA, 122 bp, Homo sapiens
gtcaaatcaaaggattttatttcatttctgagaataattttgtatctcacttgctgtttctcaataatattgtataattttatttctgatttttaaaaataagcaaactgccttgacctcaa

SEQ ID NO: 98 - DNA, 302 bp, Homo sapiens
tctctttcgttgagtgtaggcgctgctaatgttaacatcgaaataatcaagcttggagcaaaccgacagcagaacaggatatgagtttacatgatttgatttgctgatgttttaaacacttagcaggagacagctatagaagccaattaaatctctccaaggtgcatagagttatctcctttgtgagaaacaatttaagggaattgcattggccctttaactgaggggagaaaagcattaggaatgaaatttcagatgcaaagtgctgatcaatcctgcctctttttgtgttttcagctttg

SEQ ID NO: 99 - DNA, 651 bp, Homo sapiens
ggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtccttctgtgttggtgtctactgaagttatagtttacccttcctaaaaaatgaaaagtttggttcatatagtgagagaacgaaatctctatcgggcagtcagatgttctcatccttcttgctctgcctttgagttgttccgtgatcacttctgaataagcagtttgcctttataaaacttgctgctgactaaagattacaggttatagttaaatttgta

SEQ ID NO: 100 - DNA, 575 bp, Homo sapiens
gtcattctcttgggggagatggattaaacaaatgatgtattctcccatcggtcagtgcttttatgctaactagagactgggcaggttgagtagaaagtgtatgaatgccattgtatgatctgagctgaaatctggtgtgcacatacttcacactgaagcagcagaaagctctgtgaaataggtctaattattcccattttatagataacaacactgagacatagctggtaagtggtaggaccaggacttgaactcatgactctgattccaaagttcatggttgcctggctgttccatgcactatgcttagagaaaaggcaaatttctcagtctttactcacataccctgatatctaccataagaaaaagaagcaaagaggctgttacccahaatgggcccatggatcaaggtatgtgtgtaagctcctgtttatttcaacgcaccatgcccaagaacttcatatggattccttcagctcagagtcagagccaccttcaggagacagaggctgtgagcgagaaaaactttgagcccaaatctgttgaacacagtaacagagaaaattctgtttcca

SEQ ID NO: 101 - DNA, 510 bp, Homo sapiens
tatcagtgggtagaggtcaaagatgctgttaaacatcctacaatgcatggaacagcttctcacaataaagaatgatcttgtccaaaatatctattgcactctacttgggaaaaccctgggttagaggtaattagagtagataacaggaagtgaaagaatggagcaaacctgcatggcaccatggaagtagaacacacagaattttgaaaacatatagggcagagagaaggcaggattaaaaagaaaattctaagggttagagctgataactgagaagatgatggtgtcacgaacagaaacagagaaattagaaggagaatcaaatcttaaggggggccaggtgtgatggctcatgcctgtaatcccagaacattgggaggccaaggcaggcagatcacttgaggtcaggagttcaacaccagcctgggcaacatggcaaaaccatatctctactaaatatataaaaattacctggtgtggtggcacgtgcccattctcccagctactcgg

SEQ ID NO: 102 - DNA, 500 bp, Homo sapiens
tcttggcctacgtgaatcaccatgtaattgcattcattgccatggttttaaaggtccgctatgtgctgacgatgtccacacctgtttcctgaattcacacagccagctccctgcttagcatctccccttgaagatctcaggaaaatctgaaactcaacatgttcaaggcagaactcctgatctcaccctcatgtaaaatctgtcccaacctaggttcctccatgtcaatagtggtgtaaccatccacctgccctttgtcctaaacatccaacacatcagcaagtcctgccgtatcaagttcctgcatttatctctaatctttgtggccactacctaggtttaggccattatcacctctggcctggattgtgcaatagcttcctatctagtcaccctacctccactcctgtctctcccaatccattctcacagagcaatgaatgtgatcctttcataatgagaactgcttcgtatcaattatctgcctaaaccttctaatg

SEQ ID NO: 103 - DNA, 105 bp, Homo sapiens
gagtacttctagagcggccgcgggcccatcgattttccacccgggtggggtaccaggtaagtgtacccaattcgccctatagtgagtcgtattacaadtcactgg

SEQ ID NO: 104 - DNA, 120 bp, Homo sapiens
aaggattctctgtaccgcccaagggaaagccgccgttattgacaagaagcagaagtggctatatggttggccaaacattaagccgattttcccgggaaaaaaggcttaaaactacaaagg

SEQ ID NO: 105 - DNA, 145 bp, Homo sapiens
cccagctctggttccccgcctctgggctacctgcctccatggctaccctgaaccaaatgcaccgcctggggccccccaagcggccgcctcggaaggtgggccccaaggaaggccggccgcagctgaagggtgtggtcatgtgcaa

SEQ ID NO: 106 - DNA, 305 bp, Homo sapiens
aaaacggatgcatttaaaaatattttctatgtcagaattttttagatgtgtgtttacttcatgtttacaaataactgtttgctttttaatgcagtactttgaaatatatcagccaaaaccataacttacaataatttcttagggattctgaataaaattccatttctcttggatatgctttaccattcttaggggtctgtgggacaaaaatatttgtaggattttgtgtaaatacaagctttcatttttattgtgtgccaattgctattgcccaaggattgctttccatgcacatattgtaaaac

SEQ ID NO: 107 - DNA, 185 bp, Homo sapiens
tggggcccccaagggtgcaacttccttcggtcgtcccgaatccgggttcatccgacaacagccggctccaccatgccgccgaggttcgaccccaacgggatcaaagtcgtataccttaggtgcaccgcggtaggttcggtgccacttctgccctggcccccaggatcggcccctgggtctgtctc

SEQ ID NO: 108 - DNA, 432 bp, Homo sapiens
cttagacactggagactgaacactgttgctattgtctaggtgaatgatagaagaactgcatgagtatcctacaaactgggggggcctaaaacaacaggaaattactttatctcagctccacatggccttctcttctctccttttgtctcctctaaataaggacccctgccattggatgttgggcccaccaggatgatacagactgcccatctccagatccttcatttaatcacatctgcaaggtctttttttcaaatatggtacaattctcaggccctgggcattaggacatggacatgtatttttgggagccaaccttcaactgactacaaggactgtggggttggaatgaaggaagagagaggttgattcagaggcgttcagctgacactaggcatagagggatgggaggagaggcaggatatttgttaa

SEQ ID NO: 109 - DNA, 315 bp, Homo sapiens
aaacttctctcttcttttcttggttaatttctctaatgacctttcaattttgtttatcttttcaaggaaccatctttttggtttcatttacattttgtatttcgctgtttacaatttcttttagttctgctctgaattcaccactaaagaactcatccatgtaaccaataactacctgtacgcccaaaactattaaaattttaaaaggttttttatcatggagggagagattaaagcagtgtttaccagagactggagaggggaagttggggaggggaggataaagagagttgtataccaggcacaatgtgcatt

SEQ ID NO: 110 - DNA, 370 bp, Homo sapiens
gagaggtcagattgctgtcagacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaggcatcacttagataatacctggagcatcatagtggttcttaactctccaaataaggttct

SEQ ID NO: 111 - DNA, 245 bp, Homo sapiens
ctggtagcctttgcatttaacaaactagcatgaggctttttatatctaaatgctacgtgatagacaatttcagctagccacatattgtatgtatgagattcataaagactttcaatcatttcattttcagacaactgaaattttgtttagtatgtgaattctttttttgaaatgtatagtgaataggatgttgcactggtggcaattcatcatggagcataataaaattaatttgacccaataga

SEQ ID NO: 112 - DNA, 320 bp, Homo sapiens
ggcagaagcgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagcttttgcagcatccagttcatcttaagaatgtcaacgatt

SEQ ID NO: 113 - DNA, 170 bp, Homo sapiens
ctgcacgagtcacaccggagcctggggcaagacagtgattgaatacaaaaccaccaagacctcccgcctgcccatcatcgatgtggcccccttggacgttggtgccccagaccaggaattcggcttcgacgttggccctctctgcttcctgtaaactccctccatcccaa

SEQ ID NO: 114 - DNA, 160 bp, Homo sapiens
aatttggagcatgtttgtttctctctgcctggttcctctggaatttggaactatctgtgagtattcttaacatatggcaatatagttgtttccatctagtgcaataagaatccatttcttgttgcaccaggatgcaattagagagactggttgttttccc

SEQ ID NO: 115 - DNA, 280 bp, Homo sapiens
ctacaacaaagtgttcctggccaagggtaacatccccgccgagagctacaccttcttcattgacatcctgctcgacactatcagggatgagatcgctgggtgcatcgagaaggcctacgagaaaatccttttcacttaggccacccggatcctcttcttcaacacacccaaaagatgacagactacgccaagaagcgagggtgggtcctcggccccaacaactactacagttttccaagccagcagcactttggcctgcaggagggcatgccccacggta

SEQ ID NO: 116 - DNA, 220 bp, Homo sapiens
gcagtgatggttgtgtgcctgtcacagccacccacctgtgcctccccccacctgccacggccattgtcctacacccagcgcacactcctgtccacggtgcgcacgtgaacccgcccgggtacacacacctgtccctgccatggtgacaggactgtgtggggatctctgccctccctgcctgaagttccctgccattggggacctgtcacaggcacacagg

SEQ ID NO: 117 - DNA, 98 bp, Homo sapiens
aacgccggctcttcggcatacgggcaaaaagagccaaggaagccgcagaacaggatgttgaaaagaaaaaataaagccctcctggggacttggattca

SEQ ID NO: 118 - DNA, 245 bp, Homo sapiens
ggtgaaatgaaggaatgataacttgcgagtgcagaaaacaacatgaaccaagacatgatgaagtagcaaggagtaaagtagatacagtataatgaaggcaaagagtagatactagggaattggtagggaaatgagtataatcatgtttgagattgttttcctccctttgcataatttaccctcatttctaatcaaagaaaacaagggtattcagattgcctgcagcccttcaagagccatggtgt

SEQ ID NO: 119 - DNA, 300 bp, Homo sapiens
ggctgctcccagccaatgtcagagcatggcaaaggtactagagccaagccattcctgctcaacatgggagtcttctgacaagcactctgctcaggagctcagcagcctggtccactctttctcagaggtgcacagcaacctggcacttttcctagccagtcctcctttcccctctccttctataggtgggattacaggtgtgccaccaggcctggcataattttagtgatgagttctcaccatgttgctcagactggtctcgaactcctggtttcaagggatcctccgctgtgtgaggct

SEQ ID NO: 120 - DNA, 314 bp, Homo sapiens
  misc_feature 259: n = A,T,C or G
ctcgggcacgctacgagagtacaaggtagtgggtcgctacctgcccacccccaaatgccacacgccgcccctttaccgcatgcgaatctttgcgcctaatcatgtcgtcgccaagtccctcttctggtactttgtatctcagttaaagaggatgaagaagtcttcaggggagattgtctactgtgggcaggtgtttgagaagtcccccctgcggtgaagaacttcgggatctggctgcgctatgactcccggagcggcnacccacaacatgtaccggtataccgggacctaaccaccggaggggttgtcaccag

SEQ ID NO: 121 - DNA, 115 bp, Homo sapiens
gccaacatgggccgggttcgcaccaaaaccgtgaggagggcggccccggtcatcatagaaaggtactacacgcgcctgggcaacgacttccacacgaacaagcccgtttgcacgg

SEQ ID NO: 122 - DNA, 143 bp, Homo sapiens
gcatatttagctacatagggaattctctggatatttaaatgatggggcgcatgcacctgaaatgagtaggtggccaaggaatgccattttctaaagctcttcgaaataatttattagccatgtagaaggaagttgagtactct

SEQ ID NO: 123 - DNA, 110 bp, Homo sapiens
ggactggcagacttcaaaatgaaatctcgggggttctatttatttatggtcttcctgtaggaccttcgggtcagggcagaggcaggaaactaactgggtttgagtcaaat

SEQ ID NO: 124 - DNA, 129 bp, Homo sapiens
gtcgtagttccgaccataaacgatgccgaccgcgatgcggcggcggttatttccatggacccggccgggcagcttcctggacagcctcttgggtccagcccccacccgaaagtggacactggctccgcc

SEQ ID NO: 125 - DNA, 184 bp, Homo sapiens
cttttcaagatgcattccagatgaactgctaggtgagggggaagcttcatttttgtttacctgatagaatagctttcttatgagatatatataatgtgatactatgttggatattttggtcttaaagcaagactcagtggtgtatctccattaaaagctcctttaaaaagttacagagttacta

SEQ ID NO: 126 - DNA, 125 bp, Homo sapiens
ggggaacagtaacagggaagcatcttcccttgccctgggacttggggtctaggggatttccaacttgtcttctctccctggaggcataaggatctgggaggaggcttgtaacctggaacttctgt

SEQ ID NO: 127 - DNA, 207 bp, Homo sapiens
gaaaaatcagggatgagcagctttatcccatttggggtatttttgtaagtgatttacatgtgtcaattttagtaatacttttacttttttgtaacttcatccttcatatatgcttgctatacaggtatgttcatctttgtgtacagaggtttaataaattagttttcatataaaaaaaaaaaaaaaaaaaccctcgggggtcctttg

SEQ ID NO: 128 - DNA, 210 bp, Homo sapiens
ggggaccagtgtgctttgaaaccaaattaggaacacattccttgggggaggcaaagttttctggggacttgatcatacattttatatgggtggggcttctctcttcgggagatgatatcttgtttaaggagacctcttttcagttcatcaagttcatcagatatttgagtccccactctgtgccccaaataaatatgagctggggattaa

SEQ ID NO: 129 - DNA, 115 bp, Homo sapiens
ggatgatccacctgcctcagctgggattacaggcgtgcagcccaaacccgggccaagaatgtgttttcaacatcatgtctacgttatagggcatctgtctcatgaggcctcatca

SEQ ID NO: 130 - DNA, 224 bp, Homo sapiens
taaataaaatgtaaaaaggccactcccaggtaaaatccagggggaagagtcatctaagtttaccatgcagttgttttaccaaaaaatagaggaggagagtcttaacttttgctcttggatttaagtcaaggtactgtatagaagttgtgtaaaacagtatgaaagttcaatgttgctgttcttgctcagtgattttaaagaaattgagtagtccctatgtgaat

SEQ ID NO: 131 - DNA, 246 bp, Homo sapiens
gcagccaggtgaggctctctagtttaataaaaatcatggaaagactcttaatgcagactcttcttaaggtgttaataggggatttttttcaagctttatttttggttgccagtttccaattttttaaaaaatgttgagggtaatctttcccaccttcccaaacctaattcttgtagatgccattagtgttgaaccaatgctttctcatgtctcaatctttgtatatgcatcttttcagatgtatta

SEQ ID NO: 132 - DNA, 160 bp, Homo sapiens
gcctcttctatacagtttcttcaatctcatttcagatcatatttctgtaataattaaggcttttgagaaggaccatccctatataattgtaagacacacattttaaagcattagaattgaaaaatgaaaaccctttaggcatttttgagcaatattttcc

SEQ ID NO: 133 - DNA, 220 bp, Homo sapiens
ccaggatcttgagctttagtgtgctatacctatgtgtcttatcgtgggccactgtgccaataaacaaaaaacaactgtttgggtttacctcagttgcagtagttattttcatttagaagttgttctcagattattgtttcagttatatagaggattactagactagttatgaggaaccccactacattcaatggaattggtgcttaaaatctcatcgatg

SEQ ID NO: 134 - DNA, 276 bp, Homo sapiens
ctgcagcctgcagcacatcagctacccggagaacgcggacggaaagaccgctgctcagcacccccgaagaaacacggaattccagagaggcacaaggcaccgccccggcgcgcacagcttgcacttaagcggctttcctttcctaacttcaaacaaacatagggggtgggagccgaggaccacttggttgcttgcgggctttctcttagcataaaagttgggaaggaaacacacaccgcgtcaagggcccaaaggcccaaaaaagaacgcgaggtc

SEQ ID NO: 135 - DNA, 285 bp, Homo sapiens
cccattcctgcactttcagtctgagtgtattttaaggtgaaattagtctcttgcaggcagcatacagttgggtcttgttttgttttgctttttaaatttttttaatccagtcatccactctatgccttttgattggataatttaatccatttacattcaaggtaattactgaatggtaagaacttaccaatgccagcttattaattgatttcctgattgctacattgagagttaaataaattttgtattttggggggccaaattcagttcttaacaagaggttcc

SEQ ID NO: 136 - DNA, 280 bp, Homo sapiens
gtcagagtccgaggcaaaatcagtcaaggtgaaaattaagctcaataaaaaagatgacaaaggccgggacaaagggaaaaggcaagaaaaggccaaatcgaggaaaagccaaacctgtagtaagccattttgacagccatgaggagcaggatgaacgtgaccagtcagaaggaagttggacggatgatgagtgatcagtatggacctttttccttggtagaccttaattccttcctccctgttttatttctacccagtgagttatttgtatataggcact

SEQ ID NO: 137 - DNA, 286 bp, Homo sapiens
gaaattaaaaatgctggattaaatgaaacattttcataaaagtattgtggatctgacagatgatgataagaactgtgaggccaaaaccagtaagcgaatctgaaaaattcacataagctgagcgttgaagctgcttttgccctggtaaacctaacaaacttgagagtattgattttcaatgcctcatagtgtagatggggatagaaaatacaactctgcccatgatcaaggtggaagcccaccaggggacactcccattcagttgagactccctcctgccttaata

SEQ ID NO: 138 - DNA, 150 bp, Homo sapiens
gagttccctacctaagagaatgttaccacctgaacagtccttcggtgaatctgagaggagaggatggggtaaggcagaagcaccagctgtactactagaagggagcttttggtggtagatccctggtgtctccaacctcactaggtggac

SEQ ID NO: 139 - DNA, 143 bp, Homo sapiens
aagatgcaccttctgagctgccttgtgcaccctccccattaagcgtaggttaggaggtttccgggaggctgctcagctggatctggagccagctggcttttgctccgttccctggctagtctgtgcctggttcaccagggagg

SEQ ID NO: 140 - DNA, 122 bp, Homo sapiens
  misc_feature 18: n = A,T,C or G
caaccaaacgcgcttggnttgcagatgtcaaagaatctgcagagggtgctactgaagatccagccttagccaatcaccacctcattgggtgaaagttccagggctcaatccaggaccacact

SEQ ID NO: 141 - DNA, 214 bp, Homo sapiens
gtagtgctagagtgcaatttacctgaggaaggcgagtctagtgtattccactgatgaattaatttctgataggaagggtgtacagagcctaacaaatagttcagatgaagaaactaataaaacaacttagaaaagtttgttgatatattcagaaactctgaactatgggcttatgttaaatcacaggtccttggaatatgaagatgaattagat

SEQ ID NO: 142 - DNA, 454 bp, Homo sapiens
ggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttgggggggctgtgtcacccagcccgcccgtcctgtgggctgcacagctcaccttgttcctcctgccccggttcgagagcgagtctgtggcactctctgccttcatgcacctctctttctacacgtcgccttcactgtaatcacacatcctgactcgtcatttataaggagg

SEQ ID NO: 143 - DNA, 372 bp, Homo sapiens
cacataccaaggccaccacacaccacctgtccaaaaaggccttcgatacgggataatcctatttattacctcagaaatttttttcttcgcaggattttttctgagccttttaccactccagcctagcccctaccccccaattaggagggcactggcccccaacaggcatcaccccgctaaatcccctagaagtcccactcctaaacacatccgtattactcgcatcaggagtatcaatcacctgagctcaccatagtctaatagaaaacaaccgaaaccaaataattcaagcactgcttattacaattttactggtctctattttaccctcctacagcctcaggagtacttcgagtctccttcaccatttcc

SEQ ID NO: 144 - DNA, 301 bp, Homo sapiens
gccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaacactgtagtaataaattttcatatgcca

SEQ ID NO: 145 - DNA, 342 bp, Homo sapiens
ccatcatgggtcgcatgcatgctcccgggaaggcctgtccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaatttttagaattcttaagtctaagggacttgctcctgatcttctgaagatctctaccatttaattaagaaagcagttgctgttcgaaagcatcttgagaggacagaaaggataaggatgctaaattccg

SEQ ID NO: 146 - DNA, 411 bp, Homo sapiens
ctcaagtgaccacccacctcagcctctcaaagtgctgggattacagccgtgcgtcccggcccctgtgagcagtaatgattactccagagatacctaataaaggaacactttaaacactggtatgaaaaggactagcagtcctaggtaactaagccgatgattttagtagggtatctctctaatatatctcaatagaagtctagcaattttcaaataaaacaacttgaaaccagaagactacggagaagacggcaaaaatttattaaagacctagaaaatagacatggttaggcttctaggatattgctagaaagttaagggaatgacactattctcaggtaccggattatttcacagaactagataagtctctctcctttggtcctctatcttgctatactattcgtctaa

SEQ ID NO: 147 - DNA, 382 bp, Homo sapiens
ggcagaagtagagcagaagaagaagcggaccttccgcaagttcacctaccgcggcgtggacctcgaccagctgctggacatgtcctacgagcagctgatgcagctgtacagtgcgcgccaggcggcgggctgaaccggggcctgcggggaagagcacttcctgctgaagcgcctcgaaaggccaagaaggaggcgccgcccatggagaagccggaagtggttaagacgcacctccggacatgatcatcctaccgagatggtgggcagcatggtgggcgtctacacggcaagacttcaccaggtgagatcagccgagatgatcggcactacctggcgagtctcatcacctacaagccgtaaggatggccggccgcatcgggcc

SEQ ID NO: 148 - DNA, 200 bp, Homo sapiens
ggttgaactagagatggacaggttatcaacgaaacttctcagcatcacgatgaccttgaataaaaattgcacacactcagtgccagcaatatattaccagccaaggataaaaaaggaattcatatcttaaggaaccagcttttcagtgcctttctgcagtttttcaaggggcccaagttagatttggaataggaattagc

SEQ ID NO: 149 - DNA, 300 bp, Homo sapiens
ggcacgaggtcaggagcagcagtgctgtgccagctccaagcccagccctcagccatggcatgcccctggatcaggccatttggcctcctcggtgggccatcttccacaagtacttcggcagggaggggttacaagcacacccttgagcaagaaggagcttaaggagcttatccagaaggagcttaccatttgctcgagctgcaggattctgaaattccaaggcttattgaagactttgaccgacaaggaccaggaggtaaccttcaggagtatgtaccttcctgggggccttggtttgat

SEQ ID NO: 150 - DNA, 205 bp, Homo sapiens
tgaatctctcctttgcctttgagctcatgcaagatggagggttggaaagcaaaccgcggccagaagacatagtcaactgtgacctgaaatctacactacgagtgttgtacaaccttttaaccaagtaccgttacggtggaggtaggggcttccctgggcccaccacttcccaagaggttctttctgttgcggtattgaccctcct

SEQ ID NO: 151 - DNA, 215 bp, Homo sapiens
agttcggacttttcttccctctctttctaagagacctgaactgggcagactgcaaaataaaatctcgggtgttctatttatttattggtcttcctgtaagaccttcgggtcaaggcagaggcagggaaattaacttggtgttagtcaaatgccccctgaggtacttcccccagcccaggccagaagacctcctttaggttccgggcgcaggaact

SEQ ID NO: 152 - DNA, 152 bp, Homo sapiens
cagaaacctgaagttagaaggctcaacgagaacaagctatcagggctgctaaggagcaaaaaaggctaagcaagcatcttaaaaagacttccaatggctgctgctaaggcacctacaaagggcagcacctaagcaaaagattgttgaaggcc

SEQ ID NO: 153 - DNA, 204 bp, Homo sapiens
  misc_feature 35, 53: n = A,T,C or G
tcgtccaatttcggcacgttactaataaagtctangataacattatatatttnatgttgatgtagcttactgttggcaaatgtacttgtgatcagccaaagcccaaggcctttccataatattcagatggatatttctgtctcagactgtgtgtggtatttcttttttacctaaatatgtatgtctctcaattattgctgttta

SEQ ID NO: 154 - DNA, 110 bp, Homo sapiens
gcaccaagctgcagaccaaggagcatgtgattgaggccctgcgcagggcacggttcagttttcctggccgccaggaggatccacatcttaaaggaggtgggctttcacca

SEQ ID NO: 155 - DNA, 120 bp, Homo sapiens
agtgtgggtgatcagcccagatttgacgtgcactcaaagactcgagaatgcagattaatcttctttccatcccgccaattttggtttcaattggacctacaaccttaagttggcatcatt

SEQ ID NO: 156 - DNA, 110 bp, Homo sapiens
tagagcagaggaggagcggaccttcgcaagttacctacgcgcgtgactggaccagcttcttgacatgtctacgagcagcttattgaactttacaattcgtgcagggggcg

SEQ ID NO: 157 - DNA, 297 bp, Homo sapiens
caaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttcaaaaaaaaaaaaaaaa

SEQ ID NO: 158 - DNA, 526 bp, Homo sapiens
cttagacactggagactgaacactgttgctattgtctaggtgaatgatagaagaactgcatgagtatcctacaaactggggggcctaaaacaacaggaaattactttatctcagctccacatggccttctcttctctccttttgtctcctctaaataaggacccctgccattggatgttgggcccaccaggatgatacagactgcccatctccagatccttcatttaatcacatctgcaaggtctttttttcaaatatggtacaattctcaggccctgggcattaggacatggacatgtatttttgggagccacccttcaactgactacaaggacctgtggggttggaatgaaaggaagagaagaggttgattcagaggccgttcagctgacagctaggcatagagggatgggagggagaaggcaggatattttgtttatttgttcatctggtgatagacttttgggctgtttccaatttgaggctattataaataatgctgctatgaacattcccatatacattt

SEQ ID NO: 159 - DNA, 482 bp, Homo sapiens
gcagtgatggttgtgtgcctgtcacacccacccacctgtgcctccccccacctgccacgcccattgtcctacacccagcgcacactcctctccacgctgcgcacgtgaacccgcccgggtcacacacctgccctgccatggtgacaggactgtgtgggatctctgcctccctgcctgaagttcctgccattgggacctgtcacaggcacacaggacacagctggctcaccctcttctctgacagcacctgggccatccctgatagtgatcagccctgctgaggaagggttagggtgggctgcaggctggaggccagggagaggccctggaccgggcctggcatttactcaccctcctcccatcccacactgtcccggagcctccatctccacctgagccagctgggttgatgcggatttccaggcatcctcagcgggacccatggcctggggtcaccaccttcctgagctgcgtggatctca

SEQ ID NO: 160 - DNA, 179 bp, Homo sapiens
gcatatttagctacataggaaattctctggaatatttaaatgatggggcgcatgcacctgaaatgagtaggtggccaaggaatgccattttctaaagctcttcgaaataatttattagccatgtagaaggaggtgagtactctgtgttcctggaagagattgaaaaaaaaaaaaaaaaa

SEQ ID NO: 161 - DNA, 135 bp, Homo sapiens
gtcaaatcaaaggattttatttcatttctgagaataattttgtatctcacttgctgtttctcaataatattgtataattttatttctgatttttaaaaataagcaaactgcccttgacctcaaaaaaaaaaaaaa

SEQ ID NO: 162 - DNA, 100 bp, Homo sapiens
  misc_feature 38: n = A,T,C or G
ttttaagttattagatttaaaatcagtactttttaatnggaaacaacttgaccaaaaatttgaaacaagaattttgagacccataacaaaagttaaatga

SEQ ID NO: 163 - DNA, 170 bp, Homo sapiens
cagagttctgcctgtgtgtgctgggttttggcatagcctgtgtttgcagtgagagtgacttgctgtcagtcacggggcacagcctcctgttcacccactggcttcccccttcccactgaagtgtgagctctatgtttcagggcatctattaaagagtgagccacaggcaa

SEQ ID NO: 164 - DNA, 270 bp, Homo sapiens
ggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtccttgcgctatctgtgttatgactcagtgtggatgtgtttatacacattttatttgtatcattcatgtaaacctcaaataaatgcttccttatgtgaaaaa

SEQ ID NO: 165 - DNA, 295 bp, Homo sapiens
cgacagcaacgtggtcttggacacaaccatgcggggtggccgcctgggggtcttctgcttctcccaggagaacatcatctgggccaacctgcgttaccgctgcaatgacaccatcccagaggactatgagacccatcagctgcggcaagcctagggaccagggtgaggaccgccggatgacagccaccctcaccgcggctggatgggggctctgcacccagccccaagcggtggccgtcctgaggggaagtgagaagggctcagagaggacaaaataaagtgtgtgtccagggaa

SEQ ID NO: 166 - DNA, 235 bp, Homo sapiens
ggcacgagggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcatttcagcatatccaagtgaacagagcacctagagatgcgaccggcgagacctacagagctcattgttcggattaaccgatacatgaga

SEQ ID NO: 167 - DNA, 150 bp, Homo sapiens
gaaaacataactgttagacttcccgtttctgaaagaaagagcatcgttccaatgcttgttcactgttcctctgtcatactgtatctggaatgctttgtaatacttgcatgcttcttagaccagaacatgtaggtccccttgtgtctcaat

SEQ ID NO: 168 - DNA, 235 bp, Homo sapiens
gcggctccatcctggcctcgctgtccaccttccagcagatgtggatcaccaagcaggagtacgacgaggccggcccttccatcgtccaccgcaaatgcttctagacacactccacctccagcacgcgacttctcaggacgacgaatcttctcaatgggggggcggctgagctccagccacccagcagtcactttctttgtaacaactaccgttgctgccatcggtaacctgacac

SEQ ID NO: 169 - DNA, 106 bp, Homo sapiens
atggttctaatcctggaaattgtgattgtgaccatgagtagaggactttcagttctaagctgataagtgtgtaggcagagaggtactttttttttgtaccccactg

SEQ ID NO: 170 - DNA, 178 bp, Homo sapiens
gtttggctctggtaactgaccttcaaagctaaaatataaaactatttgggaagtatgaaacgatgtctcgtgatctggtgtacccttatccctgtgacacgttgcctctgacaatactggtataattgtaaataatgtcaaactccgttttctagcaagtattaagggagctgtgtct

SEQ ID NO: 171 - DNA, 190 bp, Homo sapiens
ccggaaaacctctacgtgaaggaggtggccaagccgagcccgggggagggtgaagtcctcctgaaggtggcggccagcgccctgaaccgagcggacttaatgcagagacaaggccagtatgacccacctccaggagccagcaacatttttgggacttgaggcatcttgacatgtggcagagcttgggcct

SEQ ID NO: 172 - DNA, 224 bp, Homo sapiens
caaacccaaagatgttaacagtattttaagaagttgctgcagattcctttggccactgtatttgttaatttcttgcaatttgaaggtacgagtagaggtttaaagaaaaatcagtttttgttcttaaaaatgcatttaagttgtaaacgtcttttttaagcctttgaagtgcctctgattctatgtaacttgttgcagactggtgttaatgagtatatgtaaca

SEQ ID NO: 173 - DNA, 244 bp, Homo sapiens
ctagttttctgtaatttgtactttcccacactataattggcttctgttttacaaaatggtgggtggctttttcttttttgtacgtgtacaggattctgctggtacgagaggccttcctctttctgtttttaaaaaaagttttactgccatattggcattccattccctgttgccatcctcactgttacctgttttgggttctggtctactttgactttcaaagtacctccagcctcctcatacg

SEQ ID NO: 174 - DNA, 111 bp, Homo sapiens
gctgaaggaaagattgatcgccgttctggtaaaaagctggaagatggccctaaattccttgaggtctggtgaatgctgccattgtggatatggtccctggcaagcccatgt

SEQ ID NO: 175 - DNA, 121 bp, Homo sapiens
ctttgtttcttggggcaagcaggaaaatttaaatttgtacctattttggtatatgttgaggatggtttaaataaatttggtggaaaaaatggaaataaaggcatggttttgggttttccca

SEQ ID NO: 176 - DNA, 113 bp, Homo sapiens
cttcgttgccgaatttcggcacgagggcagcgcgggaggccgcacgattgccttggagttacttgttaaagacgttgaacccagccaaggagtttcgttcagagctcttggca

SEQ ID NO: 177 - DNA, 150 bp, Homo sapiens
atcacggagctgaatctgccgcagctagaaatgctcaagaaccagctggaccaggaagtggagttcttgtccacgtccattgctcagctcaaggtgggtacagaccaaggtatgtggaagccaaggactgtctggaacgtcctgaacaag

SEQ ID NO: 178 - DNA, 125 bp, Homo sapiens
tcctttttcaagtccattttggaaagatgaaggcagtgaatttcccatttcacccttgatcccaccaggaaggcaaaaaggattgttctcatcaaggaaaaccaaaggagatggcctattgacca

SEQ ID NO: 179 - DNA, 111 bp, Homo sapiens
ctcggagaagcaggggagagtggcgggccgctgaataagcttccaaaatgatgaccacaccagtttatcctattgcacagagggggactgatagctccccaaggcatcccc

SEQ ID NO: 180 - DNA, 204 bp, Homo sapiens
gggagaagaagggattttgcctctatcctgaccaatgcaagccctctggctgtgaacctcctgggaggagattgctgggtgcctgggacggcggagcagccgggtgacggccaggcggaggcgctgggcccatcccttactttcggagtcccttccacggacacgggaaggattgaccccccaaggtccaggaggtattgatgg

SEQ ID NO: 181 - DNA, 206 bp, Homo sapiens
cacagaagtctggtcacctctgggcgcctgggatggtcaccgaagagaagcacgctgtccccgtctcttcctggcttctgccagaaaatcgaacaagtgcaattaacacactgttactgccggagcctgaaactcccaggacttgtccttgatccttccagaaaccaccaggtccggcacttggagcccccgggagagggacctcc

SEQ ID NO: 182 - DNA, 221 bp, Homo sapiens
cggaggtgcaggtcctggtgcttgatggtcgaggccatctcctgggccgcctggcggccattcgtggctaaacaggccggaaggtggtggtcgtacgctgtgaaggcatcaacatttcttgcaatttctacagaaacaagttgaagtaccttgcttttctccgcaagcggattgaacaccaaccctttccgagggccctaccactttccgggccccagccg

SEQ ID NO: 183 - DNA, 182 bp, Homo sapiens
attggagagacaagagaaagggcgaatgaggcgaagaagagggttaggaaaataaatggaaccgtatcaacgaaatgtcgttaagtaatagagttagattaagtgtattaagagagttagagagagtattgaatatattcctttaagtaaaaatttctggaatatatgttcgtgaattagag

SEQ ID NO: 184 - DNA, 101 bp, Homo sapiens
gcctagtggtcctgttcaagccgagctcgatgccgttcggccgggggcgcctcggtgtgcccagatgggtgctcccgttcctccaggagcttgggggggtt

SEQ ID NO: 185 - DNA, 111 bp, Homo sapiens
acacaacgtaacaataacatatttagccaatgtagtagactgctatataatacattagagtgtcaattcattccgtttacagccccattgggtgtcaaattttttttgtty

SEQ ID NO: 186 - DNA, 195 bp, Homo sapiens
catcagaaagattcattggcatgccacaggggattctcctccttcatcctgtaaaggtcaacaataaaaaccaaattattggggctgcttttgtcacactagcatagagaatgtgttgaaatttaactttgtaagcttgtatgtgggtgttgatcttttttttccttacagacacccataattaaatatcatatt

SEQ ID NO: 187 - DNA, 157 bp, Homo sapiens
tggtttgtgctccccctactgcctatatcgacttcgcccggcagaagctagatcccaagattgctgtggctgcgcagaacttctacaaagtggactaattggggctttactggggaggatcagccctggcatgaatcaaaggactgcggagccacgt

SEQ ID NO: 188 - DNA, 283 bp, Homo sapiens
tcgtgccgaattcggcacgagggcggcgcgtggtctacgccgagtgacagagacgctcaggctgtgttctcaggatgacccagtgggagacagcagcaccagcggtggcagagaccccagacatcaagctctttgggaagctgagcacccatgatgtgcagatcaatgacatttccctgcaggattacatttcagttaaggagaagtatgccaagtaccttcctcacaatgcagagcggtattcctccaaacgctttcccaaagctcagtgtccccttctggr

SEQ ID NO: 189 - DNA, 152 bp, Homo sapiens
gtcctcttcaatcgtagatttcacactttttaaaactacccattatacctctgcaaacaaattactccccccatttcattccctattacccaataaaacgtcttaccacccctcaaagactttgtgttacaaaaagataaacaaaagcgtct

SEQ ID NO: 190 - DNA, 157 bp, Homo sapiens
ctcgtgccgaattcggcacgagcacaagcacagggagatgcgtgggctgacatctgcaggccgaaagagccgtggcctttggaaagaggtccacaagttccaccacactatttgtggctctcgccgggcagcttggagaaggcgcaatactctccar

SEQ ID NO: 191 - DNA, 74 bp, Homo sapiens
cttattaatcatacaaactctcaccatgatgtgaagagtttcacaaatccttcaaaataaaaggtaatgacttt

SEQ ID NO: 192 - DNA, 150 bp, Homo sapiens
ctccaccaaccaactttccccaacccggcaagacagcacccaactaaccccacaaagcaaaaatgggggacaatttacatggcctttggaaatattttttccttgcattcatctctcaaccttggttttatctttgacccacccgacatg

SEQ ID NO: 193 - DNA, 138 bp, Homo sapiens
cccacacgccgcgggacctccaggggcgactctagtggcctgaggagatgtatttatagggcccccagcagggctgcttcccccctcgggccggtgcccaaggatgggctcctcccggcgggggctttggccaaagct

SEQ ID NO: 194 - DNA, 154 bp, Homo sapiens
ttgggtgtttatgaagttgaagaccagattacagctgtcagaaaattcatagagatggggtttcattgaatgaaaaaaggatagccaatatgggggctcgtcctcttgagggataccggttcatcacttggccctttcccatcttggacctggg

SEQ ID NO: 195 - DNA, 129 bp, Homo sapiens
taatcacccaccatagggcatgattaacaaagcaacctttcccttccccggagtgattttgcgaaaccccccttttcccttcaagcttgcttaagatgttccaaatttagaaaggctttaaggcggccc

SEQ ID NO: 196 - DNA, 130 bp, Homo sapiens
gtggcagccatctccttctgggcatcatggccgccctcagacccttgtgaagcccaagattcgtcaaaaagagaacccaaggaggttaatcccgccaccacgttaagaccccttttttcaaaaattaags

SEQ ID NO: 197 - DNA, 117 bp, Homo sapiens
ctctatctctgtaagagataaaaaaggccatgcatcatagggcttagaagggcgagatgtcctatgtagggtggccatgccctctattgaacatatatcgtaataggagcctgagta

SEQ ID NO: 198 - DNA, 156 bp, Homo sapiens
ggcatatcctgtcggggtgacgggcccatggggcggagctcgtccgcatggtgctgaatggctaggaccttcccagtcttcccagagttcgtgcctttccctgtgtgaattttgtatctagcctaaagtttcccatgggctttcttgatctagaac

SEQ ID NO: 199 - DNA, 101 bp, Homo sapiens
ctcgtgccgaattcggcacgagcccaagaagcatctgaagcgggtcggcagctccaaagcatttggatgcttggataaattgaccgtgtgggttgtctgtc

SEQ ID NO: 200 - DNA, 137 bp, Homo sapiens
cggacattcagactgagcgtgcctaccaaaagcagccgaccatctttcaaaacaaggagaggggtcctgctgggagaaacttggcaaggagaagcttccgcggtactacaaggaacattcggtcttgggcttcaagg

SEQ ID NO: 201 - DNA, 148 bp, Homo sapiens
tctgcaccaactttctccaccgttacggcatcagagaccagcattccaatggtacataggacaggcaggtttgtacagaggacagtattgggaacacaaggcctgtattaattgccagtttgctggctgggcacagtggcttatgcct

SEQ ID NO: 202 - DNA, 528 bp, Homo sapiens
ctcgtgccgaattcggcacgaggcagcgcggaggccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatggcggccgcaaactgacacctcagggacaaagagatctggacagaatcgccggacaagtggcagctgccaacaagaagcattagaacaaaccatgctgggttaataaattgcctcattcgtaaaaaaaaaaaa

SEQ ID NO: 203 - DNA, 450 bp, Homo sapiens
tgctttttcaagtccattttggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaatttgcagatgtattatgaacagggattagaaaaaccatttaaagagatacagcttgatccaaattgtaggctt

SEQ ID NO: 204 - DNA, 470 bp, Homo sapiens
ctcgtgccgaattcggcacgagacacagagaacaggaggaactgaggcgacagcaagagggctttaagccaaactacatggaaaatggtgataaaagaaaatgtggctgaagttacccgaagttcagcttgcagtgtaattcagaagagttaagaccagaagtactggaatcatacttcctttcaggtcaaaacattttgtgggaaatatcctgttcgtgacctaggagaaacaagacagaaaacaaatctttcttcatttatgaatttcttactccatacaagcagtttatggatgtctgggcaatcatagcacttgccatttaaaaacatgctacaggggcacattttctgtggttaaaaatgatctccagaataagtgtaaactgcagttttcctttgcattgagggttttggctttttatttgtaaattaaatcaagatgttacccaaaaaaaaaaaaaaaaaaaa

SEQ ID NO: 205 - DNA, 584 bp, Homo sapiens
ctcgtgccgaattcggcacgagggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcacaaaccagtccacaagcacagggagatgcgtgggctgacatctgcaggccgaaagagcccgtggccttggaaaggggcacaagttc

SEQ ID NO: 206 - DNA, 166 bp, Homo sapiens
ggtcaagaatgtgttgaccttcaaccgcagacccagaacggcagaagttccaagggaggccttccagctggtttggaccgaacaggtgaatggcaaagagtcctgtacaagccaagtgttgggggaatgtgtatggagggcccctggggccagaaacccttaccca

SEQ ID NO: 207 - DNA, 297 bp, Homo sapiens
aacttactcccctgtggtgagtaccgtggaaccccagcccacctcactatcatactcagcttcccctgattggcccatcccagcccctgaagctctatgccaagaaccaaagctaccggacaccacctgaaacagccacagccaaggtaggcatgcatatgaggtcttcccataccctctgggtgttgagaggtttagccacatgagggagcagaggacaatctctgcagggctgggagtgggtagggcctgaggtctcaataaaccttcagtacctgaatgaacttgcttcataca

SEQ ID NO: 208 - DNA, 154 bp, Homo sapiens
aacaataccagccttaactatgcagctcatgctgtgacatccaggggtccagggaccacccagcctctgctgagtttgttttacagggagacacagaagagctccaagctaatgcctgcaccaatccagctgtgcatgacaagctgaagacatg

SEQ ID NO: 209 - DNA, 247 bp, Homo sapiens
ctgtcgaaatgcaccatgaaggctttgaggtcgaaggctcttccttggggacaaatgtgggcttcaatgtcaagaatgtgtctgtcaaggatgttcgtcgtggcaacgttgctggtgacaacaaaatgacccaccaatggcagcagctggcttcactgctcaggtgattatcctgaaccatccaggccaaataagcgccggctatgcccctgtattggattgccacacggctcacattgcatgccac

SEQ ID NO: 210 - DNA, 617 bp, Homo sapiens
gtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagcgtttgtgaggcatatcctgtcggggtgacgggcccatggggcggagctcgtccgcatggtgctgaatggctgaggaccttcccagtctccccagagtccgtgcctttccctgtgtgaattttgtatctagcctaaagtttccctaggctttctgtctcagcaactttcccatcttgtctctcc

SEQ ID NO: 211 - DNA, 228 bp, Homo sapiens
aaccactgcagctggcgtggctgtgggctctgctgtggggcacacattgggtcacgccattactgggggcttcagtggaggaagtaatgctgagcctgccaggcctgacatcacttaccaggagcctcagggaacccagccagcacagcagcagcagccttgcctctatgagatcaaacagtttctggagtgtgcccagacccagggtgacatcaagctctgtgaggg

SEQ ID NO: 212 - DNA, 251 bp, Homo sapiens
accagggagattaaggacctgaagctgaagggtgatggacctccgtgggaaggttcaagcgcccgacccctccgtcgaagtccgtgtctcggctgaggccatgctccgggccctgctggctccaagcacaaggtgtccatggatctgccgggccaacctaaagtctgtgaggagggaggacacagagagggagcggcctgtggaggtgggtgactggagaaagacgtggagccatgtctggcatgcaggcc

SEQ ID NO: 213 - DNA, 95 bp, Homo sapiens
tgccgaattcggcacgagcaaaggatacaatttctcagtcctgtctgttcttattgatgtcctttacagttaataaatttgagcacactaaaaca

SEQ ID NO: 214 - DNA, 109 bp, Homo sapiens
ggaaagcaggagagcttgctttgtggacacagcctggcaggaagaattttactgccttaggccccactgatcatcccagaaccgatgattatcgtagtgtatttccacc

SEQ ID NO: 215 - DNA, 101 bp, Homo sapiens
cactgaagaacatcacctaagagcatttatttttgcaccagtatgggacaacattgacgtgcattgcaccatcatgactgcaccgaggccagtggccaaag

SEQ ID NO: 216 - DNA, 118 bp, Homo sapiens
gtggactggggctctgagtccacctggctccccctgcatgccccggggtcccaccctctcccgacgaccttccgagccgcgggttacttgccctgtccctcaagtacgtccccgccgg

SEQ ID NO: 217 - DNA, 120 bp, Homo sapiens
attttcagggtgctatcggacatcatgacaagacacggggatttcagaagacgtattgtcaccaaattcatactttgtcatcatctttgcactatcatgcatcacagtgcattcacacgt

SEQ ID NO: 218 - DNA, 301 bp, Homo sapiens
ctggaatagtgagttgggaggatgcggagacagctagccaactgcattaccaaaccatattgcacttttcagttccctagttttctaggtcagcttcgattccctgactaggaggatgatgatatctaggcataacctagcctgtcgaggaccctagttcaggacagacaactgacatttattgcaatatcatgcactagtccttacatatgtcatattttcgattatagacatcagtagcacacagcatcttggggattttcatctgacttccctggccatcttatcccatccttgcact

SEQ ID NO: 219 - DNA, 193 bp, Homo sapiens
gtgtgatggtgcatgcctgtcatcccagctcctcagtaggctgagacaggagcatcacttcgacgtgggaggcagaggttgcagtcagccgagattgcaccaccgcactccagcctgggtgacacagcgagacttatctcatacatcatagatagatactccagcctgggtgacagagcgagacttatagata

SEQ ID NO: 220 - DNA, 147 bp, Homo sapiens
gctaaaggagcagaggcatggagacggtcatccctgtagatgtcatgaggcgagcctgggattcaggtcaccgttgcaggcctggctgggcacagacccagtacagtgtagccgtgcatgtggtcatttgtcctgatgccagccttg

SEQ ID NO: 221 - DNA, 156 bp, Homo sapiens
gacatttttgtattttcagtagagacggggtttcaccatattgatcaggttggtcccacactcctgacctcaggtgatccacctgcacttggcctcccacagtgctaggcattacaggcgtgagccccgtgcccagccagcacacatatagtctct

SEQ ID NO: 222 - DNA, 136 bp, Homo sapiens
caactcccaatttcgtggttgacgttataaagactgactgatggcacgacaggcccttgtgttggactgtcattatccagaggatgaggttggacaagaagacgaggctgagcagttcacatcttctctatcaggg

SEQ ID NO: 223 - DNA, 241 bp, Homo sapiens
ggaggacagaaacctcccgttggagcagaagggcaaaagctcgcttgatcttgattttcagtacgaatacagaccgtgaaagcggggcctcacgatccttctgaccttttgggttttaagcaggaggtgtcagaaaagttaccacaggccagaaagcagcgccttgcttcaaaagctcagaagggtcaaaaagctccagcccagaaagcaccttctccaaaggcatctggcaagaaagcat

SEQ ID NO: 224 - DNA, 129 bp, Homo sapiens
ccaaaatctgcatgttggtgtgtgcccaggcagacttcgaggggttcgtgctgtaagacctaaaggtccttatgagattgttccaaacaaaggaaaccatgtcaagcagggccctatggtggttccatg

SEQ ID NO: 225 - DNA, 159 bp, Homo sapiens
gttccagcaggaatacttcggcagctaggctccctggagggcacggtgaagaggccttcaagccctgcagcctccgacttcctgctggctccaggaccggccgtgcgcgcggccagcagatggcgatgcaggaccagcctggcttcgaggaagcccgcg

SEQ ID NO: 226 - DNA, 170 bp, Homo sapiens
ctctggaaccattaaagagatcctgggggactgccagtcagtgggctgtaatgttgatgggccgccatcctcatgacatcatcgatgacatcaacagtggtgctgtggatgccagccagttaaggacaaagggaaacattcaattaaaggatcaattgacaacttggtga

SEQ ID NO: 227 - DNA, 112 bp, Homo sapiens
ccctctcttttacccagagacagcacatacgtgtgcacacgcatgcacacacacattcagtattttaaaaggattgttttcctaggttgccatcttcaattttaattttaat

SEQ ID NO: 228 - DNA, 182 bp, Homo sapiens
ctgaactgtgtctaagggtcggtcggtttaccacttggacgggtgctgcatcggcaaggccaaggttgaaccaccggatgggtgccaacccattcggtttgtttttggcaagcagcttttgaaaccggtaggcgcctctgtcaaaccttcaagggcattgcacaagtttgactttggggaag

SEQ ID NO: 229 - DNA, 143 bp, Homo sapiens
aacgcctgccacgcgtcggaactcggccgcgggacatccacggggcgcgagtgacacgcgggaaggagaagcagtgttctgcttggagccgatgccaaacaccatgcatttcttattcagattcattgttttcttttatctgt

SEQ ID NO: 230 - DNA, 133 bp, Homo sapiens
gaccgacaaaattccagttatttatttccaaatgttttggacacagtataatttgacacaggacaattggatacttcctctttttttggcttgttccaaccaaatacaattcaacttgctttttggttttaat

SEQ ID NO: 231 - DNA, 169 bp, Homo sapiens
aatggagtgtgtattgttccagtgacacttcagagagctggtagttagtagcatgttgagccaggcctgggtctgtgtctcttttctctttctccttagtcttctcatagcattaactaatctaattggggttcaatattggcattcaacctcggtgctggatattttc

SEQ ID NO: 232 - DNA, 164 bp, Homo sapiens
ctaggttgaagtctagattgacagacatctgaatccatgtcattcataaccccttgatctgtagtgtcatgggtcctgccgcaggaggcagttgaacctgggggtgcctgcagccttccactcctgccccgccttacccacatgctccctgttttctcatgctt

SEQ ID NO: 233 - DNA, 166 bp, Homo sapiens
cacacctggctaaaattttttttttgttgagacggattctctatgttccccaggctggtctcaggctcctgggctcagatkggtcctcctttttcaagttccaaaaggcacaagccaaagtttttaggtttttgcccttgcccatcatgcccaacaaggaggttct

SEQ ID NO: 234 - DNA, 346 bp, Homo sapiens
gccaccagcccctcactgtggttcggaggagagtcaggaagggccacgacaaagcagaaacatcggattttggggaaccgcgtgtcaatccctttttcccgcaggcttgggttgggagagacttttctgttccttgtgtaactgtgttggctgaaagactacctcgttctggtcttgatgtgtcaccggggcaactcctggggggcgggaatgggggcaggttggaagcggctccccattttataccaaaggtgctacatctatgtgatgggtggggtggggagggaatcactggtgctatagaaattgagatgccccccaggccagcaaatgttcctttttgtca

SEQ ID NO: 235 - DNA, 219 bp, Homo sapiens
agacatgggggaaatcgccagcttcgataaggccaagctgaagaaaacggagacgcaggaagaagaacaaccttgccgaacaaagagaccaattgagcaaggagaaggcggagtgaaactttcctaaagatcctggaggatttcctcacccccgtcctcttcgagcaccccagtcgtgtatgtgggaggaagagccacctgcaagatggcacacgagcc

SEQ ID NO: 236 - DNA, 120 bp, Homo sapiens
cataccacacgatcacgtgtcacgacattagcttcacatttgttcaggcaacagaaagacttcggtgaccacaccttataaaccagacagttttgtcgatcactttgggcaatttcaatt

SEQ ID NO: 237 - DNA, 135 bp, Homo sapiens
cagcaacatgctttaaccccattgtatgtttgtggccagagcatagtttcacatcttgagacatttgggacatcaaggtttcatggtagacaggtcatgcagtatatggcatttacatcattggcaattcgattr

SEQ ID NO: 238 - DNA, 186 bp, Homo sapiens
gttagcatggcaatcattacacagtcaggccacaggccatcattaccaagtagtgacacaggaaccacttttacactgttagtaggactttccactagttccacccttgttggaggccagttttggccatttcttcagggtcttggacctggaattaccatttgacccaaccatcccattactggg

SEQ ID NO: 239 - DNA, 170 bp, Homo sapiens
gcggctcggccccggcggcgctggaccccgtcgaggatctaacgcaagtccctacctgaggaactccagaagtcgcttcgatgttgaaggacgtgcagatgctgcaggacggcatcagcaagatggaaccccacccaccgaaaaggtaccacatgcaggcgattgcaatt

SEQ ID NO: 240 - DNA, 120 bp, Homo sapiens
cggcacgagtgttcattcagccttgtacctgtgctcttcaataaacctcttgggttttttgggcaggaaataaattttgggaacatttgtttgcctggttgtttcctgttgaaaaaatam

SEQ ID NO: 241 - DNA, 140 bp, Homo sapiens
ggcttatcatcattttaggcttatctattactgtgtttggactgctataatacacaacaaccgaacgtgccgggaatgctgtgtaacctgcctttgaagcactcctcagtacgttttgccaacctatgtgaatggccgtg

SEQ ID NO: 242 - DNA, 145 bp, Homo sapiens
caaaacagaccaggcacagaaagctgaaggtgctggagatgccaagtgaagtgtgtgcatttttgataactgtgtacttctggtgactgtacagtttgatatactatttttatcaagttttataaaagtgcagaattttgtttac

SEQ ID NO: 243 - DNA, 265 bp, Homo sapiens
tatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaaaaaaaacggcacgagctcgtgccgaattcggcacgagagtaaaacccagcccatgaccctaacaggggccctctcagccctcctaatgacctccggcctagccatgtgatttcactc

SEQ ID NO: 244 - DNA, 310 bp, Homo sapiens
gccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtgacgtgtgatcaccattatgcagaattcacgccagtacaagatccagactgttcttgaacagcagaggatgtcaaggatggaaatacagcaggtcctagccaattgctggacaaca

SEQ ID NO: 245 - DNA, 250 bp, Homo sapiens
taaatagcctagtctggggagtcttccataaagttttgcatggagcaaacaaacaggattaaactaggtttggttccttcagccctctaaaagcatagggcttagcctgcaggcttccttggctttctctgtgtgtgtagtttgtaaacactatagcatcttttaaggtccagtgtccattgaaaccttccacatccgtgtactctctggctatatacaagtttttgggagcgagggttccctctccctc

SEQ ID NO: 246 - DNA, 200 bp, Homo sapiens
cctggtcggcagagagtagcctgcaacattcggccgtgttacgatgagtttacccctcaatcccaaacctttcctcaatgactaacaggaaagccagtatggtgaaacttaagtggggaatgagtacaagggctatcttggtatctgtagatggctacatgaacatgcagcttgcaatcaagaggattcacataggtggg

SEQ ID NO: 247 - DNA, 230 bp, Homo sapiens
cttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtagatgtagaagtgtaaaatagaatagttggagtgttaattcgtgttcctttcctaacatttggatgattgtcatagggtt

SEQ ID NO: 248 - DNA, 180 bp, Homo sapiens
tactatgcagccataaaaatatgatgagtttatgtcctttgtagggacatggatgaaattggaaatcatcattctcagtaaactattgcaagaacaaaaaaccaaacactgcatattctcactcataggtggtattaacaattagacatgttgacacaggtagtggtacatcacactctg

SEQ ID NO: 249 - DNA, 300 bp, Homo sapiens
acaagtggtattggacaggagatgtcgccacaatgaatgagcagggcttctgcaagatcgtgggccgctctaaggatatgatcatccggggtggtgagaacatctaccccgcagagctcgaggacttctttcacacacacccaaggtgcaggaagtgcaggtggtgggagttaaggacgatcggatgggggaagagatttttgccttcattcggcttaaggacggggagtagaccacggtgagagataaaacatttctcaaagggaagatctctcacttcaagatccagagtcaatcgtt

SEQ ID NO: 250 - DNA, 228 bp, Homo sapiens
ctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagcttgtggagaagcggcgttcgtgagatcagttgtagctgccatcagatgccggagactctgcctctcaat

SEQ ID NO: 251 - DNA, 233 bp, Homo sapiens
ctcgtgccgcagaacatcacctaccactgcaagaacagcatttgcctattctggacggaagcagctagcaaccctcaaggaaggccctttctcatccagggcttccaattgacggtggagattccgggcaggagggcaattagcagggttcacggtacacttgccctgaagggatggtctgcacggaacatcccgttaggtggggccaagctctgtatctcggagtacccggt

SEQ ID NO: 252 - DNA, 101 bp, Homo sapiens
tgtaaatctttttattagataatgtaaagatgtatatcagtatttttggatcatgttatagattatggatatattgtttaataaataaaggtatttttggg

SEQ ID NO: 253 - DNA, 167 bp, Homo sapiens
cggcggcgttggcggcttgtgcagcaatggccaagatcaaggctcgagatcttcgcgggaagaagaaggaggagcttctgaaacagccttgacgaccctaaggttgagcttgtcccagcttcgcgtcgccaaagttacaagccgttccgccttcaagctttctttag

SEQ ID NO: 254 - DNA, 222 bp, Homo sapiens
gggcgcccagctgccaacaccaagattggcccccgccgcatccacacagtccgtgtgcgggaggtaacaagaaataccgtgccctggaggttgggacgtgggggaatttctcctggggctcagagtgttgtactcgtaaaacaagggatcatcgatgttgtctaccaatgcatcttaataacggggctggttcggtacccaggccctggtggagggattgca

SEQ ID NO: 255 - DNA, 487 bp, Homo sapiens
ggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttat

SEQ ID NO: 256 - DNA, 613 bp, Homo sapiens
cactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggccctatggcggtggaggcaatactttgcaaaaccacgaaaccaaggtggctatggcgggtccagcagcagcagtagctatgcagtggcagaagattt

SEQ ID NO: 257 - DNA, 496 bp, Homo sapiens
gtgggactggggctctgagcccacctggctccccctgcagccccgggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatgcttcgtgctgcctgatgacagccgggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggcagcagctatgggctgcaggtgccctggatggattccacacctgaggagaagcagctgtggcaa

SEQ ID NO: 258 - DNA, 564 bp, Homo sapiens
aacgcctgccacgcgtcggaactcggccgcgggacatccacggggcgcgagtgacacgcgggagggagagcagtgttctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggctcgaaattctactgcagccggacacaaaatgaaggccaccccaaatggtttgttcttggtgttgggcaagtcataaaagggctagacattgctatgacagatatgtgcccctggagaaaagcgaaaagtagttatacccccttcatttgcatacggaaagggaggctatgcagaaggcaagattccaccgggtgctacattgatttttgagattggaactttatgctgtgaccaaaggaccacggagcattgaggacatttaaacaaattg

SEQ ID NO: 259 - DNA, 108 bp, Homo sapiens
atgaatcctctggcatttgtttgagatttgctctatggcctagtatgtggttgtaaatgttccatctgtgcctgaaaaaatgtatatttctaattcagtagtctctgc

SEQ ID NO: 260 - DNA, 214 bp, Homo sapiens
gtcatttgcatacgacagtagcattctgaccacacttgtacgctgtaacctcatctacttctgatgtttttaaaaaatgacttttaacaaggagagggaaaagaaacccactaaattttgctttgtttccttgaaagaatgtggcaacactgttttgtgattttatttgtgcaggtcatgcacaccgttttgataaagggccgtacccagtatt

SEQ ID NO: 261 - DNA, 76 bp, Homo sapiens
cagatacaattttcaccagtgttttttgtctaccttgctgcttctgaaaatatacatataagccttttaaaatgaa

SEQ ID NO: 262 - DNA, 100 bp, Homo sapiens
gatcatggcatgtttccactgttatacacagagtagtttcactagccctaaaaatactctatgttctacctcgtcataccttcatacttctcataatcct

SEQ ID NO: 263 - DNA, 110 bp, Homo sapiens
cgggggtttaatgtgattggccaggctggtctaggactcctgtaccatccaagtgatctgcccacacttggccttgcaaagattctggattagcaggtgtcaagtgcact

SEQ ID NO: 264 - DNA, 249 bp, Homo sapiens
aagccctttgagtcatggaaataggcaccattctctttggcaatctctttgcgagtgtcttctcgagaagacactccccgtttcactgcacttggcccacagtaaggctgtcctggggcccttgaaggcacatttttggtgctgtccaggaggagagcctagaaatcacagggaggttgccattcacttctctaggccaaactaggggaaacacctcaactgaggggcttgatcatctcccgatgtccm

SEQ ID NO: 265 - DNA, 176 bp, Homo sapiens
gccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtcttct

SEQ ID NO: 266 - DNA, 186 bp, Homo sapiens
gtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagtgccaaagcctta

SEQ ID NO: 267 - DNA, 112 bp, Homo sapiens
gattgaagtaattgaacgttaaatagtgcaaaattggatggatggatttattactaatgtaatgtaactttgctcatgtatgttatgttcaattataccaggagcttttatg

SEQ ID NO: 268 - DNA, 259 bp, Homo sapiens
aggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagagatcaagaggtttcacattaaaattagaatttctggcctctctcgdtcggtcagaatgtgtggcaattctgatct

SEQ ID NO: 269 - DNA, 207 bp, Homo sapiens
aaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaatttggaagtatctatgaacttccataaataactttaa

SEQ ID NO: 270 - DNA, 252 bp, Homo sapiens
ttactttttaggctttagtatattatctagaaggtttggcttttgatgtggatgatgtgagcttcatgtgtcttagaatctactacaagcattacctaacatggtgatctgcaagtagtaggcacccagataaatatttgttgaatttagttaaatgaaactgaacagtgtttggccatgtgtatatttatatcatgtttaccagatctgtttagtttccacatatatgtatatgtatatttggatgactat

SEQ ID NO: 271 - DNA, 269 bp, Homo sapiens
ccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggtacaaattgcgaagagacgcagactttcctctctccgagcttctacttctaagtctgaatccagtcaagaaataaggttttttgagttacaaataaataagatc

SEQ ID NO: 272 - DNA, 109 bp, Homo sapiens
ccgcttctggcctcttggagccatgggccaaaggccaaggggatgggcagaggtctgtgtttggtctggcccagttccccatcattaaactcagcctgactgctgccta

SEQ ID NO: 273 - DNA, 169 bp, Homo sapiens
agcagctccatttctggagtctgggtcttccgaggccaggagcttgcctttaccgctgagtccagattggcaggtggactacgagtcatacacatggcggaaactggacctggcagcgaggagacccagacgctggttcgagagtacttttcctgggagggggccttcc

SEQ ID NO: 274 - DNA, 262 bp, Homo sapiens
ctcgtgccgaattcggcacgagcagggacacatggagtgcctctaactccatcctgtttgtgtctgtttctcacagctggagttgatcaaggatgatgaaaaagaggcttaggaaggagaggatgacagagacagcgccaatggcgaggatgactcttaagcacatagttgggtttagaaatcttatcccattatttctttacctaggcgcgttgtctaagatcaaatttttcaaccagatcctctcccctagtatcttcag

SEQ ID NO: 275 - DNA, 105 bp, Homo sapiens
gtttcttgggcaagcagaaaaattaaattgtacctattttgtatatgttagatgtttaaataaattgtgaaaaaaatgaaataaagcatgtttggttttccaaag

SEQ ID NO: 276 - DNA, 198 bp, Homo sapiens
ctttggtcttccacagtcatgttgaggtgggctccctggtatggtaaaaagccaggtataatgcaacttcaccccagcctttgtactaaggctcttgatagtggatatactccttttaaggttaggcccaatatagggtaatggaaatttcctgccctcttgggttccccattttttactaataaggaggcccagtgt

SEQ ID NO: 277 - DNA, 162 bp, Homo sapiens
aaactaaatcaacccaatgtctctcctacccactcaccattgctacccttctcacctctgcctcctggtggcctctatggggtttccgactcatgagatcccctatatcatgggtgtccaactttccaggatcgtaaccagctttatccgctcctgcctttc

SEQ ID NO: 278 - DNA, 209 bp, Homo sapiens
ctcgtgccgaattcggcacgaggaagattctaggaggggagggaccagcaaatctgagagaaccgtcctggggccttccttcgaggagccctctgatgtgaggagggacttgagttgagttacgctgtggtgttaggtgtcctagctacttacccggaagtccaggtgaatctcgtcataggtgactctcaggcttctaccaggatccg

SEQ ID NO: 279 - DNA, 221 bp, Homo sapiens
gaagctttgagtgaagctcttcctggggacaatgtgggcttcaatgtcaagaatgtgtctgtcaaggatgttcgtcgtggcaacgttgctggtgacagcaaaactgacccaccaatggaagcagctggcttcactgctcaggtgattatcctgaaccatccaggccaaataagcgccggctatgccctgtattggattgccacaaggcttcacattgcgtg

SEQ ID NO: 280 - DNA, 168 bp, Homo sapiens
ggacagagatggatgatggggagggggctggcctggaaggacccccagtgcaggtgacattgaagccaggtttcaaagctcccacagggagctgcccagagagagtccccaaggggcaaggtgactcgggggcaggggtaggtccttagtaggagagcttaggatatg

SEQ ID NO: 281 - DNA, 177 bp, Homo sapiens
cggacatggcccagctggaggcctgtgtgcgctctatccagctggacgggctggtctggggggcttccaagctggtgcccgtgggctacggtatccggaagctacagattcagtgtgtggtggaggacgacaaggtcgggttcagacttgctgtgaggaggaggatcaccaagtttg

SEQ ID NO: 282 - DNA, 176 bp, Homo sapiens
aggggtggggggaggggttgggttgggctcttatcttcagtggagcttaggaaacgctcccactcccacgggccatcgagggcccagcacggctgagcggctgaaaaaccgtagccatagatcctgtccacctccacttccctctgaccctcaggctttcccagcttcctcccctt

SEQ ID NO: 283 - DNA, 224 bp, Homo sapiens
cggaaggaaccgttacgggaactgaagttgcgggattaaggcctgatcaagatgacaaccctccgaaaaggcaccgaggacttcgtggcagaggcccatgggggagaaggccagttgggagccctggcttggaagtgtgttgaagtccggggcgaagagagctgagaggaaagggggttttggcaaggcgctgtgttgtgccgtgtgcgcggtgtgctggtgtg

SEQ ID NO: 284 - DNA, 146 bp, Homo sapiens
gtccaataccacctccaagccgagtcacttggtggatgcgcacactgccgaagtcaactggcctctcattcaagtccctacagcgaatttattctagccaccgctctgcgggtaagaccgtagctgtgtgggatctggcgtgagcc

SEQ ID NO: 285 - DNA, 183 bp, Homo sapiens
gaccaggagcgttttgataacagttacctctctgcgtgacagtggtccctctccccggacttgcacttgttccttgtttcctctgggttttatagtgatacagtggtgtcccggggccaggctgcgctctgcccagcccagcctacagtccggataaaggtgcggcatcctgctggccctgca

SEQ ID NO: 286 - DNA, 110 bp, Homo sapiens
cttaacatggtcgctgagctagccacggactgatcggagccccttggggcgttgctcggattggcagcgcagcgacctgccagccagcttcatctcccagggcccccatt

SEQ ID NO: 287 - DNA, 129 bp, Homo sapiens
tgaaactctgccaccctgatgtggaagatgttggagactacttgaattgacccctaatccattgtcttgcatccattaggacgtccaataaatgggtttttctgtcaacatttgtagactatgtcgata

SEQ ID NO: 288 - DNA, 315 bp, Homo sapiens
tcgtactacacgacacgtactacgttgtagctcacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgagacatcctatcatctgtaggctcattcatttctcttacagcagtaatattaataattt

SEQ ID NO: 289 - DNA, 181 bp, Homo sapiens
agaagaaccaagttgcattattaatctgccctgtggttttttccttttaacaatcagtttgagctgctgctgttatgagtttctcatcaagatgaaagccctaatatgtaaaggtcaaatccgagtttaaattttgtgcttttataggaaagaatttcttcataggcggggtgatatatca

SEQ ID NO: 290 - DNA, 174 bp, Homo sapiens
cggcacgagcttgtgctaggcaggccaccgctgtgactgggcttccggccctttccactacgttggaagaagaaaacctatttttcaatgtaaataaaatatcttggtagcctctcttggaaaccttgccccgtttaagaaagttggcattgtccctttgaaaggggccaagaa

SEQ ID NO: 291 - DNA, 260 bp, Homo sapiens
gtggagccgccaccaatatgcagatttttgtgatatcccttacggggtagaccatcaccctcgaggtttaaccctcggatacgatagataatgtaaaggccaagatccaggataaggttggtattcctcctgatcagcagagactgatctttgctggcaagcagctggaagatggacgtactttgtctgactacaatattcaataggagtctactcttcatcttgtgttgagacttcgtggtggtgctaagataaggaga

SEQ ID NO: 292 - DNA, 186 bp, Homo sapiens
cttctctggccaaagtctgtgccaaccgcaccaccatcgtagtggcacacaggctctcaactgtggtcaatgctgaccagatcctcgtcatcaaggatggctgcatcgtggagaggggacgacacgaggctcttttgtcccgaggtggggtgtattctgacatgttgcagcttcagcagggacagg

SEQ ID NO: 293 - DNA, 181 bp, Homo sapiens
ctccacaagtatctgaagatgggaaagcccatcctttcaaaatcaacttagaatcagaaccacaggaattcaaacccattggtaccgcgcacaacagaagggcccagccttttgttgcagctgcaaacattgatgacaaaagacaggtagtgagcgcttcctataactcgccaatttggct

SEQ ID NO: 294 - DNA, 102 bp, Homo sapiens
cggaggtggcagccatcttcttctcggcatcatggccgcccttagaccccttgtgtaaggccaagatcgtcaaatagaggaccaaggaggttattccgcaac

SEQ ID NO: 295 - DNA, 118 bp, Homo sapiens
tgaggtttggaaaggaatcaagaaacggcagacagacttagggttgcagacacatatttttttcaggcttggtgacgagaaaatctagagacaatgagggacataaattggccttgca

SEQ ID NO: 296 - DNA, 152 bp, Homo sapiens
ctcgtgccgatttttatagaagctattacaactgataggctagcttcatgggtattgatgatacattgcttaaccatactaacagctgctttccctctcttaattgtaaaaaggtgaatgaaggttcacttgatgtgagacatactatatat

SEQ ID NO: 297 - DNA, 96 bp, Homo sapiens
gagtacttctagagcggccgcgggcccatcgattttcacccgggttgggtaccaggtaagtttacccaattcggcctatagtgctaggcgctattw

SEQ ID NO: 298 - DNA, 116 bp, Homo sapiens
ggcccatgtgcccactgtctcttccacttcgtctaggattgcgcaggcactacctccttacttgagggcacaggatgacttccccaaggaaagaaaccgaatagtgtgagggtgat

SEQ ID NO: 299 - DNA, 172 bp, Homo sapiens
ccaccctgcaccttggtgctccgctctcagaggttggatgcagatcttcgtgaagaccctgacttgtaagaccatcaccctcgaggtggagcccagtgacaacatcgagaagttcaaggcaaagattcacagatatagggagggcatatccttctctatcagacagagggtt

SEQ ID NO: 300 - DNA, 184 bp, Homo sapiens
gcacacgaggaacatgctctctcgcaaaggatcttcttcatccctctttcagaagaggagaagagggaaacacaaggagaaacggctggtgcagagccccaattcctcacttcatgggatgtttaaattcccaggatgctatatacatcaccacgggccttttaggcatgtcacaaacgggtag

SEQ ID NO: 301 - DNA, 212 bp, Homo sapiens
tttatttaaaaatagcagtagtaaaccaagtacacattaacataaatacttttaaaaaacatatttttaaaaactgagaacagcagcattgtttacattttgcaaatctcattgtctggcttaacaaaagtggctgtattctcagagtctacttctgcattcaatccattttgatatgctgttttggctggagtatattacaaactcttacc

SEQ ID NO: 302 - DNA, 570 bp, Homo sapiens
gatcatggcatgtttccactgttatacacagagtagtttcactgccctaaaaatcctctgtgttctgcctgtcatcccttcatctcctctaatcctggcaacattttttctgtctccatagttttacctttgatcttttatatcatatagttgaaattatacagtgtgtagccttttcaaattgacttctttcacttagtaatgtggatttcagtttcctccatgtcttttcatggcttgataatgcatttctttttagagccaaattatgttccatcgtctggatgtttatttattcacctactgaaggactgttggatgcttccttttggcaattatgaggaaagctgttataaatatctgtgcaggctttttgtgtggacataactgaaatatttttaaagttatatttattgaggtataatttacattcagtaatagtcacactttttagtgtagagttctgagttttgacagttgtatctaatcatgcaatcaacaccacaatcaagatgaagaacaggcccctcacttccctaacttctttcctatccctttttagtccttttc

SEQ ID NO: 303 - DNA, 440 bp, Homo sapiens
aagccctttgagtcatggaaataggcaccattctctttggcaatctcttggggagtgtcttctcgagaagacactccccgtttcactgcacttggcccacagtaaggctgtcctggggcccttgaaggcacatttttggtgctgtccaggaggagagcctagaaatcacagggaggttgccattcacttctctaggccaaactaggggaaacacctaactgaggggcttgaacatcacccagatgtccatgcagcgctggcctgtcccctgaggcctgcttacctggcttagtaccatggtcagctcctgggaatcattccctcctggaagatgagacgaccctgtgttcattcagatcgggctcccagcagtgtgcattgtgacgtcttctgggtgtcatcctgctgggcagcctccatgccagtgtctcctgtgttcc

SEQ ID NO: 304 - DNA, 330 bp, Homo sapiens
gcttgacgtacttgcagttaactgtgcaaaattggctggctgcctctgttcctactgtactgtaactttgatcatgtctgttcctgttccattctcccaggagcttctctgcagactgacacaccctcccccaccccgggtagtggagatgctggtgtctgggtagtcatggatttctgctggacatttgaatgtgataaacaatccagcattacttaggaaatgctacatgcggaatgtgcacgtttccaggggcgagtattgtcaatcaaaaggtttgcaatgatttccttcctgccaaaaataaacatgtgaaactgcaaaaaaaaa

SEQ ID NO: 305 - DNA, 250 bp, Homo sapiens
cgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaaaaaaaaaaaaaaaaaaaaaaaaaaaaaaaaaaaaaaaaaaaaaaaaaaaaaaaaaaaaaaaaaaaaa

SEQ ID NO: 306 - DNA, 390 bp, Homo sapiens
tcgtgccgaattcggcacgagccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctctttctagggacaatgtgggcttcaatgtcaagaatgtgtctgtcaaggatgttcgtcgtggcaacgttgctggtgacagcaaaaatgaccaccaatgggagcagcttgcttcactgctcaggtgattatcctgaccatccaggccaaataagcgccgctattcccctctattt

SEQ ID NO: 307 - DNA, 325 bp, Homo sapiens
agaaggccccgtgatacaagaatcagctgaaccaagccagttggaagttccagccacagaagaaataaaagagactgatggaagctctcagatcaagcaagaaccagaccccacgtggtagacctcttccctcctaggcttaaagtatcagtggttgagaagagcttttcggacctgttactacccaagctgtgtaatatacttgtataacagaaataccttctatacaaacctctttttctacttttagatagatatgtctactctttcagcagttctgtgtattaaagagcagagtgactctggcttcgaatagctggtgtac

SEQ ID NO: 308 - DNA, 255 bp, Homo sapiens
gctctcttccaggacatcaagaagccagctgaagatgagtggggtaaaaccccagacgccatgaaagctgccatggccctggagaaaaagctgaaccaggcccttttggatcttcatgccctcggttctgcccgcacggacccccatctctgtgacttcctggagactcacttcctagatgaggagtgtaagcttatcaagaagatagggtgaccacctgaccaacctccacaagctcggtgccccgaggcttgg

SEQ ID NO: 309 - DNA, 110 bp, Homo sapiens
caaaacgaagaagaactgattgggcttccacagccctcctctcccaagaaatccaggctcctctcccaagaaatccaggtcgctttccagacttcaaacggcgatcttac

SEQ ID NO: 310 - DNA, 220 bp, Homo sapiens
ggaagatgaacgggcggaagcagagtctcgcggagctcatcggcactctgaacgcggccaaggtgccggccgacacgaggtggtttgtgctccccctactgcctatatcgacttcggccggcagaagctagatcccaagattgctgtcgctgcgcagaacttctacaaagtgactaatgggggttttactgggagatcagccctggcataatcaaagact

SEQ ID NO: 311 - DNA, 130 bp, Homo sapiens
aaaaaggggaattcaattacacgagatacacgcaatcataaacaatgagccaaagacaaagagtacctaacagaacttagccataaactttcaggtacaatgtacttatccttcttttattcatccagac

SEQ ID NO: 312 - DNA, 119 bp, Homo sapiens
gcaagcattcatttttagctcgctcattttttaccatgttttccagtctgtttaacttctgcagtgccttcactacactgccttacataaaccaaatcacaataaagttcatattcagt

SEQ ID NO: 313 - DNA, 129 bp, Homo sapiens
catcatggacaccagccgtgttgcagcctttcaagctggccagggtcaccaaggtccttggcaggaccggttccttagggacagtgtcacggaggttcgcgtgtggaattctatttggacggcacgggg

SEQ ID NO: 314 - DNA, 116 bp, Homo sapiens
cctgcggctgttggatttgggaatgaccttggtgagagtctcactgctccagggtctctttttggtccaaaggctaggacctatagaagttggatcacatttttttctttcccggt

SEQ ID NO: 315 - DNA, 113 bp, Homo sapiens
ccccgaggtgttacagaaatagatatgaagttgttgcctggacttgcataccggcaagattggcattgggtatatttaaaattcctcctttatatggcctggtttatatttcc

SEQ ID NO: 316 - DNA, 126 bp, Homo sapiens
ctcggtgatttaactggacctccggacccattggcgcagaatatgcacctgttttaggttaccccccagctcacatatgcatgcgagatttgctgagactgggggaaaggataaatccgacgttct

SEQ ID NO: 317 - DNA, 180 bp, Homo sapiens
ctgaccaataactaggtcaatctcaagttgaatgaagagtgaccatcattgcatcttcaccttgagataatagagaagttagatgtcataattgtgctaactatgttttaccatcaatacatcataacctcttttcaatgcattaagtacacaacatgtctgggcacacatgcatcaaca

SEQ ID NO: 318 - DNA, 260 bp, Homo sapiens
actatgcgctgcccctgggccgcaagaagggagccaagctgactcctgaggaagaagagattttaaacaaaaaacgatctaaaaaaattcagaagatatatgatgaaaggtaaagaatgccaaaatcagcagtctcctggaggagcagttccagcagggcaagcttcttgcgtgcatcgctttcaaggccggacagttttggcccaccagatggctattttctagagggcctaaggttggagttctatcttagggaaatc

SEQ ID NO: 319 - DNA, 110 bp, Homo sapiens
tttttagagaatagctttatcttggttcaactctttagttttatttcgaggcgcacacaaaaatatcttgcaagcagaaccttggcaaacaaaagccatgaacacttatt

SEQ ID NO: 320 - DNA, 270 bp, Homo sapiens
gccacgtgttgctcagacagggtgtgctgggcatcaaggtgaagatcatgctgccctgggacccaacctggtaagatttggccctaaggaaggcccctgccctgaccacggtgagcatttgtggaacccaaagatgagatacttcccaccacccccattttaagaacagaagggtggggaagccagagccgcctcccatgcccaccagtcccacagcataacagggtctccttggcagctgtattctggaggctggatgttgctctctta

SEQ ID NO: 321 - DNA, 195 bp, Homo sapiens
gagaaatattctcttaaaatgacctttgttttaatctcattcatgatgttgattttttcaatgtggtgcaatatatacaataaaatttgtcataactattttaagtgtacagttcagtatattacatatgttcataagttgttacaaccatcaccaccatccatcttcagaattattttcatcttatacaattga

SEQ ID NO: 322 - DNA, 210 bp, Homo sapiens
gtcttaaaagtaatctctgccttatctctgccttattgctttggactcaactgccacaccaaaggatattggatatggcttttatactgcctgccaaccagagataaatcaagcaagttttggaggatttaattcctgataacacaaactttgcagaatgggaggaaaatatttgcaacctacctctctgacaaggggtttataacttgg

SEQ ID NO: 323 - DNA, 335 bp, Homo sapiens
gaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccatttcttcgccaggccaggtatcacaagctccgggtggataaggcagctgctgcagcagggccactacaagccaaatcagatgagaaggcggcggttgcaggcaagaagcctgttgtaggtagaaaggaaagaaggctcttttggttttaagagcagaagaagcctcttgttggaaaaaagcagcactaccaggaa

SEQ ID NO: 324 - DNA, 321 bp, Homo sapiens
aggttgtaccttcataaggtggtatggggggttggggtcaggccctgaacatcgtcctacttgagaatctgtcaggggaaaaagtcaaggggagcaggaggaagagccaggagggccagagcagaagaagagatggagtcttaggggccagggtgagccaggggtccagggcctagaggtgcttcctgggggcgggggaattcagccagtgtccccctcccctcttccaccccagctccagccctggtcttgtcttttcatccctcttccccacgacagaagaagttgttgccctcgcaatcgtcatcgtgttcctgtgtc

SEQ ID NO: 325 - DNA, 305 bp, Homo sapiens
gcaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaggtggggcttcaccaagttcaattctgatgaattttgaagacatggtggcttaaaagcggctcatcccagatggctgttggggtcagtacatccccaatcggggccctttggacaagtggcgggccctt

SEQ ID NO: 326 - DNA, 330 bp, Homo sapiens
tttgcttaggcgcagacgggggaagcggagcaaacatgccagtggcccggagctgggtttgttcgcaaaaacttatgtgaccccgcggaggaccctttcgagaaatctcgttctcgaccaagagcctgaagctgatcggcgagtattggctccggaacaaacgtgaggtctggagggtcaaatttaccctggccaagatccccaaggcgcccgggaacttcttacgctttatgagaaggacccacggcgtcttttcgaaggaacgccctcctcggcggctggtcccattggggttctgatgagggcaagatgaagctggattacatcctg

SEQ ID NO: 327 - DNA, 339 bp, Homo sapiens
cgatgacccaaacctgctcagcctggacgcctacgtgttcaacaccgaagcccaccctctgcctatctggacccctgcctagggtgggatggcttgctggtgtggggacttcgggtgggcagaggcaccttgctgggtctgtggcattttccaagggcccacgtagcaccggcaaccgccaagtggcccaggctctgaactggctctgggctcctcctcgtctcttctttaatcaggacaccgtgagacaagtaaggccgtcagtctttgtgttatgcggggtggcttggcccttggagcctccccttgcttcctccagaggcacgaattatgcttacg

SEQ ID NO: 328 - DNA, 231 bp, Homo sapiens
ctgccaggccctccagcaggaggacagagtgccctggggcatccaccttctgcccaggggacgtggcgctgtcggtgtttggaggctgctgccccctggcttttggcgccccatgggccctcagcgtctccccatgctgggctcactacatgggccagcccttgctctaccctggccggtagtggctgggcgcctaggttgtgttgagagggggatgccctggccctgcct

SEQ ID NO: 329 - DNA, 160 bp, Homo sapiens
gtgagaagcttcatttagtgtttaaaaatgtggggagataaatcagacttaacatgtatgtaagatcaatttcacttaaaagtattggtccaaatagcaaaaatagggccaggtgaaacatgtagtcatttttttaaaaacatgtacttgggctttgtgt

SEQ ID NO: 330 - DNA, 138 bp, Homo sapiens
gacatctctggtgttcccaccaccctagatgaaaatccacagcacagacctctaccgtgttttctctttccatccctaaacccacttcccttaaaatgtttggatttgcaaaggcaatttgggggcctgctggagcct

SEQ ID NO: 331 - DNA, 158 bp, Homo sapiens
cggcacgagcgcgagtgggagcaccaggatctcgggctcggaacgagacttcacggatttgtttaagaaaatggcagacaaaccagacatgggggaaaatcgccagcttcgttaaggccaagctgaagaaacggagacgcaggagaagacacctcccg

SEQ ID NO: 332 - DNA, 420 bp, Homo sapiens
aaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaataaaaaaaaaaaaaaaaaaaaaaaaaaaaaaa

SEQ ID NO: 333 - DNA, 290 bp, Homo sapiens
cccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaagaccctgtgcccagcttccatgctgactgatggttaaataatgtgattgtctcctcaaaaaaaaaaaaaaaaaaa

SEQ ID NO: 334 - DNA, 507 bp, Homo sapiens
ctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattgggcatttaagtttagtagtaaaagactggttaatgataacaatgcatcggtaaaaccttcagaagg

SEQ ID NO: 335 - DNA, 149 bp, Homo sapiens
attggattgccacacggctcacattgcatgcaagtttgctgagctgaaggaaagattgatcgccgttctggtaaaaagctggaagatggccctaaattcttgaagtctggtgatgctgccattgttgatatggttcctggcaagcccat

SEQ ID NO: 336 - DNA, 181 bp, Homo sapiens
caagagtgtgaggccagagaactttgagctggtgaagaagttcatcagtcagatcgtgggatacgctgggacgtgtcagacaagctggcccaggtggggctggttgcagtactcaagctctgtgccgccaaggagttcccctgggtcgcttcccacaccaagagggacatcaaggcggcct

SEQ ID NO: 337 - DNA, 161 bp, Homo sapiens
gttacaccaaccaggacagaaatcattatcttagccaccagaacacagaatgttcttggtgagaagggccggcggatttcgggaactgactgctgttagttcagaagaggttttgctttccagagggcagtttagagctttatgctgaaaaggtggccact

SEQ ID NO: 338 - DNA, 104 bp, Homo sapiens
tgtaaatgctgtatagatttggttttcctttctttacttaccctggtttggatttttttttttttttttgaaaatggattttatccttcttttggcaaattaac

SEQ ID NO: 339 - DNA, 194 bp, Homo sapiens
atcgtccaccgcaaatgcttctaaacggactcagcagatgcgtagtttgctgcatgggttaattgagaatagaaatttgcccctggcaaatgcacacacctcatgctagcctcacgaaactggaataagccttcgaaaagaaattgtcctttaagcttgtatctgatatcagcactgggttgtgagaacttgtt

SEQ ID NO: 340 - DNA, 195 bp, Homo sapiens
tttaaaattgattagcatcatatttccatcttattccattaaagtatgcagattatttgcccaaatcttcttcagattcagcatttgttctttgccagtctcattttcatcttcctcccatggttcccagaagcttttgtttcttgggcaagcagaaaaataaattgtaccccttttgtatatgtgagatgttta

SEQ ID NO: 341 - DNA, 190 bp, Homo sapiens
atttcagctatggagatgacaatctggctcccaacactgccaacgtcagatgaccttcctacggctgctgtccacggaaggctcccagaacatcacctaccactgcaagaacagcatttcctatcttgacgagcagctggcaacctcaagaaggccctgctcatccagggctccaatgacgtggagatcc

SEQ ID NO: 342 - DNA, 170 bp, Homo sapiens
gaaataccaccggaactggtcgaatgaggcacctaaaaattgtataccgcagattcaggcatgggattccgtgaagggaacaacacctaaacccaagagggcagcttttgcagcatccgttcatcttaagattgtcaacgtttagtcatgcaataaatgttctggtttta

SEQ ID NO: 343 - DNA, 121 bp, Homo sapiens
tcatggcacccaagtcaaaggcacatggcaagaaggtgctgacttcttggagatgccataaagcacctggattgatctcaaagggcacctttgcccagctgagtgaactgcaacttgtgac

SEQ ID NO: 344 - DNA, 100 bp, Homo sapiens
aatattctggtattattacaatgcagaatttttagtattctagctttcaaaattagtaagtcttttactgaattgtgacatttacataatgaattctatt

SEQ ID NO: 345 - DNA, 152 bp, Homo sapiens
ctgcttcgtgtttcaggacatcaagcagcctatggagagatccagttgtccaggaactgtttgtagcctcctaccaaatgccacggagtgaggtcaattttggaagtaggaacctccaaccttggtcaagcctttagctgtactacaaactt

SEQ ID NO: 346 - DNA, 100 bp, Homo sapiens
gacaccacggaggagtgatctgggctcttgcctccacctgagcctttacccttagagagcttagaccctatttaaacctacctccaatacccaaccaaat

SEQ ID NO: 347 - DNA, 270 bp, Homo sapiens
tccaggactccgaggaccaaagggccagcaaggtgaaccgggtccaaagggaccagatggccctcggggtggaaattggtctgccaggacctcagggtccacctggacctcaaggaccaagtggtctgtccattcaaggaatgcccggaatgccaggagaaaaaggagagaaaggagatactggccttccaggtccacagggtatcccaggaggcgttggttcaccaggacggtgatggctcaccaggccagaagggccttcccggaaag

SEQ ID NO: 348 - DNA, 275 bp, Homo sapiens
cggcacgaggcaggacatgcctccgccggggggctatgggcccatcgactacaaacggaacttgcccgcgtcgaggactgtcgggctacagcatgctggccatagggattggaaccctgatctacgggcactggagcataatgaagtggaaccctgagcgcaggcgcctacaaatcgaggacttcgaggctcgcatcggcttgttgccactgttacaggcagaacccacccgaggcccttcagatgcttcgggagaacctggaggaggagcccat

SEQ ID NO: 349 - DNA, 145 bp, Homo sapiens
gtcctatgaaggggtgtggggtgaggtagtgaaaagggcggtagttggtggtggaaccagaaacggacgccggtgcttggaggggttcttaaattatatttaaaaaagtaacttttttgtataaataaaagaaaatggggcgtga

SEQ ID NO: 350 - DNA, 240 bp, Homo sapiens
gggactacaggtgcacaccaccatgcccagctaaccacagaaactttcatctcttcattttttcctttgggcaccatttaatacctaaggacaggtagaaagggtcccagaaagacaccattggtaatggccgattgccggctgcagtcatcgcccccagatcaggctggtacaggatgccttaaggtgatgagaggtaagggtgcattgagaatattgagcacagggagggagaagcag

SEQ ID NO: 351 - DNA, 280 bp, Homo sapiens
gcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagaccaccttgctcataaacaaaatgccatgttggtcctctcccctggcctgtgacatctggactatttctgtttt

SEQ ID NO: 352 - DNA, 235 bp, Homo sapiens
agtctcggtttttttcgttgttgttgttgttgtttttctttttctttttttttttgaggacagcaattaaccacagtacatattactgtagttctctataggtttacatacattcataccataactctgttctctcctcttttttggttttcaactttaaaaacaaaaataaacggtgataatctttactggtgaaaagggtgggaaaataaatcaaccaattgcaccagtttgt

SEQ ID NO: 353 - DNA, 102 bp, Homo sapiens
taaaaactgactttctgtatttatgatagatatgaccatttttggtgttgagtagattgttgcattggaaatgaactgaagcagtatggtagatttaaaagg

SEQ ID NO: 354 - DNA, 190 bp, Homo sapiens
gccatgagcagcaaagtctctcgcgacaccctgtacgaggcggtgcgggaagtctgcacgggaaccagcgcaagcccgcaagttcctggagacggtggagttgcagatcagcttgaagaactatgatccccagaagggacaagcgcttctcgggcacctcagcttaagtccactccccccctaagttctc

SEQ ID NO: 355 - DNA, 295 bp, Homo sapiens
gccagaggatgtcagctgccaattgtgttttcctgcagcaattcataacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaacctcaaatctggtgggatctctgcgggcttgtgccactgagcatatttgtggagggtggacaagcttgctccac

SEQ ID NO: 356 - DNA, 150 bp, Homo sapiens
ctaaaacatatatattgagaaaaactaaatgtacatgaccagagctgaggcgagtggatcacttgatcccatgaggcggaggttacagtgagccaggatcccaccattgttttccaacctgggttacaaggagtgaaactctgtcttcaa

SEQ ID NO: 357 - DNA, 102 bp, Homo sapiens
cccatgggagtagagcccgagatacctgggccactatgtccagttctgacctcgaaatacccctaaccccgaggcccatgcaggtctggggaacatagaccg

SEQ ID NO: 358 - DNA, 107 bp, Homo sapiens
ggaaatcgtccgtgcattaaggagaggctgtcctacgtggccctgggactttcgagcaggagattggcaacgcttgctttccagcttcctccttggggaaggagcta

SEQ ID NO: 359 - DNA, 102 bp, Homo sapiens
tcctttgacctggatgccagcggctggcatccatggccacgctgctggcccggctggcgtctcttcctgtgacctggctaaggaggccttcctggcggtctc

SEQ ID NO: 360 - DNA, 107 bp, Homo sapiens
ccggcacgagctaagttttcatttgtagtacccaattacacaaaaaggttcccttttagggaaattaaaggaattcaggtgttatatatccataaccatttttacac

SEQ ID NO: 361 - DNA, 107 bp, Homo sapiens
gacagacttgaagatttcagatctataaatactgaggtggtagcatgctctgttgattcacagtttaccaatttggcctggataatacccctcgaggacaagaagga

SEQ ID NO: 362 - DNA, 107 bp, Homo sapiens
ctgccagggccagacccaggtggggacagcctgaaccctgcttccccctgtggccggacatgccccgatctttacacacattggtgaccctagagagagagaggaag

SEQ ID NO: 363 - DNA, 158 bp, Homo sapiens
aaggagcttgccatgcccggggaggacctgaagttcaacctaatcttgccggcacaaattgattctaagagaaagggccagcgtttaaccctccgagatgcaacccgacttattggaaccggtctagtaaccacaacgttggcaatgactaaaggagg

SEQ ID NO: 364 - DNA, 189 bp, Homo sapiens
acgtctgaggttatcaataagctcctagtccagacgccatgggtcatttcacagaggaggacaaggctactatcacaagcctgttggggcaaggtgaatttttgaagatccttggaggagaaacccctcggaaggctcctggttgtcttccccattgccccagaggttcctttacagattctgcaacct

SEQ ID NO: 365 - DNA, 150 bp, Homo sapiens
tacaggcagagcaggaactactgttagtcaatccctagtactcccagcaggcagagctccttaggtccggccaggactttttttcctaaatggtcttttttttaacacctttattttaacacaattgattaaatgaaggtattggaggta

SEQ ID NO: 366 - DNA, 100 bp, Homo sapiens
cgctgagctgcgattagatatgaggaggaatgctcgtacttgtgatacaagacctgctcaatgttagatggccttgaatttagattgcacctacaggagt

SEQ ID NO: 367 - DNA, 190 bp, Homo sapiens
ctgaccaacatggagaaccctgtctgtactaaaaatacaaaattagcaggtgtggtggcacatgcctgttaattcccagcttacttggggaggcttgaggcagggggactcttctggaaccttgggaggcagaggtttacagttagctgagattcgcgccatttcacttccagccttggcaacaaaagcg

SEQ ID NO: 368 - DNA, 160 bp, Homo sapiens
gtcttgagtttttttttaggagacgcggtcgtaaggctgaggattttgtcgcacgctccttcttctgactaacccctgttcgcctcttgccgaggaacaaatcggtcaagaagcccccgcgcaacaaccattgctttttagggctacccgaaaaacaccc

SEQ ID NO: 369 - DNA, 175 bp, Homo sapiens
cgcgggttcgagcccggtgtcgggcggcgtgaacttgttcgcaacgacggcagcttcctggagctgttcaagcggaagatggaggaggagcagcggcaggccaaggaggagccgcccccgggtccgcagacgaccccaacaatcggccgccgcgcttgccccggggattccaaga

SEQ ID NO: 370 - DNA, 450 bp, Homo sapiens
atgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggtttctcttggttgtagagtggcccagaattgcattctgaatgaataaagggtaaaaaaaaaaaaaaaaaaaaaaaaaaa

SEQ ID NO: 371 - DNA, 508 bp, Homo sapiens
ggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggttttggca

SEQ ID NO: 372 - DNA, 430 bp, Homo sapiens
cggcacgagctaagttttcatttgagtacccaaatacacaaaaggtgtccctttaaggaaaataaagaattaagttttaaataacattacattttacaatctgacatctggagtatattgaacataggctatttcttgatataacactcatttaattgtggccatccaaatgaatattattgcagaatttatcttgttcataatgatttgtaaatggtgttatagctgaatacctgtgcatgaaaatgggcaatattttcatctgtttacttgtagtgccatagaggccaatatgcacaatattaactaatgccaagacatggctgtttaaaaaatttaatgttcaaacagttatcactgatgcttttgcactatttattaataaaatcatatattggtgtaaaaaaaaaaaaaaaaaaaaaaaaaaaaa

SEQ ID NO: 373 - DNA, 250 bp, Homo sapiens
tcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaagtaaaaaaaaaaaaaaaaaaaaaaaaaaaaaaaaaaaaaaaaaaaaaaaaa

SEQ ID NO: 374 - DNA, 542 bp, Homo sapiens
gtcctctgcaatcgtagatttcacactttttaaaactacccatgatacctctgcaaacaaatgactccccccattgcattcccgtattacccaataaaacgtcttacgacggctgaagactttttcttacaagaaataaacaaaaacgtctgacagcatagtagatgagttccatgcccaagtgctactcaattgcctgagcttgaattgaattgtgtgacttaaacgcgctctggtacaatctctgggtgccctctgaacttcaggctcttgctgtaacagtagtctgtcttgcactagagttgtttatatgtttgtctttctctttcactagattgtaagtgcaacagagcccaagacctagtcttgttcctgtttgtacatgctatagcacctaacaaggaatgtatgatgtttgttgtttcattgaatttgtgaaatataaataatagtatctattccgatcctcatgtcctcttccccacctcatcttccaatcccttgctcataaaacatgtttataaaaaaaacatccttccata

SEQ ID NO: 375 - DNA, 253 bp, Homo sapiens
cggcacgagtgttatcagcttgtactggtctcataactctggttttggaagaataatttggaaattgttgctgtgttctgtgaaaataacctccccaaaataattagtaactggttgttctacttggtaatttgacaccctgttaataacgcaattatttctgtgttcttaaacagtataaatagttgtaagtttgcatgcatgatggaaaaataaaaacctgtatctctgttaaaaaaaaaaaaaaaaaaaa

SEQ ID NO: 376 - DNA, 440 bp, Homo sapiens
cagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttggcaaatttttctgaatgtgacctttttttgctgatttgctgggtttgggattaactagcattattttgccacctttatattgtatttataaaaaaaaagtactatcaatcaatcatactactttggattgttgtgctggtgtaatgtggatttaacatcaataaatatttgacaaataataaaaaaaaaaaaaaaaaaaaaaaaaaaaaaaaaaaaaaaaaaaaaaaaaaaaa

SEQ ID NO: 377 - DNA, 414 bp, Homo sapiens
ttaacatggtgctgagctagccaggactgatggagcccctgggggtgtgggatggaggagggtctgcagccagttcattcccagggccccatcttgatgggccaagggctaaacatgcatgtgtcagtggctttggagcaggttaggctggggctcatcgagggtctcaggccgaggccactgcggtgccagtgcccccctgaggactagggcaggcagctgggggcacttggttccatggagcctggataaacagtgctttggaggctctggacagctgtgtggtgtttgtgtcttaactatgcactgggcccttgtctgcgtcggcttgcatacagagggcccctggggtttggccctccggcctggcctcagcagtgggatggacagggccaggcaggcctctgaacttcc

SEQ ID NO: 378 - DNA, 444 bp, Homo sapiens
atcacttcaagctacagcaatttgagctgttttgtcatttgttacataaagcaggtgataatgatctgttgccagtgattttgacttgtgtctctgggaaaacaaacaaacaaagaaagaaacaagaaagaagctctactgcgtttataaagctgtactccaaagtgattttaaaataattccaggacagtattcatggtagatgatatatattctttaacaaaaaaaattaaatattaggtagctttatggagagttgacatttttaaaacaagtaaagcaattcaccaagactgagccggccaggcatggtggctcatgcctgtaatcccagcactttgggaggctgaggcgggtggatcatgaggtcaagagattgaggccatcctggccaacgtggtgaaaccccatctctactaaaaatacaaaaaaaaaaaaaaaaaa

SEQ ID NO: 379 - DNA, 636 bp, Homo sapiens
gaggaggacaccgatgtcccagcagaaggcggcatgagaccaacgtgggagccagaagagagaggttcctggctggcccaggtctagtcccttagtcacacacgtcaaagttcatcactagggtgttagtgaagaggaaatgggaccaggcgcggtggcttacgcctgtaatctcagcactttgggagatcgaggcgggtggatcacttgaggccatgagttcaagaccagcctggccaatatggcaaaaccctgtctctacaaaaaacacaaaaaaattagctgagcatggtggtacatgcctgtaatcccagctacttgggaggctgaggcacaagaatcatttgaacctgggaggtggaggtggcagtgagccaggattgcaccaccgcactccagcctgggcagcagagcaagactccgtctcaaaaaaaaggaaatggaccctgacaccagaactgactttggatcctttactaaaatcaatgcttctcgatttttaatgaaaaaacaaacaaacaaaaccacgtggggattttattaaagtataggctctgagtcatcaaagttcccaggggatgctgatgttgctggacctcggagcacacagagagaagcacgttttggagtatgaat

SEQ ID NO: 380 - DNA, 599 bp, Homo sapiens
ctcgtgccgaattcggcacgagctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatgggccccaataaaggcaagctgcctctgctccctctgaaaaaaaaaaaaaaaaaaaaaaaaaaaaaaaaaaaaaaaaaaaaaaaaaaaaaaaaaaaaaaaaaaaaaaa

SEQ ID NO: 381 - DNA, 550 bp, Homo sapiens
tgacagtcgcagtgccatggaggagcccagcagctccgaggctcccgccaagaatggggcaggctccctgagaagccggcatctgcccaacagcaacaacaactccagcagctggttgaacgtgaaggggcccctctccccgttcaacagccgggcagcggcagggcctgcacaccacaagctcagctacctgggccgagtggtgcgggagatcgtggagacagagcgcatgtacgtacaggacctgcgcagcatcgtggaggactacctcttgaagatcattgacacacccgggctgctgaagccagaacaggtcagcgccctctttgggaacatagaaaatatctacgcgctgaacagccagatggaggagcccatccccaggagactcaagcagtggcctggagaggctttgttctgtaacggtgccttttcttagggtccaggcaggaatgaagccaataatttattgctttccaaaaaaaaaaaaaaaaaaaaaaaaaaaaaaaaaaaaaaaaaaaaaaaaaaaaaaaaaaaaaaaaaaaaaaaa

SEQ ID NO: 382 - DNA, 608 bp, Homo sapiens
agcatcttggagagttttgtggggtgctggcatccatcaaccaacaaaataccaaaatgactctaggtaattataagtgaagcaaaaccactgggcagggatgataacaggcactgtacttaacaggagtcagcgtatcacaatgctgctcggactatgttcagacactaaactctaagtgtcatgagggcagggactccctctatcttctcaccattgtagcattgctagcacaatgcccacacacagaagataatgatatatttatcaaacaaatggatgctgttcaaaataaaaatatagctctcttgaaaaacaattctccctgcaagaacttcctcttcttactgtttcttttctcaatttttttgcttcctacttccaccaacccctcttgcagagactgctccattccagtaaaaggtgaaggttcaactggagacctccaaagtcggctgggcctagggtttgggtaggcaattgctggaagagcacagagagggaaagatttcaggcagtggtgataagaaaaggcccacctgggtcaggtgtggtggctcacgcctgtaatcccagcactttgggaggccgaggtgggcggatcacga

SEQ ID NO: 383 - DNA, 253 bp, Homo sapiens
gaacaattcatacagaggggctaacaagccaaaccagcagccttcagtgggagggaacttggaaagttggaatgttcaaggaaaatgacaaaatacaagtttacaaaaattgttttttcaaaaaatgctcaaatggccaggcacagtggctcatgcctgtattcccaacacttgggaggctgaggtgggtggatcacttgagtctaggagttcgagaccagcctgggtgacgtggcaaaaaaaaaaaaaaaaa

SEQ ID NO: 384 - DNA, 615 bp, Homo sapiens
gtgaccaggtgtcagctgtgacgtattatcattgcctgcacctgtgcaactttgatgttattggcatggcgtgactggttagctgtactccctggcttttcagttaataaataatttaaggacattttgagaaagaagcatgaatcctggctgttgtctgaaaacttttcattgatggattctcataagatccagattgtatccccattaacacatccagttaatggtgtcagtgacttgcagagaaatctgagacattagtggaatgaaatacagttttaaaagatacttttctctctaaaattcctgcttgcacataggagagtgtcatgtggaaaaatgtatgcattaatgactgagtgaaaagtgattcagaagtttcttctgtacaaaagggaatatgttaattcattttgcttccatttctttgccatatatacatagtattttctctttctcaatagtacataattaaattacatcactgacatcctagcatcagtgaaatatggtatctacttttcaatatgtagattttttgcagctaagacattttaattttctaaaaaatatattaattttggctctgaaaaatcagagtgaagtcttgcggta

SEQ ID NO: 385 - DNA, 540 bp, Homo sapiens
ctgtctcacaagaacttcactcaaccccgtgccaggactcagcagtggcctggacaacagcctcagcttcctctacccatcttcttttcttaaagcaggctatgtgccctacatggcaaggcaccatgactgcccatcgagatgccaagaagggctatggaactatgcaggtggctagtggtcagactgaagtcaccagctgaataccttaaggaggactcttgaggctcataatggagttcctggggcacagggattagttatgagcattaaagttcctaagacccagtgacagtactgggagaaaccaaggctgaagagtcaggttgaagcacaggcttttgttttttgttgtttttgttttttgagacagagtctcattctgtcacccaggctggagtgcagtggcgcaatcttggctcactgcaacctccgactcccaggttcaagcaattctcctgcctcggcctcctttagtaggtgggattacaggtgcataccaccacacctttctaatttttgcatttttagtagagatgg

SEQ ID NO: 386 - DNA, 270 bp, Homo sapiens
  misc_feature 107: n = A,T,C or G
gcttggttcatggacaggtaaatatgttattcagtcttgtcattattgtgatttttttcagtcaatatttggataggggataaaagatttggataaaacttaatggngtatagatccattaagttttcttcctagataaaagtctcagtccaggctggacattgtggctcacgcctgtaattccagcactttgggaggccgaagtggctggattacctgaggtcaggagttcgagaccagcctggtcaacatggtgaaacctcatctcct

SEQ ID NO: 387 - DNA, 322 bp, Homo sapiens
ggctttaaaaaaatcagctttctgatttatattctgtggaaatgaggcttgtttgtttcaggttattctataatgtcttttggtgtggctgaagctgctgaggccatggggggagatttgtaaacaaggatttaaaaagtatgtttatttaatctaattgaatttggccaaaggacttaaatgcaggaattgagtggccaaagctttgtttttgggtcacttgctcttaataactaaaaataaataaatgcatgtcatatttgtcactggttgtcaccgtgttgtgaaaatatggcacattgtaattggtccaatgaagttt

SEQ ID NO: 388 - DNA, 313 bp, Homo sapiens
caggtgcccacctttcagggagtctcccagcatgggcggatccgggcatgagctgctgtaaactatttgtggctgtgctgcttgagtgacgtctctgtcgtgtgggtgccaagtgcttgtgtagaactgtgttctgagcccctgttctggacacaactgtgtcctgtgagtgtatcgctactgtgagcgttccggcctagcagggcatgtcttaggtgcagctgtgcacgggtcagctgagcacagtccagaaccagctctcggtgtctgggccacatccgcccactgggctgaccccctcctccatgtcgat

SEQ ID NO: 389 - DNA, 131 bp, Homo sapiens
gcggggcacccagtctgcgtgtacacgagggatgaggtgacgggtgaagctgccctgcgggcgaccgacgctgcagttgtttggcctgaccgtggggcagcgcaccatcaggtttgtcatgaggtgctacg

SEQ ID NO: 390 - DNA, 106 bp, Homo sapiens
ctcgtccgcgccgcttggccttcatgtctctttcgagcagcggacgccggtctctgttccgcagaatgggggcttttttaaagattgtttaagaataaggcctact

SEQ ID NO: 391 - DNA, 102 bp, Homo sapiens
ccttatcaaggacggcaagctgtatcaagaacaatgtctccactgactatgatctatcttacaagagcatcaaccctctgtggtgggctgtgtccactgatg

SEQ ID NO: 392 - DNA, 121 bp, Homo sapiens
gcatatagttcagacatgatgctagttgacactctgtgttataggcgtataatgatgtctctcatctttgcccattagacaatcaacaatattgtaggtggtccaggaccaagatgccagt

SEQ ID NO: 393 - DNA, 157 bp, Homo sapiens
gcctattctctaagaatcagattggagataaagaaaagctgggaggtaactttctctgaagataaggagaccatggaaaaagctgtagaagaaaagattgaatggctggaaagcacccaagatgctgacattgaagacttcaaagctaagtagaggg

SEQ ID NO: 394 - DNA, 104 bp, Homo sapiens
ggaggccgctgagggcctgctgcaggaggcgctagacaaggatagtcgctacccagagacgctggtcaacctcattgtgtcctgtcccagcaccttgggcaagc

SEQ ID NO: 395 - DNA, 146 bp, Homo sapiens
atttcattcccctcatcttcaaacatcattattattcttgaccagacctgaatctaagttaccatccccttggaaattctggagaaggagtctcatgcaccacctatcacactccctcacatcctgtttctggactttggattgga

SEQ ID NO: 396 - DNA, 110 bp, Homo sapiens
caacttcccaatacactcggctaattctaaagtactctctatacaaactgattccgacccagtctacttcccagatgtcggaccaccacacctctgacatcttctaacgg

SEQ ID NO: 397 - DNA, 165 bp, Homo sapiens
agagtttcgccatggcccggcccaagaagcacttaaagcgtgttgcagccctcagacattgggattctttgacaaactaacggggtgtattttgacctcggtccatcggacaggtccccacaagctgaggggatgtcttcctctagatcggcttcctcaaggatt

SEQ ID NO: 398 - DNA, 212 bp, Homo sapiens
ggtctaacaacagtgacttcaaggcctgttgaagccaccaattctggggcaaacaatccttacccagtggatgatgttccctctagaaattgataaccttgtgaagtggtggtttcccctccagttgccaaaatggccatatcctcaagctccttctggccccacattctactccaaaacatttccaattttaggctcaggttggggacaca

SEQ ID NO: 399 - DNA, 165 bp, Homo sapiens
tacccgaccctgcagccgcagaaatgttgatgcctaagaagaaccggattgccatttatgaactccttttttaaggagggagtcatgttggccaaaaaggatgtccacatacctaagcacccggagctggcaacaaaatatgcccaaccttcatgtcatgaaggc

SEQ ID NO: 400 - DNA, 145 bp, Homo sapiens
actgacacagctgagcttgttatccatctccccaaactttctctttcttggacttctggcatgcccactcccaggccctattcctctatggggacagctggctaggacccctctgccttcctcccaatcctgactggctcctagg

SEQ ID NO: 401 - DNA, 134 bp, Homo sapiens
ttggagctcatctgcaatgtagggccggtggcctcctccaccagcttggtgctgcaccagcaggaggtcctgccccctccactgttgctgctccagctggaggagaggaaagtgggagcaaagaaagaggatcc

SEQ ID NO: 402 - DNA, 117 bp, Homo sapiens
cctcttcctactgccaggtcgatcagtggctttcctggacctcccagctttagagtctttctatcacctctgcaccagcctctaggaaggaggatgggcatagtggagaccaccaag

SEQ ID NO: 403 - DNA, 104 bp, Homo sapiens
tgaacagtcgcagtgccatggaggagcccagcagctccgaggctcccgccaagaatggggcaggctccctagagaggccggcatctgcccaacagcaacacaca

SEQ ID NO: 404 - DNA, 135 bp, Homo sapiens
ctgaactggcagactgcaaataaatctcggggtcctattattattgtctcctgtaagacctccgggtcaaggcagaggcaggaactaactggtgtgagtcaaatgcccctgagtgactgcccccagcccaggcca

SEQ ID NO: 405 - DNA, 144 bp, Homo sapiens
agctggtgcgctccggacatctctgactaatatgctgtgtctgtgcagcacctgatctaaactgagagtgcttcgagtcgagcgagtgctctgacgctagagctcgtgctgaacctggcaagcagcacaacctgtgcttcactt

SEQ ID NO: 406 - DNA, 124 bp, Homo sapiens
attaagatcacttgtgttgaggctgtggggtaatgagcactcagcctttggggtacctgttcctaaagtgggccaaaagagccctccctacaatgatgccccagtttttgctttattcctattt

SEQ ID NO: 407 - DNA, 148 bp, Homo sapiens
tggtcctgtttgtttcttggctaagattagacaagacatatcaatcacagaaatataccttggtgccaccaacccattttgtgccacatgcaagttttgaataaggatggtatagaaaacaacgctgcatatacaggtaccatttagg

SEQ ID NO: 408 - DNA, 123 bp, Homo sapiens
gtaggaccatggtcatcctgtcatctgtcactgctggatgacatcctccctgttagatggacctcagggggaggggagtcttccacacgtcyctttggggagagggatctccccagcccccag

SEQ ID NO: 409 - DNA, 186 bp, Homo sapiens
ttcagactcctagtccagagctctcagcaatcctcatcttgtaatgctgtctacagactccaagtatgcaatgggccaagccacaccctctccctcttcctcctgccccaagggcagagattcatggaaggttgtctgtttatgaggaatggagtcgttgccccggcccaaatcgcacccaggcct

SEQ ID NO: 410 - DNA, 302 bp, Homo sapiens
  misc_feature 280: n = A,T,C or G
tttattctagggatgaaggttatgctgggtaatcatacaaaaccttgtattgaaataagttgaggatcttataaaaggaaaaaactgattcaacaggtttaaagcattttctgcatttcagaaaaaaaataaaagctgtaatttacaagccagccaatgaatctgcttacctgattgtgtttgtgcagacatactttaaaaactggcaatagtaaagccatgttacgagccttaaggacattgaagtcgttaaggtccctgagaatggctataacacatncttagtgatgggaacatttcta

SEQ ID NO: 411 - DNA, 136 bp, Homo sapiens
gggcggactgcttaatcccaggcgtttcgagaccatcctaggcaacgtggcaaaaccccatctctacaaaaaatagaaaaattcgccgggcatggtggctcacgcatgtaattccagcactcttggaggccgaggc

SEQ ID NO: 412 - DNA, 120 bp, Homo sapiens
gtttgagccaactttaagactgcttcctattagacataataacatacagttaaggccacaattcgaatcctactcttcagacgaccggccatgactaggagcacacatttgtcccttgat

SEQ ID NO: 413 - DNA, 290 bp, Homo sapiens
tggtggccctgctgggaagcccaactgctgggggagacgtttctgccaccctgggtgatgagcagcttttcccccctggctttctgggggaggagttggcctccttagggagacaggtgacccttggtgccacccctgccccgtgtgtcccccgggtgttctcagtggttgctgaaggcaggtagagggtgctgtccagtatccccccatgtaaaggtcacttcccttctcatggagtcagctgagcatcactcagcccttccatgtcccactcaccttcctcgtctcct

SEQ ID NO: 414 - DNA, 219 bp, Homo sapiens
gctgatgcagctgtacagtgcgcgccagcggcggcttgaacccggggcctgcgcgggaagagcacttccctgctgaagcgcctgccaaaggccaagaaggaggcgccgcccatggagaagccggaagttgtgaagacgcacctcggacatgatcatcctacccagatggtggcagcatggtgggcgtctacaacgccaagaccttcaaccaggtggaga

SEQ ID NO: 415 - DNA, 294 bp, Homo sapiens
gtccgttttccggcaggggggaagggtgtagaagagaagaagaaggaggttcctgctgtcccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagacctgaaattcgaatggcgaggatggcaagaaaagctggcaacttctatgtacctcagacccaaattggcgtttgtcat

SEQ ID NO: 416 - DNA, 295 bp, Homo sapiens
ggcgcgtccggggcctgaaggaggacctgggcgcgtgtctgctgcagtcggactgtgtggtccaggaaggaaaatcacctcggcagtgtttgaaggaaggatactgcaactctttgaagtacgcattttttgagtgtaaaagatcagtgttggataacagggcaagattcagaggaagaaaaggatattgatgcattatgttgaagccaacatggaaaacaacaaatattttccctggtcattaacacaaaggagccaacacaggaaacatactttttactacatctgtttggtt

SEQ ID NO: 417 - DNA, 287 bp, Homo sapiens
agcagctccatttctggagtctgggtcttccgaggccaggagcttgcctttccgctgagtccagattggcaggtggactacgagtcatacacatggcggaaactggatcctggcagctaggagacccagacgctggttcgagagtacttttcctgggagggggccttccagcatgtgggcaaagcttcaatcagggcaagatcttcaagtgaacatctcttgccatcacctagctgcctgcacctgcccttcagggagatgggggtcattaaaggaaactgaacatt

SEQ ID NO: 418 - DNA, 359 bp, Homo sapiens
atcttgacattaaaagttctggctaactttggaatccattagagaaaatcttgtcaccagattcattacaattcaaatcgaagagttgtgaactgttatcccattgataagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtctcaataaa

SEQ ID NO: 419 - DNA, 214 bp, Homo sapiens
caccatcgtgtgcaacagcaaggacggcggggcctgggtggaccgagcagcgggaggctgtcttttcccttccagcctggaagtgttgcagaggtgtgcatcaccttcgaccaggccaacctgtaccgtcaagctgccagatggatacgaattcagttccccaaccgcctcaacctggaggccatcaactacatgggcagctggacgggtgact

SEQ ID NO: 420 - DNA, 200 bp, Homo sapiens
aaaaccaccaagactcccgctgcccatcatcgatgtggccccttgacgttggtgcccagaccaggaattcggcttcgacgttggccctgtctgcttcctgtaaactccctccatcccaacctggctcctcccacccaaccaactttcccccaacccggaaacagacaagcaacccaaactgaaccccaacaaaaggccaa

SEQ ID NO: 421 - DNA, 115 bp, Homo sapiens
gttcagtaaccgagatcacacaattgcactccagcctgggtgacagagcagactctgtctcaggaaaaaaaaaaagttctaggagagttttttaccacaacgatgtgaacagttg

SEQ ID NO: 422 - DNA, 205 bp, Homo sapiens
atactggccacacccctgatcaggtacgactgctgtggacagacccacgaaatgtgggctggcgggacaagacctcctatcgctggcagcttctgcaccggcctcaagttggctacattcgggtgaagctctatgagggaccccagcttgtggcggattctggggtgatcattgacacatccatgccaggggggcgtcttggtgt

SEQ ID NO: 423 - DNA, 262 bp, Homo sapiens
ccagggtcagagacagggcttggttctgcttcctggtgaagcatggcttcggggtgctgcctctccctccctgtttgaatctgcagattgtgttaggcccccagctgagggcctggagtggtgggattggtcccagtgcctggcgcacattggcctgcagagtagattaactgaatgaccaaagagcaacaaaagtctagtgattcttgtctttgaggttctgactggtgttttacaactgagtccaaggcttttcccttct

SEQ ID NO: 424 - DNA, 591 bp, Homo sapiens
gaaatatcagtttcagaaatgaatgaaaagttgacaactctgtgttataggaagtataatgatgtctctgatctttgcaaattagaaaataaacaatattgtaggtggtccaagaaccaagatgacagttttacaatttgcaggaaacttacatatcctttagaaactctttgcaatagtccaaatagaagtacaaatacattgaaagaaatgccttggggacatatcaataacaacgtaacacagagctattctattggttatgaaggtagctatgatgcctctgctgatctctttgatgatattgctaaagaaatggacattgcaactgagattaccaaaaaatcacaggatattttgttaaaatggggaacatctttggcagaaagtcacccttcagagtctgatttttcactgagatcactttctgaagacttcatccagccttcacaaaaattatccttgcaaagcctatctgactctaggcattcaagaacatgctctccaacacctcattttcaatcagattcagaatataattttgaaaatagtcaagactttgttccatgttcacagtcaactccaatttca

SEQ ID NO: 425 - DNA, 520 bp, Homo sapiens
gcagcgtgggcgccatgagcagctcgggactgaattcggagaaggtagctgctctgatacagaaactgaattccgacccccagttcgtacttgcccagaatgtcgggaccacccacgacctgctggacatctgtctgaagcgggccacggtgcagcgcgcgcagcatgtgttccagcacgccgtgccccaggagggcaagccaatcaccaaccagaagagctcagggcgatgctggatcttttcttgtctgaatgttatgaggcttccattcatgaaaaagttaaatattgaagaatttgagtttagccaatcttacctgtttttttgggacaaggttgaacgctgttatttcttcttgagtgcttttgtggacacagcccagagaaaggagcctgaggatgggaggctggtgcagtttttgcttatgaaccctgcaaatgatggtggccaatgggatatgcttgttaatattgttgaaaaatatggtgttatccctaagaaatgcttccctgaatctta

SEQ ID NO: 426 - DNA, 304 bp, Homo sapiens
ccctgcttcccctcactgcccaggtcgatcaagtggcttttcctgggacctgcccagctttgagaatctcttctcatccaccctctggcacccagcctctgagggaaggagggatggggcatagtgggagacccagccaagactgagggtaagggcaggtaggcgtaaggctgtggcaatttccggaaggtttgggtttggttttttttaaaccgggcaatattgtgtccagtccaggctgtgaaaaaaattatataccaaggttttcaattaaaattcagtgcctacctgaaaaaaaaaaaaa

SEQ ID NO: 427 - DNA, 284 bp, Homo sapiens
cactggctcgaaaaaaaaaaagcaatataaattggctctgatttatgctacagaggaaagggttggggcgctctgtgggcctgtgataggaaggtttgccaattggagttcgtaggcaaagaggaaggaaggagcattccaggcagatggagtagcaagtcagaaggagcatggggcaggctgggttggtggacacagagcaggccactcgggaacttgtagttcatggtaaggagattttttttttttttgaaatggatttttgccctgtcacccaggctgga

SEQ ID NO: 428 - DNA, 162 bp, Homo sapiens
aagcattcaaatgaggaattctgagtgcatctccaagatccacctgcacttcctcattcagcccctttataactaatgtttgtgccagaggccttctcgagtctttggccataggtgtttggcatttagtgaccttcgagagctcaaaacaatgatctaagg

SEQ ID NO: 429 - DNA, 104 bp, Homo sapiens
gaaaaaagagacacatgagagtggcttttagtgggtttctttcctccctattccggggcccgtacgacttctttctttggaactgccaacgtgtgttcttggta

SEQ ID NO: 430 - DNA, 114 bp, Homo sapiens
ttttctgtgaatagaacattaaaacatttggtattacactttataagatttctgtgatttcacttttaatataatagcataatcttctactaataaggatatactgttaattat

SEQ ID NO: 431 - DNA, 185 bp, Homo sapiens
gcttacttctcttccttctctccttaatgacattaacactattctcaccagacctcctaggcgacccagacaattatacctagccaaccccttaaacaccctccccacatcaagcccgaatgatatttcctattcgcctacacaattctccgatccgtccataacaaactaggaggcgtcctcgc

SEQ ID NO: 432 - DNA, 105 bp, Homo sapiens
atagttgtcacttagctctacctgggcagctctaaaatattaaaagacccaagtcctaccctcagaattttttaactcgtctagcatgcaaataggggcattgag

SEQ ID NO: 433 - DNA, 290 bp, Homo sapiens
tttactttaaaaaaaaggatttcttttacgaagtattttttgtttttttgagattgagtctcgctctttcacccagacttgagttcagttgcagattcttggctcacttcaatctcttcctcccggattcaagtgattcttctgcctcagcctcccaagtagcttggaaaacaggcctttccaccacaccggagtagttttggtatttttagtagagatggggttcacattctggccaggctggtcttgaactcctacctcaggtgatctttttccccaacctccaaagc

SEQ ID NO: 434 - DNA, 170 bp, Homo sapiens
gtcgctcatacttgtaatcccagcactttgggaggccgaggcgggtggatcaaaaggtaagcagatcgagaccatcctggccaacattgtgaaaccctgtctctactaaaaatacaaaagtaagccggtgtggtggcacatgcctgtaatgccagctactcggaagctga

SEQ ID NO: 435 - DNA, 339 bp, Homo sapiens
cagaagcgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtaaggacacacctaacccagaggcagcttttgcagcatccagttcatcttaagatgtcacgattagtcatgcataaatgtctggtttaaaatt

SEQ ID NO: 436 - DNA, 320 bp, Homo sapiens
gtgacaatgttgacacccgcaccgtcatggaagagatgcgggccttggtcagtcagtgcaacctctatatggcagcccggaaagccgtgagaagaggcccaaccaggctcttctggagaacatcgccctgtacctcacccatatgctgaagatctttggggccgtagaagaggacagctcctgggattcccggtcggagggcctggaaccagcttcagtctcgaggccacagtcatgccctaccttcaggtgttatcagaattccgagaaggagtccggagattcccagacaaaagtcctagatctcagctcagcatgcc

SEQ ID NO: 437 - DNA, 105 bp, Homo sapiens
attacttccttggctttcttgctttactgtcgcccctccagcgcttagagcctccctgctgctagcagcactgtgttcaggctcttgtcttaacaccgcagcccc

SEQ ID NO: 438 - DNA, 109 bp, Homo sapiens
ctgtaatcccagctactctggaggctgaggcacaagaatcacttgaatcaagtggatcacttaaggtgaagagttcgagaccagcctcgcccaacatggtgaaaactcg

SEQ ID NO: 439 - DNA, 186 bp, Homo sapiens
ctggaacgagcgtgctgtcaacagagtcagtgcgatccgatttgtggaggatgagaaagatgaagaagacaatgagacgagaacacttctaaggcgagccacttcacacctctggggagttaaagcacatgtaaaagacagttgagaatttacggattgacatgaattctgctaaaggactggact

SEQ ID NO: 440 - DNA, 108 bp, Homo sapiens
cggtcatggagggagcaggagctggatccggcttccggaaggagctggtgagcaggctctgcacctgcacttcaagggattgacaaggaccaaagaaggcagcagtcc

SEQ ID NO: 441 - DNA, 135 bp, Homo sapiens
ctaggtcgcggcgatatggccaacgtaccagaaagtcgggatcgtcggtaatacgggcccccctattggggcctccctccggaaaattggtgaaggaaaatttgaaattcaagccaaccacggccaagtacactt

SEQ ID NO: 442 - DNA, 105 bp, Homo sapiens
agtttgttaaaggttatggtactatgttaagtatgaaaggcagtcgtgctcagcttagcagcactttggagctaggtgggttcaagccatctggaaatgaaactg

SEQ ID NO: 443 - DNA, 102 bp, Homo sapiens
attttttcactagattttttccaattgagaaaatatatactaacacatagcatatacataatcactctatttgaggaaatatcttgttttctgccaatagat

SEQ ID NO: 444 - DNA, 375 bp, Homo sapiens
tcccacctcagcctcctgagtagctgggactacaggtgccacaccaccacggccagctcattttttgtatgttttgtagagactgtgttttgccacgttgccaggctattcttaaacgtccgagctcaagtgatccctccacctcagccttccaaagtgctgggattacagatgtatccacacacccagccaaatgcattcatgtctaccatagaaatacatctctttgctgctatcttgaatttgtagactccacaatcaataaagagaggcatccataaaaaatgggtagagccagcagtgctacactgtatcaagacttagagccagcagcagatcactgagtcagagtcagacagctgcacatgacaaacc

SEQ ID NO: 445 - DNA, 455 bp, Homo sapiens
gctatgtggacattgccatcccatgcaacaacaagggagctcactcagtgggtttgatgtggtggatgctggctcgggaagttctgcgcatgcgtggcaccatttcccgtgaacaaccatgggaggtcatgcctgatctgtacttctacagagatcctgaagagattgaaaaagaagagcaggctgctgctgagaaggcagtgaccaaggaggaatttcagggtgaatggactgctccgctcctgagttcactgctactcagcctgaggttgcagactggtctgaaggtgtacaggtgccctctgtgcctattcagcaattcctactgaagactggagcgtcagcctgccacggaagactggtctcagctccactgctcaggccactaatgggtggagcaccactgactggtcttaagctgttcttgcataggctctaagcagcatggaaaatgg

SEQ ID NO: 446 - DNA, 241 bp, Homo sapiens
gtttgtatatattttaaaaaattgttttaaaagtcagtttgcaacatgtctgtaccaagatggtactttgccttaaccgtttatatgcactttcatggagactgcaatacgttgctatgagcactttctttatccttggagtttaatcctttgcttcatctttctacagtatgacataatgatttgctatgttgtaaaatctttgtaaaaaatttctatataaaaatattttgaaaatctt

SEQ ID NO: 447 - DNA, 295 bp, Homo sapiens
cggcacgagaaaaatattaaaaaataaatagcgactgggctgggcatgggtggctcatgcctggtaaatttcagcactttgggaggtcaaggcaggcaggtcacttaagcccaagagttccagaccagcctggccaagatggtgaaactggtctctactaaaaatgtaaaacctacccggccatggtgtcgcatgcctgtaatccagctactcgggaggctgaggcttgaggatcgcttgaacctgggaggcagaggttgcagttagccaagatcgcgcacttcactccagcctg

SEQ ID NO: 448 - DNA, 360 bp, Homo sapiens
aataggtaaatccatggagacagaaagtagattataagttaccagggctgggcgacaaggggagtgggcattattgtttagtgggtacggagtttctatgtggggtgataaaaaagttttggaggctgggcacgatggctcatgcctgtaatcccaacacgttggaggcccaggcgggtggatcacttgaggtcaggagttccagactagcctggccaacatggtgaacccccgtatctgctcgttgttggtggcgcctataatccagctactcaggaggctgaggcaggagaatcacttgaccccggaggtggaagttgcagttagcaagattgtccactcactccagcccggttacaa

SEQ ID NO: 449 - DNA, 421 bp, Homo sapiens
gacactactttagtccccttttctttggatcattctttgactctatagagattcctcccgttttcttcccatggctgatggtgtgagctttaattttgaaggcttttcccattgttgtatgacttctgctcctggtgtatcttccactggctagggactcattcagaacaggtattaggacattcttctgtgcattttaaaggtctaagatggcactgtctaatatagtagtccctaggcccatgtgattgccaatcacttgaaatatgtgaggcaggtggatcacgaggtctggagttcgagaacagcctggccaagatggtgaaccccgtctctactaaaacacaaagttagcgggtgcgtggtgggtcctgtagtccggttctcggaggctgaggcaggagaatcacttgacccagga

SEQ ID NO: 450 - DNA, 274 bp, Homo sapiens
cttggctcaacgcctgtaatcccagcactttgggaggctgaggcgggtggatcacctgaggtcgggagtttgagaccagcctggccaacatggtgaaaccccatcgctactaaaaatataaaaaattagctgggcatggtggcgcacgctcgttagttccagctactcaggaggctgaggcaggagatcgcttgaacccgggagttgaggttgcagtgagctgagatcgcaccattgcactccagcctgggcaacaagagcgaaactctgtctc

SEQ ID NO: 451 - DNA, 305 bp, Homo sapiens
accccagtgggagaaagttcaaaggtgattagattaataatttaatagaggatgagtgacctctgataaattactgctagaatgaacttgtcaatgatggatggtaaattttcatggaagttataaaagtgataaataaaacccttgcttttacccctgtcagtagccctcctcctaccactgaaccccattgcccctacccctccttctaactttattgctgtattctctcactctatattcctctctattcgctaatattgcattgctgtcacataaaattcataaaggtttagtggttagtg

SEQ ID NO: 452 - DNA, 326 bp, Homo sapiens
acattctttctaatgatgcatagtggtccatggtacatgtaggtatactataatttattgcctgattgatgtatatgtgggttattttttgttttcttgtaataatgctgcatttgacatctttttatacattttgtgaacttatgcaaatatttctgtaaaatagattcttaaaagtaaaattgttttgatgaggtgtgtggatatatacattttactagagaccaccgtattgccctttaaaaaggtggacccagctatttgggaggcggaggttgcggtgagccgagatcgcaccagtccactccagccttgggtgacaaagg

SEQ ID NO: 453 - DNA, 324 bp, Homo sapiens
tttctcagtgcacgagtattgttcctttccctttgaattgttctattgcattctcatttgtagagtgtaggtttgttgcagatggggaaggtttgttttgttgtaaataaaataaagtatgggattctttccttgtgccttcagatggtaccttgccagcaagacgaaacaggcgggccttcggggacaagcagagctgtcttcgcccgttcactgaagatgatgctgctgatccaaatgattctgacatagacccaggtctgttagggcaagatcaaacagtgtcctactgtttgatgtgaattctctctcatgctctcacct

SEQ ID NO: 454 - DNA, 162 bp, Homo sapiens
ctcgtccacttttcgggcaggggttatggcttcgacatgtcttgcatcaaagatgtggccattaaggagcccctagtggatgtcgtggaccccaaacagctggtcaccaacgccttcctcataaaggaggtggacatctataccgtcaaggttgtaagacct

SEQ ID NO: 455 - DNA, 269 bp, Homo sapiens
gcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctaa

SEQ ID NO: 456 - DNA, 277 bp, Homo sapiens
ctggatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacaaaagccaaaattgacatatgggatctaattaaactaaagagcttctgcacagcaaaagacacttccatcagagttaacaggcaacctacagagtgggagaaatttttcg

SEQ ID NO: 457 - DNA, 293 bp, Homo sapiens
tcccaacactcccatcatcctagtgggaactaaacttgatcttagggatgataaagacacgatcgagaaactgaaggagaagaagctgactcccatcacctatccgcaggtctagccatggctaaggagattggtgctgtaaaatacctggagtgctcggcgctcacacagcgaggcctcaagacagtgtttgacgagcgatccgagcagtcctctgcccgcctcccgtgaagaagaggagagaaaatgcctcctgttgtaaatgtctcagcccctcgttcttggtcctgtcc

SEQ ID NO: 458 - DNA, 305 bp, Homo sapiens
ctgcagtacattggaacctgaattgaaagaaagtcttccttgaataattggagtttgtcttgagaggcaaatatagccccaagaatcacaagtttcgaggaccatgtaggtcttttacgtagcccaaatccataaattagtctcactttttgtatttatcgtttcatattaaaccctctatatcaaatgttcatcatgattttgtatgatttttataactattttattcattttattagatttattctaaaattttttaatggaaaattcttaaactgtggacaccactgaaggggcttattaac

SEQ ID NO: 459 - DNA, 220 bp, Homo sapiens
aaagaaggcgatccgagttctgctacttcctagtaagggacgtctctggagagattctgaggtgtttgagcctcttttggcctacacaccggcagtgttccttcccgcactcagagggcctctcttggagccagttccaggccacccatgggcccttggcccgcccccctattcatggctggcagattgggggccccccccttttggaggccctgtggcc

SEQ ID NO: 460 - DNA, 225 bp, Homo sapiens
ggaatttgaaagttgtattcagtattatttggaaaacaattggcttcaacatagagaaagctcctacagaagggaaaaaaagagctgctgttccctaagtaacgcgaacccctcgctgctggagcggcactgtgcctacctctaagccaagatcacagcatgtgagggagacagtggacatcttcttttatgctggacccctaagatgaggaagtcgggcagtac

SEQ ID NO: 461 - DNA, 130 bp, Homo sapiens
acctgcaaaaccagggcaaggcagtaccgggaaactggcgtgagttgctgcggtttgggggaagttgcacacccttttcatagatacctcccttaaccctcagtgcagattcttgagaaaactccaaggc

SEQ ID NO: 462 - DNA, 170 bp, Homo sapiens
cgccgccacaatggtgcgcatgaatgtcctggcagatgctctcaagagtatcaacaatgccgaaaagagaggcaaacgccaggtgcttattaggccgtgctccaaagtcatcgtccggtttctcactgtaatgatgagcatggttacattggcgaatttgaatcatttgt

SEQ ID NO: 463 - DNA, 166 bp, Homo sapiens
gacattcatacagaggggctacaagccaaaccagcagccttcagtgggagggactttgcaagttggattgttcaaggaaattgacaaaatacaagtttacaaaaattgttttttcaaaaaatgctcaaatggccaaagcacagtcgctcagcctgtattcccacaa

SEQ ID NO: 464 - DNA, 181 bp, Homo sapiens
gtttcaccgtgtttggccaggatggtctcgatctcatgacctcgtgatccacccacctcgggcctcccaaaagtgctggggattacaggcgtgacacccgcacccggccctgagtgctttctttaagtcaggcattgttctaaggtctttctgtacctgtatcatctcatttaatcctcag

SEQ ID NO: 465 - DNA, 138 bp, Homo sapiens
aggggctcgagagccctcttctaacatccctaaggtgggccatcatttgttacagatggggaggccccagggaccaggtgaattaaggtggcggctcggggcccaagcatctcggtattgagctctatgctgtgggcg

SEQ ID NO: 466 - DNA, 102 bp, Homo sapiens
aaggcactttcctcctccaccttttctatattgttcaagctgacaaagtaggtatttttaggaaaagttctaaagttataaaaaatgttttctgcaagtaaa

SEQ ID NO: 467 - DNA, 105 bp, Homo sapiens
cggcacgagtagttaccagcatgccattgaagaatctgtcgttctcatttattgattcccataaaacctgcccaggatcttctcttcactaaaggcatacagact

SEQ ID NO: 468 - DNA, 101 bp, Homo sapiens
gcttggttcatggacaggtaaatatgttattcagtcttgtcattattgtgatttttttcagtcaatttttggatgaggggataaaagttttggagaaaact

SEQ ID NO: 469 - DNA, 273 bp, Homo sapiens
tgcctaacttaattttcaaaggggcccaagtgaaattccaagggatggatccagggatggaaaatataccctgggtactgaacaaaaaaacccaaattacactccttattaaagaatactaaggtcgggcacggtggctcaagcctgtaatcccagcactttgggaagctggggtgggcagatcatgaggtcagaagttcaagaccagcctgatcaacatggtgaaaccctgcctctctaaaatacaaaaattaaccaggcatggtggcacag

SEQ ID NO: 470 - DNA, 236 bp, Homo sapiens
aacatgccatccagactgaggaagacccggaaacttaggggccacgtgagccacggccacggcccaataggcaagcaccggaagcaccccggccggccgcggtaatgctggtggtctgcatcaccaccggatcaactttcgacaaataccacccaggctactttgggaaagttggtatgaagcattaccacttaaagaggaaccagagcttctgccaactgtcaaccttgacaaat

SEQ ID NO: 471 - DNA, 255 bp, Homo sapiens
ccaggatggagtgcagtggcatgatctcggctcactgcaacctctgcttcctgggttcaagcgattctctccttcctcagcctcccgagtggctgggactacaggcgtgcaccaccacgcccaactaatttttgtatttttcatacagacggggtttcaccatgttggccaggatggtctcgatctcttgacctcatgacctgcccgccttggcctccctaagtgctgccattacaggcgtgacacccatgtctg

SEQ ID NO: 472 - DNA, 254 bp, Homo sapiens
aaaagatgaatgtcagacatttgaagaacctatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtccatccagtccagtgaatccacgaccgcagacctgccccccgcaaca

SEQ ID NO: 473 - DNA, 580 bp, Homo sapiens
aagcattcaaatgaggaattctgagtgcatctccaagatccacctgcacttcctcattcagcccctttataactaatgtttgtgccagaggccatctcgagtctgtggccataggtgtgtggcatttagtgaccttcgagaagctcaaaacaatgatctaaggacagacaagacgttaaaagacaacccacggaatgggagaaaatatttgcaaatcatatatctgataagcgtccagtctccagaatgtataaagaacaactcagcgataaagacaagcaatccaattgtaaactgggcaaaggatttaaataaacatttccccaaagaagatgtacagattccaatgagcacgtgaaaagattctcagcatcattagtcactagggaaatggaaatcaaaatcacagtaagtttccatttcacatcactaggatggctataatttcaaaagaaaaaagcaaaattaacaagtgatggcaagaaagttatcagaatccccctacatcactggtatgaatataaaatagtgcaatcattgtgagaaaaatcctgggcagtttctcaaaatgctaaacata

SEQ ID NO: 474 - DNA, 453 bp, Homo sapiens
gaaaaaagaagacacaagagaggtggctttgagtgggtttcctttcctcccctattcccggggcccggacgacttctgcttgggaactgccaacgcttctgcttgggaattgcgtgcagcagagcctagaggagctgttccttccttcacagatacttaagacctccaccatgtctgattcgagttctccctgggagggtttagaagaaacgcaggaacattctgggtggcgtcgaaggagcctttcccgatcatcatgtgtgacttctgcgaggtccagatcactgaattcatgtttacattctcgtgcaagcagggacctcttgcttctgagaaatggggaagagaccttttagccaaaatgcccttcttaaaaagagagacctttttttttaaagttcggttaaaaatgtgacagatgagtacaaaaatgcagacacttatcaaaaagca

SEQ ID NO: 475 - DNA, 121 bp, Homo sapiens
aaaatagttgtcaacttagctctacctgggcagctctaaaatattaaaagacccaagtcctaccctcagaattttttaactcgtctagcatgcaaatagggcattgagttttttttttttt

SEQ ID NO: 476 - DNA, 340 bp, Homo sapiens
aagttatgggataaaaaaggttatgggtaacttatggtataaaagttatgataaaaggccaggtgcaagtggctcacgcctgtaatcccagcacttttgggaggctgaggttgggagttcaagaccagcctggtcaacatggtgaaactgtgtctctactaaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaaaaaaaa

SEQ ID NO: 477 - DNA, 112 bp, Homo sapiens
tcaggcttcattctgcctcttgcatgacagctgatctttcggaccaggacacaaagcagcaagaagcggggagagagaggatagaaacacgcgcaggagagccttcgaacga

SEQ ID NO: 478 - DNA, 109 bp, Homo sapiens
ctggaaggcttgatgctcagacatgttacagccacatagctttgtcctagtcatgctgcactgcagcttgaaggccacgtcacatggggcactctctcttctctctcat

SEQ ID NO: 479 - DNA, 157 bp, Homo sapiens
atctgcaatgtgaccttcttactaaatacaaattagctggcatagtgcacggctcagtccagctactcaggagctgaggcaggagaatccttcacccaggaggcagagtttctgttagcgagattcacactcactcagcctggcacagagtagactc

SEQ ID NO: 480 - DNA, 144 bp, Homo sapiens
gagtagtatatgtgctagtctttaattctaaggaatttctatgtatctctacgatataacctagttaagtgattatctatggatgtgtggtctggataactaaaatcaccagtaacactctgtgtaccattacagaaatacttc

SEQ ID NO: 481 - DNA, 139 bp, Homo sapiens
gaatagtgctgcagtgaacatgggggtgcacatgtttttttgacatactgatttcaagttcttaagatattagattcacaagtgggtttgctgaatatggagttgatttgtgtgggtgaggcgggcatccagataacat

SEQ ID NO: 482 - DNA, 141 bp, Homo sapiens
gagactggtgtctcaacccggtatggtggtcacctttgctccagtcaacgttacacggaagtaaaatctgtcgaaatgcaccatgaagctttgagtgaagctcttcctggggacaatgtggggcttcaatgtcaggaatgt

SEQ ID NO: 483 - DNA, 134 bp, Homo sapiens
tgtgctgtaatcccagctacccaggagggtgaggcaggagaatcacttgaacctgggaaggcagagaggttgcagtgacccaagatcgagccactgcactccagcctgggcgacagagcgagactctccatctg

SEQ ID NO: 484 - DNA, 250 bp, Homo sapiens
atccacaaggtctaatatctagaattcataaggaaagtaagcaaatcaacaagaaaaaaaaaccccttaaaaactgggcaagcataaacagacacttctcaaaagaagatacataagcagcttctgggcgcagtggctcacgcctgtaatcccagcacttggggaggcgaggttggcggatcacctcaggttaggagttcgagaccagcccgccaacatggtgaaaccccatctcttttaaaatacaaaa

SEQ ID NO: 485 - DNA, 299 bp, Homo sapiens
ggaggtgtttgataataaagtaaagattcagccagacacaatcatacaggtgtggcgagaggatattccagtgaactatatgaaggagctggaactggtcaccaaggccggcttccgggcccttctctctgccccttggtacctgaaccgtatatcctatggccctgacttggaaggatttctacgtagtggaacccctcgcatttgaaggtacccctgagcagaaggctcttgtgattggtggagaggcttgtatgtggggagaatatgtggacaacacaaacctggtcccaggctct

SEQ ID NO: 486 - DNA, 190 bp, Homo sapiens
ttatttctgaaaaacaaagaaatacattttaaaatagcaaaggagaccatgaatgggatgtcttctctgaaggccagggcttccagtgttcctgatcctgttgtaagagatcctccatgcatccagagaggacagattttttttggaaaccctttcagtagctgtttttcatgcaactttattactgtca

SEQ ID NO: 487 - DNA, 220 bp, Homo sapiens
ctgactggggtcaattcaagtcatgcaggctgtgagaaacgcggggtcgcggttcctgcggtcctggacttggccccagacaaccggggtcgtggccagaacgccggccgggaccatctgcacaggcgctcgacagctccaagacggtgcggccaagcagaaagttgcacagaacgcggctcccagccacaccaagttcagcatttaccctccccttcca

SEQ ID NO: 488 - DNA, 240 bp, Homo sapiens
gactgctcctcattacccactcacctcagcccctagcaatcatcaatctatgttctgtctctggatttatctattctgaatatttcgtatacatggacttatctgtgaccttttgtgtcgagcttctttcacttagcatgatgtttgcaaggttcttcccattatagtatgtatcagtactacactttttaatgagtaatattgtaaaggatgtatacatcacaatttgtttatacatca

SEQ ID NO: 489 - DNA, 220 bp, Homo sapiens
aactgttgggcaacaaatgctgagctttcctcaactcctgcaaacagtgctgcacaatcatccaggtggtcataagctacttcctcatgctcatcttcatgacctacaacgggtacctctgcattgcagtagcagcaggggccggtacaagatacttcctcttcagctgggaggaggcagtggtagtggattcacagagcattgccttgacatcaaactc

SEQ ID NO: 490 - DNA, 251 bp, Homo sapiens
gcggctgggaggcggtttggggagtggcgggtggtaacagcacacgagagccgctgctgtctgcgcttgaggacttggaggtcctgtctagggaacttatagaaatgctggcaatttcaagaaaccaaaagttgttacaggctggagaggaaaccaggtctcgagttgttaattcaccgagatggggaatttcaagacctaatgaaattcgcacttaatcagggaaaattcatcatgaaatgcaagtttta

SEQ ID NO: 491 - DNA, 170 bp, Homo sapiens
ctcgtccgaatttcggcacgggtcttaattccactcacccttcttcattcttgctcagcaacactgaacatcttacaatttcttgaaaatgccgagcttgctgtccaccacagggatccacacttgtctttgctctgtacccgggaatgttcatccctgggactatcccg

SEQ ID NO: 492 - DNA, 120 bp, Homo sapiens
gttaaagtccatctctcccactagaaagaaagcgtcaagaaagctgaatctaatgtctatttactcctgtgcccctagcacctagcagcacagtgcctggcacataatggcattcaatat

SEQ ID NO: 493 - DNA, 178 bp, Homo sapiens
gaaaagccactttggaaaccccaacatttgcccagaaacgtcggcgtaccctgggatatgttgattagatctttacaccaggatttgatgccagatttgcataagaacatgcttaatagacgatcttttagtgatgtcttaccagagtcacccaagtcagcgcggaagacagaggagg

SEQ ID NO: 494 - DNA, 287 bp, Homo sapiens
tccactcctactggagaccatgtcggttccggacccaccagtttaccataagcaagactaaacctgatccttgggcaaaagttcctaaccctactttaccctcccaccctcacttttaaatccaccatactgaatgccacactatggaatgcagctacctgccaagcaaggcaatagagggcaaaaaatggaggtgaattaagatggacctcatctgaaatacacaaatgcattactatctgaggtaccagcaagagtttagtctacgtgtataaggctccagtagg

SEQ ID NO: 495 - DNA, 103 bp, Homo sapiens
gaggatgagtaatgagtactctgtaaggaggaccatgtcagactattgtaagctaagcattaggactgatacacatatatatgctcctggcatagacacataa

SEQ ID NO: 496 - DNA, 184 bp, Homo sapiens
tttctttaatttgaagataatgcaggagtcatagtgaacattaaaggcgagatgaaaggtctgccattacaggcccagtagcaaaggagtgtccagacttgttggccccggattgcatccaattgctggcagcattcaatgattctccagtatatttgtaaaaataaaaaaaacctaaccccaa

SEQ ID NO: 497 - DNA, 124 bp, Homo sapiens
attttgactaccacaactcaacggctacatagaaaaatccaccccttacgagtgcggcttcgaccctatatcccccgcccgcgtcccctttctccataaaattcttcttaagtagctattacct

SEQ ID NO: 498 - DNA, 122 bp, Homo sapiens
ggcttcggatggtgggcccctggttatcccagctactcgggaggctgaggcagaagaatcacttgaaccttgaaggaggaggttgcagtaagctgaggtagcgccgctgcactctagcctgg

SEQ ID NO: 499 - DNA, 180 bp, Homo sapiens
tctgcttcttgtaaaacctgacccagaaccaacacaatccgttgcaacccaaggacccaagtactttccaatctcagtcactctaggactctgcactgaatggctgacctgacctgatgtccattcatcccaccctctcacagttcggacttttctcccctctctttctaagagacctga

SEQ ID NO: 500 - DNA, 236 bp, Homo sapiens
cacccacccagctgctgtcattccgctcactgagctcttcttcattctcacctgatccctggggggactcaaagccaaaactgcccaaagaggaaagattgaatcctaaaggggatccttgcccccatggagggccccctactagaaggacgtgaaagcagcttttgggggaaactgaggcagttgggaagacagagcagaatgagccctcaccctggctgggggtccagcacagg

SEQ ID NO: 501 - DNA, 137 bp, Homo sapiens
ctcgcccctccctgttcagcgcagtacctggatggcagcctggctttctgggatctcaccaccatgcctagaccattgacctccacctgttcctcgagccttcagctggatcctgggcttttccctacccgggttgg

SEQ ID NO: 502 - DNA, 106 bp, Homo sapiens
tacagttcttaatggttgcacagacccaaagagtagagcagcagcaagatctattgtggagagcgaaagaacaatgctttctatcagcattggatgggtgacctaa

SEQ ID NO: 503 - DNA, 162 bp, Homo sapiens
gtctactgtgggcaggtgtttgagaagtcccccctccggtgtaagaacttcggatctgtgctgcgctatgacttccggagcggcacccacaacatgtaccgggaataccgggacctgaccaccgcagcgctgtcacccagtgctaccgagacatgggttacc

SEQ ID NO: 504 - DNA, 276 bp, Homo sapiens
cggaggtgcaggtcctggtgcttgatggtcgaggccatctccttggccgcctggcgattccggtggctaaacaggtactgctgggccggaaggtggtggtcgtacgctgtgaaggcatcaacatttctggcaatttctacagaaacaagttgaggtacctggctttcctccgcaagcggatggaacaccaacccttccggaggcccctaccactttcgggtccccagccgcatcttctggcggacgtccgaggtatgcttccccacaaaaccaagc

SEQ ID NO: 505 - DNA, 279 bp, Homo sapiens
gaactgtctcgccttcgccggctttaccagggtcatctccaagaagagagtggccccccacctgagtcaatgcccaagatgccccctagaacaccagcggaagctcctccactgggcagacaggcctcagagtgctctgtaggagctgtagactgggaagagaggccaggcgtggtggctcactcctgttatcccagcactttggggagccaaggtgggctgatcacttgatcccaggagtttgagaccagcctgggcaccatggtgaacctcgtcttt

SEQ ID NO: 506 - DNA, 252 bp, Homo sapiens
gcaaaattaaatgcaccaatagtactaaataaaggtaggcaggaaggcacctaatgtactacaatagcttgtataacatcagcctcatccagtgatcaaggtgaccaaataaattatctttaacacacacacacacacacagagtatagactccacagtttccattgtaagacacattctctgacactagtgcacacttgatgccctggatcctcaagacatcaccgggtgccgggtgcagggctcacgcct

SEQ ID NO: 507 - DNA, 248 bp, Homo sapiens
attcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgttctgcccctttcacatcaaagaacttact

SEQ ID NO: 508 - DNA, 145 bp, Homo sapiens
cggtgtctcacgctgtaatcaagcactttgggaggcaaggcaagcagatcacatgaggtcaggagttcgagaacagcctggctacatggtgaaaccccgtctctactaaaatacaaaaattagccgcgtgtggtggcacatgcct

SEQ ID NO: 509 - DNA, 154 bp, Homo sapiens
caatggttgcattctttgagtttccgattagcctttccaaaggcagcagtcagatatgcatttatctcagttgagccagaggggatgatttttgaaattctgtctgtccctttgtccactaggaaaattcccttgtgagggagggtgtgtatct

SEQ ID NO: 510 - DNA, 151 bp, Homo sapiens
gaggaggacaccgatgtcccagcagaaggcggcatgagaccaacgtgggagcagaagagagaggttcctggctggcccaggtttagttcccttagttacacaacgtcaaagttcatcactagggttttagttaagaggaattggaccagcc

SEQ ID NO: 511 - DNA, 204 bp, Homo sapiens
atcacttcaagctacagcaatttgagctgttttgtcatttgttacataagcaggtgataatgatctgttgccagtcattttgacttgtgtctctggggaaacaaacaaacaaagagagaacagaaagaagctctactgcgtttataaagctgtactccaaagtgattttaaaataattccaggcagtattcattggtagatgat

SEQ ID NO: 512 - DNA, 198 bp, Homo sapiens
gcattttcggtttctagggttgttacgaagctgcaggagcgagatggaggtggacgaccgcgtcgttgatggtcgagatggtctccgggagccggcgaggctttagcgagggagggaggcaaaacttcgatgtaaggcctcaatcttgggcaaataggcttccaaacactcctactggttggacctcttgcttttcaa

SEQ ID NO: 513 - DNA, 228 bp, Homo sapiens
ctggatttgaatctgagtgagatttacctagtgatataagtgatgtatcagcagcctatatagcttttgaaacagtttcttaatctttctggccttagtttaatcctctgtgaaatgggaatgaaaatgtctatttcacaatgtggttgcagggtacacatgaaaggcagctatgttgaaataacacaaatggtagaaaattgcttttgatatcacaataaattgagc

SEQ ID NO: 514 - DNA, 135 bp, Homo sapiens
ggtcagtcgaacagacacgggtgaatgctgctaaaaacaagactcgggctgctccatcattccatgctggtgcgatcgggctactacaaagttctggctaaggggaaagtctcccaaagcagccctgtcatcgtt

SEQ ID NO: 515 - DNA, 110 bp, Homo sapiens
atggtctcaactcctaacctcaagtgatccgcccgcctcagctcttccaaagtgctaagatttatagggcggtagagcaccccatggcctgaggcttattttccctcact

SEQ ID NO: 516 - DNA, 128 bp, Homo sapiens
ttagggagtcgtgccgcgactgtggtcgtcttttataccttcccgcgcggacgccggcgctgccaacggaagggcgggctctgctgccatgaaggtgaagattaagtgctggaacggcgtggccactt

SEQ ID NO: 517 - DNA, 167 bp, Homo sapiens
ggtcaagaagccagtcatcgctgctgtcaatggctatgctttgggggggctgtgagcttgccatgatgtgtgatatcatctatgccggtgagaaggcccagtttgcacagccggagatcttaatagggaccatcccaggtgcgggcggcacccagagactcacccgt

SEQ ID NO: 518 - DNA, 314 bp, Homo sapiens
ccatggtctgggaggggctgaatgtggtgaagacgggccgagtcatgctcggggagaccaaccctgcagactccaagcctgggaccatccgtggagacttctgcatacaagttggcaggacattatacatggcagtgattctgtggagagtgcagagaaggagatcggcttgtggtttcaccttagaggaactcgtagattacacgagctgtcctcagaactcgatctatgaatgacaggaggacagacacattgcttttcacatccatttaccctacttaccattgacagaggacaggctgtaggaatctagt

SEQ ID NO: 519 - DNA, 325 bp, Homo sapiens
ctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaattgaaagatacagatagtgaagaggaaatccgtgagcattccgagtctttgacaaggatggcatggttatatca

SEQ ID NO: 520 - DNA, 190 bp, Homo sapiens
tagatgcagaaaagaccctaataaaattcaacatctcttcatgttaaaatctctcaataaactagttattgaaggggaacatacctcaccataatgcgcgctatttatgacaaacccatagctaatatcatacaggatgggcaaaagctggcagcattcttcttgaaaaccatcgtaggcaaggttactt

SEQ ID NO: 521 - DNA, 250 bp, Homo sapiens
gaaaaagcttgtggtgaaggggggcaaaaaaaagaagcaagttctgaagttcactcttgattgcacccaccctgtagaagatggaatcatggatgctgccaattttgagcagtttttgcaagcaggmacaaagtgaacggcaaagctgggcaccttggtggaggggtggtgcccatcgacaggagcaagagcaagatccaccgtcacatccgagggtgcctttctccaaaaggtatttgacatatctcac

SEQ ID NO: 522 - DNA, 130 bp, Homo sapiens
ttaaaacttaccaaaatatggaaagtgattaaatattttcagaatgtataaaagatatttccagatcagtaaattctgcattagtccattggagattctggaataaacacctttagggtacttctaaagc

SEQ ID NO: 523 - DNA, 215 bp, Homo sapiens
gaaaacactttttacattgcagcagaccttaagtcttctagccttagggacagccggtcatttctcgtgtatccagtcctgtctttcagtcaaccagagtaacaaatggcttcttttgtccttccctttgtttactactccaaccaggatctttaagatagagcgtgcaagggcgatatgccaggcgatatacaagcccatataaggcaggcttc

SEQ ID NO: 524 - DNA, 130 bp, Homo sapiens
aggcaaggagaaaacgaagagaaagaaagttttgaaaaacaaaaggagaggaagaagaagaggcagcaggcatggaagacgtcaactagtccttagatagaagtagtggcacccgtacagacgggtaact

SEQ ID NO: 525 - DNA, 195 bp, Homo sapiens
tctcgctctagggagattcttcaagcaatcactatgtcaacagacacaggtgtttcccttccttcatatgaggaagatcagggatcaaaactcattcgaaaagctaaagaggcaccattcgtacccgtttgtttttggagacagtcccgctctagtcgcccaggctggagtcacagtggcaggatctcgtctcac

SEQ ID NO: 526 - DNA, 136 bp, Homo sapiens
gcacacatatgtccctgttctgttctcatagaggagatcaaatcccttttatctattagataatcaagggcactgtgatacagttttgagtaaaaggccatttttttaaaagccttccagttttgtggattaacct

SEQ ID NO: 527 - DNA, 191 bp, Homo sapiens
ttttatttatttcattttatttcatttctttcatttatttctgagacagagtctcactctattgcccaggctggagtccagtggcgcaatcttggctcactgcaacctccacctccaggctcaaatgattctcctgcctcagcctctcaaatagctgggattacaggtgtccaccaccatgcccagttaat

SEQ ID NO: 528 - DNA, 105 bp, Homo sapiens
cgcttaaatgctgaaggtgattgtaaaaataataaatactcacatagttcaaggaacactggaaagggaaaggcctatgagggcgtaatttaaaggggtacagtt

SEQ ID NO: 529 - DNA, 151 bp, Homo sapiens
ctgtctacaagacctcactaacccgtccaggctagcagtgcctgcacagcctagctcctctccatctcttcttaagcaggctgttccctcatgcaggcaccagtcctccatgagagtccagagggcattgaccttcaggtgcatgtgtcag

SEQ ID NO: 530 - DNA, 100 bp, Homo sapiens
gtcaatgctgattgggtaattatacattcttgtgctaatttacaccttaaatttgcctcttcaaggtgattgtcctctgagtcatgattggtagatacat

SEQ ID NO: 531 - DNA, 146 bp, Homo sapiens
gagactttcctgatggtgtccccgagaggctgtctcgcagcatgtccttactagaattggtgttatgtctttgattcgcagaaggttcaggagtttgaacatgttaatgggcgctggggcatgcctcaactggctcaggtggagga

SEQ ID NO: 532 - DNA, 113 bp, Homo sapiens
cttttggaggctgaggcgggtggattgcttgaggccacgagttcgagaccacccttggccaccgtggtgaaacggttttctcttattaaaattacaaaaaattagggcttggg

SEQ ID NO: 533 - DNA, 480 bp, Homo sapiens
gtttttctggcataaggagaggaagatgggggtggggaggtggaatcaaatccatatgtttgtgatgcagttgccctgaaataataagaaagcattgctgggaaagagcctttggatgtctcaggaaccatgtttacaagccccacattggccttttggtcccctcagttcatgctgccacttgccaggctttgaaaggaccaagttcacatggggacactactcttctttcttctcctgattttttgcagcctttgctcccaatgaccttgtctctttctctgtatcatcaacatgaggtgaaggacaaatgcttgaatctttacttctctgcagagctcaatgaggcatactgctttttgccgccctatgacctcactatctgagctaaatatcatttcttcttgtcatctgtaatgctgacaactcctgggtaaagctgggtgcctcacctacagctaactggaccctgtaaaactt

SEQ ID NO: 534 - DNA, 304 bp, Homo sapiens
ggcacctgggctgggcacggtggctcacgcctgtaatcctagcactttgggaggccgaggcgggcagatcacgaggtcaagagatcaaaaccatcctggccaaaatggtgaaccctgtctctactaaaaatacaaaaattagctgggcatagtggcacgcgcctgcagtcccagctactcaggaagctgaggcaggagaatcgcttgaacccaggaggcagaggttgctgtgagccgagattgcaccactgcactccagcctgggcaacagagtgagactccatctgaaaaaaaaaaaaaaaaa

SEQ ID NO: 535 - DNA, 210 bp, Homo sapiens
gtaaaaatcaaaattcttttaaatatcaacttaattttttctaagtaagatacaaaaaattttcatctaaagtaatatttcactttatattgtaaagaaggtaggtatattggtggctgaggtctcctgaaattgctaaagggaaatttttccatggtaatgctcctacggatataaacctcagttaaatggaattaaccaagggatgtg

SEQ ID NO: 536 - DNA, 506 bp, Homo sapiens
gtttatatatatatgtgtcacatttcctttgtccattcatctgttgatggacatggctttattccataacttggctattgtgaatagtgctgcagtgaacatgggagtgcacatgtctctttgacatactgatttcaagttcttaagatatagattcacaagtgggattgctgaatatggaattgatttgtgtgggtgaggcgggcatccagataacatttttgtccaaatggatgcccagttgacctagtgccattgattgaaaaggtcatcctctccccactgcactgcagcgtcaccactggcatggatccaatgacctgtgttgtgtgtggttctgcttctggttaagccagatgctctgcccttccatgaatgcgtgctgccttaattactataatttgtcaagcattttgtgacacaaaatacacaacgcaatgatgttttgtgtaaaggtttggtatgattttccttttaaggtttttgttatttacatttcattttcc

SEQ ID NO: 537 - DNA, 294 bp, Homo sapiens
aggccgggaactgcatcatggaggtgtcctcgttggccacgcggaaagcagtcagaagcccaaccgtgagggacatgacatccaaagattactacttttgactcctacgcacactttggcatccacgaggagatgctgaaggacgaggtgcgcaccctcacttaccgcaactccatgtttcataacccgcacctcttcaaggacaaggtcgtgctggacgtcggctcgggcaccggcatcctgtgcatgttgtgctgccaaggccgtgcccgcaaggtcatcgggatcgagtgt

SEQ ID NO: 538 - DNA, 179 bp, Homo sapiens
tctggccttcccaaactgcttttgatcttttgattcctcttgggctgaagcagaccaagttccccccaggcaccccagttgtgggggagcctgtattttttttaacaacatccccatttcccacctggtcctcccccttccatgctgcaacttctaaccgcaatagtgactctgtgctt

SEQ ID NO: 539 - DNA, 250 bp, Homo sapiens
gccggctgcgggaagatggcggctcagccgttgcggcatcgctcacgttgtgcaacgccgccccggggggacttttgtggtggcactgagagggcgattgaccaagcttcttttacgacctccatggagttggatacgcaggttgtgaaggggtcctgccgctcggcccgcaggcttgggggctgaggagccagccgccggcccgcagctgccgtcttggctgcagcctgagaggtgcgctgtgttccag

SEQ ID NO: 540 - DNA, 305 bp, Homo sapiens
cgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattcgagcaatcttcctgctaaggc

SEQ ID NO: 541 - DNA, 83 bp, Homo sapiens
tgtgtacatagtaaccagtcttatcttgagatgtacagagatttgcaaatttttacatgaggaggtaagcaatgtacttaatc

SEQ ID NO: 542 - DNA, 255 bp, Homo sapiens
  misc_feature 219: n = A,T,C or G
gacagatggtagagacttccatagaattaagagggttctcatggaggggataggaagtaggtttaaagcctaccagtgtaacctaccagtacaactgtgaatcctaggcgaggcaaaaatgcacttccactgaaacgaagcatttctgaccgctttttcttggttatgatctcaatttcgaatataagatgataggtaagcgcactttctcggatactnctgaattcccaagtgccaggagtaggatttcattat

SEQ ID NO: 543 - DNA, 170 bp, Homo sapiens
gtaagttctaatcatttgataagttactactgaatggcaagctatttctatataactatctagaggcgtctctcctctttagttgtagaataacctactttagactacatatttatcatattcgtcatgtactaccatcagaccttgcttgcctgcatcaaaatgaaatg

SEQ ID NO: 544 - DNA, 150 bp, Homo sapiens
tgcccttgtatcttgcatgttaaacgttggattattgggcatgtgtgcagcctgcctctacatgctagacaagtgttcctttagtacataggccacaaggtcttcattctttaaaatggtttgacaggttctcctatataaaattaattc

SEQ ID NO: 545 - DNA, 165 bp, Homo sapiens
gccaaaacagcagtggctcacaggcccggggcattcaaagctgagctgtcaagctggtgatcgtggccaaggcattcgcgcactgagctgtgaccagcagccctgttgcgggtgcaccttctcatctccggtgaagctgaaggggcctttgcctgaaaggccagc

SEQ ID NO: 546 - DNA, 160 bp, Homo sapiens
cgaacgcaacatgaaggtgctccttgccgcgccctcatcgcggggtcgtcttcttctgctgctgccgggaccttctgcggccgatgagaaggaagaaggggcccaaagtcaccgtcaaggtgtatttgacctacggatttgagataaggattaggccggg

SEQ ID NO: 547 - DNA, 160 bp, Homo sapiens
ctctgaccagcaccatggcggttggcaagaacagcggcttacgaaggcggcaaaagggagccaagaagaaagtgtttatccattttctagaaagatttgtattatgttaaagcaacctcctattgtcaatattaggcaatattggaagcggttcgctaac

SEQ ID NO: 548 - DNA, 170 bp, Homo sapiens
aaaaatctcattcccagagtcagaggagaagagacatgtaccttgaccatcgtgctttctctcaagctagccagagggtggagcctaagggaagcgttggggtagcagatggagtaattggtcaacgaggttccagaccacttcccaaagcttcagacttgccaaggttc

SEQ ID NO: 549 - DNA, 150 bp, Homo sapiens
cgaggagatcaagtgagttgtcatttatactgtactctgtgactgtacagttgaatatcttatcaagtttataaaatgcagattttgtttacttttttaagtatgttgtagcacacacgaccctcatgttgttttggggaaggggatggt

SEQ ID NO: 550 - DNA, 206 bp, Homo sapiens
cctcgtgccggaatttcggccacgagttaaatgtggagttttttgtgaattcacatgaagtatggaatggttgttttattatgactttagtttgcattttccccaattctcgttaaatccctcattctaatgggcaatttattgtgtaaggacccgttcatatcccgtgtctctaactttgtatttggattaattttctctcggat

SEQ ID NO: 551 - DNA, 197 bp, Homo sapiens
ccagggtttttgtggagccaggctgaggctctgaaggccaaggggagtccaggtggtggcctgtctgagttttaatgatgcctttgttacttgcgagttgggcccagcccacaaggcggaaggcaaggttccgcttcttgcttatcccacttgggccctttgggaaggagacaagcttatttacttgagttagttcc

SEQ ID NO: 552 - DNA, 242 bp, Homo sapiens
gtttcgctcttgtttcccaggccggagtgcaatggcgccatctcggctcacccaaacctctgcctcccaggttcaagcaattctcctgcctaagccctcccgaatagctgggattacaagcgccaaccacaatgcctggctacttttcaaaatttaatggagatggggttttaccaagttggccaagctgggctcgaactcctgacctcaaggtgaaccgccttccttgggcctcccgagtc

SEQ ID NO: 553 - DNA, 221 bp, Homo sapiens
ggctgctctcaagtacctcattgacaattccttcactgtgtccagtggggctaggcccggggcccagaaggtgggcattgtcttcactgatggccggagccaggactacattaatgatgctgccaagaaggccaaagacctcggctttaagatgtttgctgtgggttttggcaattccctggaggatgaccttagggaaatagccccagaacccttggcam

SEQ ID NO: 554 - DNA, 221 bp, Homo sapiens
gggcaaacacagaaattttaaaaaagagtcttaactaccacagagttaattgcctcacttttcaaaaagggaaacttaagtgcttttttttccaccttcttttttgcaaaatagtcccttcacttttaagttacttaacccattttcactttcccttccactttgttttattcctaattgaaagattttattactttttaaatgaaagaaaattaaaccca

SEQ ID NO: 555 - DNA, 186 bp, Homo sapiens
gtctggcccaagccattcagaggtggggtctggggcctgggggttttgtgtcgtgacactttgtctcaaggagattccacatagggatttgaattaggctttctgcttgccaaggcctgttgcatcttagcctggcttagggccgggcaaggcctccccttagcctttggaagccgaggttcacty

SEQ ID NO: 556 - DNA, 169 bp, Homo sapiens
agaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagt

SEQ ID NO: 557 - DNA, 225 bp, Homo sapiens
ccaagcagaggctcccgtgcaggaagagaagctgtcaggtgggtgattgtctgggaacccgacacgtcccgtcgtttgtttttggttttagtatcttccccatataccaagagcacaggtggaaaaggccgcaccacatggcaattagggcaagcgctttgccgggaagtttgattggccagaaccttgggagaaatttttttctagatgtggcttgggcttgca

SEQ ID NO: 558 - DNA, 118 bp, Homo sapiens
ccttcttacttaaaggatcagaattatgccgggcgtggtgcgcatcccattattccagctacctaggagaccttaggatggagaataccttaaccctagccgcggaggttcagtagtt

SEQ ID NO: 559 - DNA, 234 bp, Homo sapiens
cggatggagtccagcaggggagtgtggaaagtggggcttgtgctgctgcctagaacaataagggatgtaaaaggcctgggaggctaagaaccctccccaaggcccaattccatgcacatttactttagctaacaatttaggggaggacttggtaagggccagggccctgttcttgggaacattagctgttatcaacaagcaggaaaggggtcgctttccccttaattgcgcttt

SEQ ID NO: 560 - DNA, 187 bp, Homo sapiens
ctcgtgcgaattcggcacgagaatattttctgtttctctttttcactctctaaactctttttgtataaataaggattatcctggaccataattcatttgaatatgaaaccaacatactttctttcatttttgtgaaaaaataaccaaaacatgtattaatgtgatacaaaggaaggctcatttccac

SEQ ID NO: 561 - DNA, 377 bp, Homo sapiens
cagactgttgcactctaaacctagggaggttgaagaatgagacccttaggttttaacacgaatcctgacaccaccatctatagggtcccaacttggttattgtaggcaaccttcctcttcttccttggtgaaggaccatccaaggccagaaggacgttaaccttacagtgttttcctttgcaccgttccccaccccaattcatcccggaaggaacttcactgaggaaacccttctttactagatatcctggccccctgggcttgtgaacacctcctagccacatcactacagtacagtgagtgaccccagcctcctgcctaccccaggatgcccctccccaccctgaccgtgctaactgtgtgtacatatatatgct

SEQ ID NO: 562 - DNA, 198 bp, Homo sapiens
gaccctgtgcgcatcttcaaacatgagccacagccaccacactctgtcctcaagttcctgcaggacgtgtttggcagcccggccacagctgccatcttctaccacacagacatgatggctctcattgacatcactggtgcggaacatcggaggcctgttaaccagggggcaagcttccgattgagtgcctctccctta

SEQ ID NO: 563 - DNA, 278 bp, Homo sapiens
gggctttaaaaaaatcagctttctgatttatattctgtggaaatgaggcttgtttgtttcaggttattctataatgtcttttggtgtggctgaagctgctgaggccatggggggagatttgtaaacaaggatttaaaaagtatgtttatttaatctcaattgaatttggcccaaggacttaaatatcaggaattgagatgggcccagctctgttttttgggcacactctctctatatctctaaatatatatagacaaatcacatatgtcacacgggtt

SEQ ID NO: 564 - DNA, 253 bp, Homo sapiens
ctcgtgccgaattcggcacgagagaaggccctgctcatccagggctccaatgacgtggagatccgggcagagggcaatagcaggttcacgtacactgccctgaaggatggctgcacgaaacataccggtaagtggggcaagactgttatcgagtacccgtcacagaagagcctcacggcttccatcattgacatatcacccataggacatatggagggccccagcacagatttcggtgtgtgacatagaggcc

SEQ ID NO: 565 - DNA, 110 bp, Homo sapiens
gatgaggacctcaccatccggatccatcagccaatggccccaaaactgggatccggaaggggcggggcaatcaacggggcccggggagaaaggattggaagagaacctcc

SEQ ID NO: 566 - DNA, 237 bp, Homo sapiens
ctctgtggcccctgcgaggaagcttgctccgggagtggtctttgggcataggcacctgcgtcactgtggcgaggtctgcttttgtctctgaccagctaacatcctcagatggctgccggcttccaccgcagagcaaatgccgctgccttctgttgagaacagagttagaatcggcgaggcaacattgttttttagcttaaggcaagcccggcccggggaaattgatatggatatgct

SEQ ID NO: 567 - DNA, 243 bp, Homo sapiens
ctctgtggtcctgctgccaccatggccactcaccgcctcgtgatggtccggcacggcgagagcacatggaaccaggagaaccgtttctgtggctggttcgatgcagagctgagtgaaaaggggaccaggaggccaagccgggagccaaggcatcaaggatgccaagataggagttgacaactgctacacagtcaatcttgaagccggccctcccacacctcttgggcctactcgagcaggaca

SEQ ID NO: 568 - DNA, 345 bp, Homo sapiens
caaacccctacagaccatcacctggaattgccactcacactgggttggagtcattgggcagctgtgcctgtccgagaggtgtctgtggtctgggcagcccctggaaaagcacctttcctgcctgtcattgttgcctgaggagggctggagttgctctgagagcagtttgggtttggagtattatatttggcttctatttttattattttggatcaccattctccctatcccttcttgcctccctcccttctaaacatgtttaataactatacagagactgctacaaaattgtatatagttttgggatcaaatagcatgaggggggaggaaccattaaaattgggg

SEQ ID NO: 569 - DNA, 250 bp, Homo sapiens
attgacattttaataatagtctcctagtctcaaaatgaattcggatgacatcacaccccggggcctgtcagggtctgggggactaggggaggttagcattaggaaaatacctaatgtagatgacgggttgatgggtccagcaaaccaccatggcacatgtatacctatgtaacaacctgacacattctgcaaatgtatcccaggatcttaaggtatattaaaaaattttttttaatgaattaggatggag

SEQ ID NO: 570 - DNA, 178 bp, Homo sapiens
tcttcctggacgagtcccgctccacgcagtacatgaaggagtaccaggacgccttcctcttcaacgaactcaaaggcgagaccatggacacctcctgagttggatgtcatccccgacccaacctgttttccaccagagttctgacactgtgactctgtataaaatggttgggagctgc

SEQ ID NO: 571 - DNA, 101 bp, Homo sapiens
gttgtgtagtagttaaggactatggcaaggagtctcaggccaaggatgtcattgaagagtatttcaaatgcaagacatgaggacataaatctttggctcac

SEQ ID NO: 572 - DNA, 346 bp, Homo sapiens
gttcattgtcatcaatcatggtttttgaagatagctagttttatccatctccagcaaagaatcatcaatagtttatattgctttacctgtgcctggcttccagagatggaacaaacccaggtgtctctcaacaagctacttttttactgggtggggaatctatgcaaggagtaaagtaaaaccatccagaatcaaagcagcaaccacatagttcaaatcaaagatcaaggtgaatttttgtatcactcctgtggaaatctatcctaatcaagtcattgcatttttccccgccataacttgctccctttcctactgtgtttcaggtacttcccttctgttaaagggt

SEQ ID NO: 573 - DNA, 325 bp, Homo sapiens
gaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaacaaagaaacatgtcagcagggcctatggtggttcatgtgtgctaaatgtgttcgtgacaaggatcaagcgtgctttccttatcgaggagcagaaaatcgttgtgaaagtgttgaag

SEQ ID NO: 574 - DNA, 234 bp, Homo sapiens
ctgcactgaatggctgacctgacctgatgtccattcatcccaccctctcacagtttggacttttctcccctctctttctaagagacctgaactgggcagactgcaaaataaaatctcggtgttctatttattattgtcttcctgtaagaccttcgggtcaaggcagaggcaggaaactaactggtgtgagtcaaatgccccctgagtgacttcccccagcccaggccagaagac

SEQ ID NO: 575 - DNA, 150 bp, Homo sapiens
cctctttctgccaaaaatttatagtattggtatatgtcccaatccaaaatctcactgttagaactcagattttcaggtctttccggttagtctcacttttttccacttggaccaccttcacttttttcaaattgtgtcagcacctgtgaa

SEQ ID NO: 576 - DNA, 190 bp, Homo sapiens
gggaaaggggttaacttcagccaggattgatggcagctgagggaaatttctttgccccaacttaaacccagaacttcaaactttaacatttggaaaattagggttccagggcccggacacagttggcccattgccttgttaatcccagccacttttggggggccaaggcgaggcttgggatctaccttta

SEQ ID NO: 577 - DNA, 240 bp, Homo sapiens
gtaatatggactttggcttaattttgtctcgttcttataaataatcctttgaaatgtgtctcagaaaatcattaacactgaaaaagggaatatggaagacttagaattctgaaaattataacatagtagactttttaattattatcaattgtgaattcaacaattttgtggggttacttagagccatgacactgtacacttggtaatttggtaaagtgccgagtgtcatatatgtccagt

SEQ ID NO: 578 - DNA, 171 bp, Homo sapiens
cggaggtggcagccatcttcttcttggcatcatggccggcctcagacccttgtgaaggccaagatcgtcaaaaagagaaccaaggaggttaatccgcaacagttagagcccatatatgcaaaattaagcgctaacttggccggaacccagaggggatttacaacacaggtt

SEQ ID NO: 579 - DNA, 100 bp, Homo sapiens
cggtcgtggagcacgtttcctgcggcgcgatggccgtagtctttcggcagttgtgaggagctcctcagctagattgcggcaggccgttgcaagcaaaccc

SEQ ID NO: 580 - DNA, 250 bp, Homo sapiens
gagaaagaacattggtaaaaggtatgaattccagaattaaagaaataatttggggatttctagataagaggatatatatgaccatgcataccttacaccttcatatacacaaccttaaatcacaaattaaccaaattaccaattcaaattttacccccaggttcagaaggtatcagacgagataattagagaaagtaaaaatatgctgtctcccatatatccataatgtgtcaaactcgacactaataat

SEQ ID NO: 581 - DNA, 269 bp, Homo sapiens
gtttggcaggcactgcctgctacttgagggccaggatgctcccccagggaagaaacggaatagtgtgggggtgtgtgcaggggctgcatcccgcagatgggctgggaatattaaaaattcttctatattgggctgggtaaattgccatggccctgagccactgagtatgttcattgccacccctgtccctcccctgggcacccctcactttccctgatcctgcaattaagggggtaatgtgggcatatggaggggactccacggagccc

SEQ ID NO: 582 - DNA, 274 bp, Homo sapiens
gaaattggctacaaccccgacacagtagcatttgtgccaatttctggttggaatggtgacacatgctggagccaagtgctaacatgccttggtttcaagggatggaaagtcacccgtaaggatggcaatgccagtggaaccacgctgcttgaggctctggactgcatctaccaccaacttgtccaactgacaagcccttgcgcctgcctctccaggatgtctacaaaattggtggtattggtactgttcccgtttgccgaggtggagacttgtg

SEQ ID NO: 583 - DNA, 255 bp, Homo sapiens
cttaggagtccgaggtgggtggatcacgaggtcaggagatccagcccatcctggccaacatggtgaaaccccatctctactaaaaatacaaaaattagccgggcgtggtgacacgtgcctttagtcccagctactcgggaggctgaggcaggagaatcacttgaaccttggaggcggaggttgcagttagctaagatcacgccacttcacttcagccttcggacagaccaagagtttattccccccaaaaaaaaa

SEQ ID NO: 584 - DNA, 320 bp, Homo sapiens
tgcgtctttccttgaatattttattggcccagagttagcctttctcaattatgtttccagactgtggccgtgattctaaaggaaaatgtgtgctctttagtgggtagaacaaatggaaatttggtttcagaatggctgacagaaatcgacataagtcatgtaatttttgttgatatatcatgaaaatgaacagaattctttttccatacttatatctaagaaaaggcatcataggttctgaaagagataactatataacagcttttaaactatccagtcaactttcagctttctccatttaggtaaatggtaggtataac

SEQ ID NO: 585 - DNA, 317 bp, Homo sapiens
gtactttgaaattgttatgggttcgttttccaaaatatgtaacttattttttaaaggaataaggtgtgctgtgtatttgttgattaaaaatcatttgtcttgcagagtatccttttttgaaggaaatatacatccttataacacatcaggtagttttcttttttctgtatttaaattatatatttcccttacttgactataatttccgttacatataattctatataccggttacatattgccttatggttctaatctgtttagggaagaatgaatttctaagcatttaatacatttgggtaattttgttctaaaag

SEQ ID NO: 586 - DNA, 309 bp, Homo sapiens
agtgcatcaacgggatacagttccatattgccttaaacctccttgttttagacacactaacatttataccaaattgcagattattctgcagagagggaattgcatgtttgtgttgtatatttagtatgaacttttttcagaatataatatttcttaggtatcaaaagtagttggaaaacatttgcaagactatgaacatagaattgctgcttttatattttaactgcagattgtgaatttcactgccttatattatttatttctgaaacaaaagaggcatttttcaataaaactactgaaaatttgaat

SEQ ID NO: 587 - DNA, 222 bp, Homo sapiens
caggtagctaaagatgacttaggtcaggagatcgagaccatcttggcaaacgtggtgaaaccccgttctctactaaaaatacaaaaaaaattagccaggcgtggtggcgggcacctgtagtcccagctacttgggaggctgaggcaggagaatggcaggaaccccgggggcggagctttcagttagcggacatcgcaccacttcactccagcctgggcaaca

SEQ ID NO: 588 - DNA, 113 bp, Homo sapiens
acagtgtctcactatgttgcccaaggtggcctcgaactcctgagctcaagtgatctgcccacctgagcctcccaaagtgctgggattacaggcatgagccactacggctagcc

SEQ ID NO: 589 - DNA, 217 bp, Homo sapiens
ctcgtgccgaattcggcacgaggtaagttgctattttcatcacagttgcctatgcccagggaataagatgtattctttataattgaattggtttttcccacgtctaactggaaacaaaacagaaggggcgtcataaatttgaataagcagaacatactgttctcaacatactgtaatcaaaggaggaatttcagtgggtctctgtgtgtgtatgaga

SEQ ID NO: 590 - DNA, 280 bp, Homo sapiens
  misc_feature 20, 62, 217, 222: n = A,T,C or G
gtaagttctaatcatttganaagttactaatgaatggaaaactatttttatataaactatcnagaggcttttcttctctttgttgttagaataacttctttaaactacatatttatcatattgtcatgtactaccatcagtgcttgtctttccctgtatcaaaatgaaaatgtgtgatatgatattttagaaattatgaagtactttttatatgaanttacntctttgttttatgaaatacgcaaggcagaaattatcattctcattttaagatttaaaa

SEQ ID NO: 591 - DNA, 600 bp, Homo sapiens
cctgtctctactaaaagtacagaattagccgggcgtggtggcgcatgcccataatcccagctactgaggagacttgaggtaggagaatcacttgaacctcagcggcggaggttgcagtgagtcgagatcgcgccagtgcactccagcctgggcaagaagagcgaaactgggtctcaagttaaaaaaagaaagcaaggaaagagtaatttacaacgaaggaaaaaaacccacagcacacccttcgcggctgtcagcgctctcctgatgtcacagtggctgcgtgtccttggggtgggtgaggtgtggggagcccagcccctggccctgcctcccgcgccccgctccccttctctctcttactcggttaagccatagcgaggcctccgctcgtttcagatatgaatttgttttatagattataaatatgcatatacagtgtatgtataaagcagaatgcctgcctttcctggttattttttgtaccatattgtaaattatattatttattctttaccaattttgggaataaaaggtgttttggttatttaatataataagagctgttaaacttctgtttaaatttccagttcaaccttgtaa

SEQ ID NO: 592 - DNA, 490 bp, Homo sapiens
cctgtctctactaaaagtacagaattagccgggcgtggtggcgcatgcccataatcccagctactgaggagacttgaggtaggagaatcacttgaacctcagcggcggaggttgcagtgagtcgagatcgcgccagtgcactccagcctgggcaagaagagcgaaactgggtctcaagttaaaaaaagaaagcaaggaaagagtaatttacaacgaaggaaaaaaacccacagcacacccttcgcggctgtcaagcgctctcctgatgtcacagtggctgcgtgtccttggggtgggtgaggtgtggggagcccagcccctggccctgcctcccgcgccccgctccccttctctctcttactcggttaagccatagcgaggcctccgctcgtttcagatatgaatttgttttatagattataaatatgcatatacagtgtatgtataaagcagaatgcctgcctttccctgggtaatttttgtaccatat

SEQ ID NO: 593 - DNA, 531 bp, Homo sapiens
cggatggagtccagcaggggagtgggaaagtgggcttgtgctgctgcctagacagtagggatgtaaaggcctgggagctagaccctccccaagcccatccatgcacattacttagctaacaattagggagactcgtaaggccaggccctgtgctgggcacatagctgtgatcacagcagacagggtcgctgccctgatggcgcttacattccagtgggtctaatgaccatatcttaggacacagatgtgcccagggaggtggtgtcactgcacaggaagtatgaggactttagtgtcctgagttcaaatcctgattcaggaactcacaaagctatgtgaccttacaccagtcacttaacttgttagccatccattatcgcatctgcaaaatggggattaagaatagaatcttggggttagtgtggagattagattaaatgtatgtaagacacttggcacaaaacctggcacatagtaaaggctcaataaaaacaagtgcctctcactgggctttgtcaacaaaaaaaaaaa

SEQ ID NO: 594 - DNA, 340 bp, Homo sapiens
ccaggctggagtgcagtggcgcgatcttggctcactgcaagctccgcctcctgggttcatgccattctcctgcctcagtctcccaagtacctgggatgacaggcgccttccaccacgcccggctaatttttaattttttgtatttttagtagagacagggtttcaccatgttagccaggatggtctcgatctcctgacgtcgtgatcagtccgcctcgtcctcccaaagtgctgggattacaggtgtgagccacttgcacccgaccgatactcacatttttaaactttttttttaattttattttggtagctaggtttatattggtcttaaatttattta

SEQ ID NO: 595 - DNA, 270 bp, Homo sapiens
cgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggcccgaggaggttccttgagttcccacccttgga

SEQ ID NO: 596 - DNA, 171 bp, Homo sapiens
taatatacctagggtgtataatatggtaaccctatgattaactttttttgagggaacccacctacacttttttcaccagcagcccattatcaatttttattaattcccaccgccaattgttattgaggggtttcccggttttttttcaaccttcatggacaaacaactttc

SEQ ID NO: 597 - DNA, 195 bp, Homo sapiens
aggtaattctacaagggcaagaagtacagcccctggacctgcggcctaagaagacacgtgccatgcgccgccggctcaacagcacgaggagaacctgaagaccaagaagcagcagcggaaggagcggctgtacccctgcggaagtacgcggtcaaggcctgtagggcgcattgtcataagcacacttgctgtgga

SEQ ID NO: 598 - DNA, 220 bp, Homo sapiens
cgacgagtcgggccctccatcgtccaccgcaaatgcttctaaacggactcagcagatgcgtagatttgctgcatgggttaattgagatagaatttgcccctgcaaatgcacacacctcatgctagcctcacgaaactggataagccttcgaaaagaaattgtccttgaagcttagtatctcgatatcaagcactggattatagacctgtgctgattagaa

SEQ ID NO: 599 - DNA, 240 bp, Homo sapiens
ctaacaggggccctctcagccctcctaatgacctccggcctagccatgtgatttcacttccactccataacgtcctcatactaggcctactaccaacacactaaccatataccatgatggcggcatgtaacaggggaagcacataccaaggcaccacacaccacctgtccaaaaggccttggtacggggtatcctatttattacctagaatttttttttcgcgagggttttcttgcgctt

SEQ ID NO: 600 - DNA, 115 bp, Homo sapiens
ggttgtgtctccattcctttctggaggtgccagccagtgaccacaatagtggaggtctttatacattttggcctgtttatccctagaagtagttggaaatttatatctcactaca

SEQ ID NO: 601 - DNA, 145 bp, Homo sapiens
aacgagtccattccggctaacacggtgaaactctactccacaaatacaaaaatagattagccggtcgagggggcgctagccttaagttccaacacacaaggaggcagagctagggaacgttttaccacgaaggcggagattccat

SEQ ID NO: 602 - DNA, 160 bp, Homo sapiens
tgtctgccctcccagccacccaaggtaagttgtgaaggcaccaacacagttatatttaaagaaatattcaagtgcatcagagagagtcttggatgaagggaggagtcctcccgcagggtcttggtcacctaggcaaaaccccagaagcaacccatttaag

SEQ ID NO: 603 - DNA, 235 bp, Homo sapiens
ttgagggtgaggccctcacttcatccggcgactagcaccgcgtccggcagcgccagccctacactcgcccgcgccatggcctctgtctccgagctcgcctgcatctactcggccctcattcttcacgacgatgaggtgacagttacggaggataagatcaatgccctcataaagcagccggtgttaatgttgaccctttttggcctgcttgtttgcaaaggccttgccaacgtaa

SEQ ID NO: 604 - DNA, 135 bp, Homo sapiens
ggatacgcgctatttacttatcagcacaaggagagagcaccatcttaagggtgttgcaaggatcgaaaaattttcgagtccaggaaggtcatgtaatcgacttcagaagtatgcgcgtataataatagaattttc

SEQ ID NO: 605 - DNA, 295 bp, Homo sapiens
agaagttctacagatggatggtggtgctggtcgtacaacagtgtgaacatacttaaactgaactgtacacctagaaatggttacagtggtaaaattttgttatattttgctataataaaaaatgcaactgatacatccaaggaataagactgaacaattcatgatcataaagcaactctatttttcttctcattgtctctctaggcctttttttgtgggctacttcctcccctgcccctgggtgaaatctcatagcttccatggtgtttctagagattgttatataataagagag

SEQ ID NO: 606 - DNA, 285 bp, Homo sapiens
aagaagctcatcactgatgagtttgtgaagcagaagtacctggactatgccagagtccccaatagcaatccccctgaatatgagttcttctggggcctgcgctcttactatgagaccagcaagatgaaagtcctcagtttgcctgcaaggtacaaaagaaggatcccaaggattgggcagctcagtaccgagaggcgatggaagccgatttgaaggctgcagctgaggctgcagcttgaagccaaggctagggcccagattagagctctcattggcatttggctc

SEQ ID NO: 607 - DNA, 284 bp, Homo sapiens
caaagagtaatgcctttgctaatcactattatgcacttaagaggaagccagtgggtatttttcccttcatagctttctagtacaaattaataaaatttagaaaattagaaaatgattgtgcataaatgtgtataatcatgtatctgttagggggcaaaaattagttggggaattatctttctttgataagtcttatcataagtttgaaaatggggcattggcaattcaatctgtttggctgggtgtcctcagaacaatcccagtcaattctgttttgcaactct

SEQ ID NO: 608 - DNA, 249 bp, Homo sapiens
ataaaatttatattaagtaaacgcagtcattttaacaattaggcaacaatcatcccagctttcagaaattgcctttttttggaattcttatagcacgaaattatctccaagacttgtgctaccattagtatatgtgtatatattggatgtatatattcttttcctcctgtaaggcccattagggctatgacattgtcattgctgctcattctacaaataggtgttgctactgagaaaggggggctgccc

SEQ ID NO: 609 - DNA, 284 bp, Homo sapiens
ctggtgtcaagcctcacctccagaatccagtactgcctcctacctcattagaattgttttcactgtgtgtcaacatgatcattcctctgttttaacaagggaataaacttaatgaacttcaacttcaggggattttttttttaaatgcaatttgagggccgggcgcggtggctcacggctgtaatcccagcactttgggaagccgaggcgggcggatcaggaggtcaagagatcgagaccattctggctaacaattgagagacccctctgctacctaaatataa

SEQ ID NO: 610 - DNA, 259 bp, Homo sapiens
tttttttttacataaattaacccatttattataggccagtgatgtctcaaagagtagaggagcgtctactggtctttcaactccttcagtcttctgatggcggactttaccgtgacaacggaagtggtattgtacggccaggcaccgccagccactgtccttcatgcagggaccacagttccagattcccacagcttgtcttttcatcttgggttttgcacacagagaggcaaggtaatcctgggggtctggctgatta

SEQ ID NO: 611 - DNA, 214 bp, Homo sapiens
cggaagtgaaattctattttatcatcccaaaagcaacatggagagtttcaatacttttgctaaccggatgaaaaatattggcgtcatgaattatttaaaggtctccttacaacatgcattaatacctgctgcatcatgggaatgcttaaaggtgctaaggaaatctgagtgaggccagagactaggagacaattgtagaaataccgtccttccc

SEQ ID NO: 612 - DNA, 225 bp, Homo sapiens
gccaccatgcctggctaattttttgtatttttagtagagacaggggtttcactatgttggctaggctggtcttgaactcctgacctcgtgatccacccgccttggcctcccaaagtgctgggattacaggcatgagccaccgcacctggccttccctgcttctctctagaatccaattagggatggttgttactactcatattgattaaaccagagtaacaaacc

SEQ ID NO: 613 - DNA, 238 bp, Homo sapiens
ctcgtgccgaattcggcacgagctcccctctctttctaagagacctgaactgggcagactgcaaaataaaatctcggtgttctattaatttattgtcttcctgtaaggtccctcgggtcaaggcagaggcaggaaactaacttgtgtgagtcaaatgccccctgaggtgactgcccccaggcccaggccaagagggctccctcaagtgtccgagcgaggaccttgttgtccatacaca

SEQ ID NO: 614 - DNA, 328 bp, Homo sapiens
ggaattcatatctaatgctgacatatgtaaaaccaaaagaatcttaacagaagaaaggagcagcagaatgctataacctcagctttagtccttaacattactctaaatttcctgtttgttcagtatttctggcttttattattaatatctttgttagcttacctgtctctgagtgtcctggggcctaaataaggatataggtttcccttaagcctccctttgatgagatgacccagggtttcatgtaggaaaggttgacgctgtgtatatacatttcctaccccctaacacaggggaaatggctccttatgtcatttttggggaattt

SEQ ID NO: 615 - DNA, 129 bp, Homo sapiens
tggagaaaaacattccaacgttattgtgcagaattcattaaacatttaacaacagataggtgatagttggggaatggagaccattaaaaggactgttctgactggcttacattgtgcaaaattcacttt

SEQ ID NO: 616 - DNA, 194 bp, Homo sapiens
caaacagacatcaatcaaatacatgtaaggtgtacatcgattctgccgggaaaggcggtacaacctgaggtgggaaggggggcccaagtgtgtatccagctgcctgagaaggccgtgccaggttacatggccagcaccctagttcaggttcttgccacatgccttgtcttcttgtttaagcatgctttctgacc

SEQ ID NO: 617 - DNA, 179 bp, Homo sapiens
ttgatgcacaatattagacattatttgtaaaccatctatctccaagggattactatccagactatataaagaactgtaactcaacaacaaaaacaactcaattgaaaaacgggtaacggcctagaattgacacaatctccaaagtaggatatataacttggctcacaagcatatgaaaa

SEQ ID NO: 618 - DNA, 138 bp, Homo sapiens
cttgtttagcatatcatgaagaattaaccacaaaaatgggccaagccagccagccccttgggggcctgcatcctgccctatgggaggtaggccaatgctggtttaatctccctccaccatgtgctaaaatgaaacact

SEQ ID NO: 619 - DNA, 325 bp, Homo sapiens
gcaggatcaaggtgaaaaggagaaccccatgcgggaacttcgcatccgcaaactctgtctcaacatctgtgttgggggagagtggagacagactgacgcgagcagccaaggtgttggagcagctcacagggcagacccctgtgttttccaaagctagatacactgtcagatcccttggcatccggagaaatgaaaagattgctgtccactgcacagttcgaggggcccaaggtagaagaaatcttggagaagggtctaaaggtgcgggagttttatttaggaaaaacaccttctcagaatctggaacctttgttctgggtccagg

SEQ ID NO: 620 - DNA, 254 bp, Homo sapiens
cactggctcgaaaaaaaaaaggcaatataaattggctctgatttatgctacagaggagagggttggggcgctctgtgggcctgtgataggaaggtttgccaattggagttcgtaggcaaagaggaaggaaggagcattccaggcagatggagtagcaagttcagagggagcattggggcaggctgggttggtggacacagagcaggcacttcgggagctttgagttgcatggtagaggagatgtgtgtgtgttt

SEQ ID NO: 621 - DNA, 333 bp, Homo sapiens
gcagcaatggccaagatcaaggctcgagatcttcgcgggaagaagaaggaggagctgctgaaacagctggacgacctgaaggtggagctgtcccagctgcgcgtcgccaaagtacaggcggtgcggcctccaagctctctaagatccgagtcgtccggaaatccattgcccgtgttctcaaagttatttaccagagcttaggagagaaacctcaggggatttctacaaggccaagaaggtacaagcccctggacccttcggcttaagaggacacgttccatgcgccgccgctttaacaagcgcggaggagacctgaggcgccagagcagcacg

SEQ ID NO: 622 - DNA, 321 bp, Homo sapiens
gccaaaatcatgccgcttcactccagcctggacaacagagtgagactctgcctcaaaaaaagaaagaaagaaagaaattggagtcctcatacgttgctggcaggaatgtaaaatagtccagccactgtgggaaatagtttggtatttcctcaaaaaggttaaacagagtcaccatatgagccacacagttccacttcctaagtatatatcccaagagaaatgaaaatacatggtttacacaaacacttggtacacaawatattttataggtgsmvttwtytacaattagccacaaaggtgggaaatgtggtggggccacaa

SEQ ID NO: 623 - DNA, 160 bp, Homo sapiens
cttgaacctgggaggcaaaggtttgcagtgaactgagattgcgccaccgcactccagccttgggcgacagagcggagacttcatctttaaaaaaaaacaagacgggccggcacggttggctcaaggctcttattcccaggcacttgagaaggccagttca

SEQ ID NO: 624 - DNA, 286 bp, Homo sapiens
tccactccctcagtaaataagtcaaaattgttaacccatgtgcccattcctgagtagggcagactcttcacaagaggcccatgacaagaattctagggtccagattgaactttaatatagacctttgtctgtgtagaccagtttgtcttgtaaactgtcttacttatgtggtgtaaacattatacattcacatgaaaagttattttcctttatataattggattcaggatcataagggcaggctgaaattaattctacagtaccagtaggataaggatcggccggc

SEQ ID NO: 625 - DNA, 207 bp, Homo sapiens
gtaattgtattaattatttaaagtgtggaaagcaaaatacaaaaaagagaaacgccaacaaaaatcagcagatgttgaagacaggggtctcgggggtgggctccggcacccacatcctggagtcaggactttcctcagtgactgtgtgtaggggggtttcaaggctgaacctcaacctccttccaccttcctccacctaactgtcga

SEQ ID NO: 626 - DNA, 162 bp, Homo sapiens
catgcctgtaatcccatcatgctgactacgagggagggctgtagggcaagggagaatttggctttgtaatccccagggagggacgggagggtttgccagtgaagcccagggatttgcttgcccattggcaactcgccaggcctcgggcaaacaaggaaccaa

SEQ ID NO: 627 - DNA, 159 bp, Homo sapiens
ttttattttattatttttagagacagggtcttgctttgtcactcacctggaatgtagtggtgcaatcatagctcacggtaaccctgacctcctgggctaaagcgcccctcccatatcaacttccctaagtagctgggcctattatgtagtaatataagt

SEQ ID NO: 628 - DNA, 154 bp, Homo sapiens
gcagccccatgctacgtgattctttatgttgtgttgttttgttttgtaaattgtataatttttaaatatctgagttttaaaaaaagaaaaaagtgacaaaaaattcttgttatgggccttaaggagggtttagtggcatctttcaggggtcact

SEQ ID NO: 629 - DNA, 202 bp, Homo sapiens
ctcgtgccgaattcggcacgagctagcatctgctcagtttctggggaggactcagggagttttattttatggtggaaggcaaaatggggacagactaattgttaaacatattaaaatttgttcatctacactggcaagccctttcgtttagtttacctattctgaaaaactgatttcttttttattctgacattcattgcat

SEQ ID NO: 630 - DNA, 219 bp, Homo sapiens
aaaagtaccagctctggctggggtccgtgaagcccaggccaggcagccaaatcttgcctgtgctgggcatacaaccctctgctttcacatctctgagctatatcctcattagtgaggtggcttttgcctttatagtttggctggggagcacttaattcttcccatttcaaaaggtaatgttgccctgggcttaacccacctcccctttggcaaggttgg

SEQ ID NO: 631 - DNA, 200 bp, Homo sapiens
gaaccttttccatttttttttcctttattctcagcaaacagcaattccactgccagagaggtagtttcctcttttctgcaccatgcagctccctgtcaaccagcttatatacagcggtttccccttgtgtctcctgtgttaagctctaagcaccttgaggccgggcctcacactctggtcagtcctgtctgaagcggcat

SEQ ID NO: 632 - DNA, 200 bp, Homo sapiens
agcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacaaacaatgcttcccctttcctgagtcccaatcc

SEQ ID NO: 633 - DNA, 153 bp, Homo sapiens
caagctactgactgtaagaaaatgttttaaaatcatttctccagcaagggactcgtgtacagaatatataaagaaccttccaaactctataatacaaaacaaacatactcagtttaaaaagaggcaagagacttggaccaaaataaggcacat

SEQ ID NO: 634 - DNA, 184 bp, Homo sapiens
gggtggctcatgcctgtaataccagcacttttggaggcccaggcaggccggatcacaaaggtcaggcgatcaagacccatcttgccaacatgggtgaaaccccctctctaccccaaaataccaaaacttaggctcggcgctggttgcaccccccctctaattccccctcctccggggggtttag

SEQ ID NO: 635 - DNA, 148 bp, Homo sapiens
ctggatttcaaatttttgaattagggatgctgaactggtaaatataatgagaatattttaaaatatgaaaaatctgaaagctgtaaccacttctggtcctgagccatttctggataaggggatactcaactctgtactcggacaatct

SEQ ID NO: 636 - DNA, 284 bp, Homo sapiens
ggcaaaaataagggaggaatatttcaggtagagggaatagcttgtgcaaaggccctgtggcaagagaaaataaagtgagatcaagaatagaaagaaggccaatgtgactggagatgagtaagtaagggggagaaagcacaaggtggctccagaagatggaagcaggttcctaatcttacttctttggtcaggttaccaaggtattttggtttccattctaaggactatcatgattcatttaaagagtgttaacgttaaggggtgacatccatttaaattkatct

SEQ ID NO: 637 - DNA, 235 bp, Homo sapiens
tttagttattgtgaaatttgttttctatgctagtaattcagtttggcatattagaagaatttcttatgtataaaaagaaactgttgcctcctacaaaaaaaagtaattttcaaaattcttaaataattttgaaaatggtgcccggatactagtgatgtaaatagtccaaaggttagacacgtgaaagcgagaaagggactatctaactagcccgaagagaagtagctgaaaaaac

SEQ ID NO: 638 - DNA, 124 bp, Homo sapiens
cctgtctgtactaaaaatacaaaaattagccaggcatggtggcacggacctttagttccagctactggtggggggctgaggcaggagaatttctttaacccaggtggtggatctcaaaaaaaaa

SEQ ID NO: 639 - DNA, 156 bp, Homo sapiens
gttttcttcattcgaagacgctaaagaagctttaaattccttgtaataaaaaggggaatttgaggggcagagcaattcaagctctgagtttgtcaaagaccccacgggggttcaactcaatattccaaaaggccagccattcccaaaatactattt

SEQ ID NO: 640 - DNA, 128 bp, Homo sapiens
gtgaccaggtgtcagctgtgacgtattatcattgcctgcacctgtgcaactttggatgttattgggcatggcggtgacttggttaggctggtacttccttggcttttccaggttaataaaataaattt

SEQ ID NO: 641 - DNA, 153 bp, Homo sapiens
gcccagaggaaactggctggagcctggaccagctggggctgatgcttttgcagtggtcatgtgattgtgaccttgtagctacttatcagagagccagaccctcctgtcctgggagacaagagccatgcctcaaggatcaagcccaatgttcta

SEQ ID NO: 642 - DNA, 114 bp, Homo sapiens
ctcgtgccgaattcggcacgagaaggtggctctgctcactgtggcaattctcaaagaggaatgagagctgagggctgtcgggctcaaggcaaccccaaacaagttgggaggaag

SEQ ID NO: 643 - DNA, 121 bp, Homo sapiens
ttaaccaggatggcctgttaaaaatgcagagagctggcagagtgaacagtaaatgttttaattcgctgtgtcatttgcccttagctaggctgtttcacctgccggctcattgtgttgctat

SEQ ID NO: 644 - DNA, 170 bp, Homo sapiens
gtaatatcctgccacctggaaggcctccttaaacttattgtaggcagtaatcacatcttgagtggttagatgccaggacaacatgttaggactttaatggacatatgactcttgtcctcatggggcttatggttttctgcatagttatttcataaacaggtgtttctgtt

SEQ ID NO: 645 - DNA, 245 bp, Homo sapiens
ttgatggctggtaaatcagatgctttttactcactttcctgcctaagagcaggggtttttaaaaatcaagcacaggtaggtaggtatatataaatgcctttattatcccctatgagaaaagagctgtttccctatttaaagattccccttaagctgttatcacttcttgactgatgggctttcttgttccaaatatgggtctgatcattagcagtctgcattgtcatctttgccttggattgaga

SEQ ID NO: 646 - DNA, 307 bp, Homo sapiens
gaattatgaaatttttaatacaaaaaataatccatttaggtgctgagttacggtcccatctcttcacaggcatggattctaatcccactgctgacagagatgtaaaaattcatcctaccagagtttttaatctttagcatttagggaggcagtgtcataaagtaaaaagtgtgtggccttggagtctaagagacgtggttgcaaacttagctcttggttattgcaattagggccttgcaccaggtcattttcttcacattctcatctgtaaatggagatatacctacagatattgcagattaatacc

SEQ ID NO: 647 - DNA, 308 bp, Homo sapiens
ctcgtccattttagggcaaaaaccaatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggatgttgtagttacctactgagtaggcggcgatttttgtatgttatgacatgcagttcattattatgtggtctatttacttgtactgtg

SEQ ID NO: 648 - DNA, 311 bp, Homo sapiens
ctgtctccagtgggcgtcttgggccccgctctattctgggctgcgggcctgggaagggctcgccgggtgccaaatgagctgtcctaactctgcggggctgcagcttcctgcatgatgctggggagcttggcgcctgacccaggatctagaaggcactctgggcaggccgcgctccgcccacgaaggtttaaccaccaaggactctgagagctggcaggtcttagtaaccctggtaacaattctcttcaccttatcaaaacctgagctaaaaccaatgcatcagctgatgatgacagcagaaagtggcaggg

SEQ ID NO: 649 - DNA, 139 bp, Homo sapiens
cacggttgtgtctccattcctttctggaggtgccagccagtgaccacaatagtggaggtctttatacattttggcctgtttatccctagaagtagtttggaaaattttatatcctcactacattttttttttttttttt

SEQ ID NO: 650 - DNA, 380 bp, Homo sapiens
cagcgctgccccctgctggctgtgtgacctgtgcacaaggattacgcgctgttttacttctccagctacaaaggagagagcacctacttcatagggttgttgcaaggatcgaaaaataatgtcgaagtcccaggaagttccatgtgataccgcctctcagatgttagctgctgttttaattatagttatttgctggcacacagctccctgtaggcttcataactgtcaaaatgtgagcagaggcggggtgcagtggctcacgcctgtaatcccagcactttgagaggccgaggcaggaggatcacttgagctcaggagttccagaccagcctgggcaacatggtagaccctgtctccaccaaaaatattaaaatctgtag

SEQ ID NO: 651 - DNA, 399 bp, Homo sapiens
caaacagacatcaatcaaatacatgtaaggtgtacatcgattctgccgggaaaggcggtacaacctgaggtgggaggggggcccaagtgtgtatccagctgcctggaaggccgtgccaggttacatggccagcaccctagctcaggctctttccacattccttgtcttctgtttaagcatgctttctacctctaggccctttttgttgcatcacttctgctgtgatttgaatgtttgtcccctacaaaattcgtgttgaaacttaatccccaatgtgacagtcttgaaagatgggatgtttaacaagtgattgggtcttgagggctctgccctcatgaatacattaatccattaataggtcaattaattatcatgggagtcatactggtggcttcaaaa

SEQ ID NO: 652 - DNA, 406 bp, Homo sapiens
catgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaataattccaacgggggaaaaaaaaaaaaaaaaaaa

SEQ ID NO: 653 - DNA, 309 bp, Homo sapiens
gttccctgcacaaaatgcccggcgacgaccaagaaaaccgtccctgctacagagcaggagttgccgcagccccaggctgagacagggtctggaacagaatctgacagtgatgaatcagtaccagagcttgaagaccaggattccacccaggcaaccacacaacaggcccagctggcggcagagctgacattgatgagacccagtcagtaaagcaaaacagagtcggagtgaaaagaaggcacgaaggctatgtccaactggtcttcggcagttacaggagttactagagtcactatccggaaatctaag

SEQ ID NO: 654 - DNA, 120 bp, Homo sapiens
caagctacgcctctaggcttcatgccattagcctgcctcagactccagagtagctgggactacaggcacctcccactgtccctagctaattttagtatattttgagtagagtatgagggt

SEQ ID NO: 655 - DNA, 306 bp, Homo sapiens
gctatgtctccttatgtattactcaatactgttttgcagagaaaacatttttcaagcatgtgcttcctgaagacacctcagtctttgggccatttgatttccaatacatagggtggaggaatgtgattttggggctgaccataaactggaaatttgtgaaatggcagttattgggcaatcttcagtttattttttcagttgaagtggactcatttctggaatggatttaataggctgtgtctaatgtacaaactgggtgagtcctgccttagtgtgtcctgccccaccggtacggttccaggatac

SEQ ID NO: 656 - DNA, 310 bp, Homo sapiens
cagccaaggcggcccaagccagtgacctggaaaaaatccacctggatgagaagtctttccgttggttgcacaacgaggaccagatggctgtggagaagctctctgacgggatccgcaagtttgccgctgatgcagtaagctggagcggatctgacagaacgaatgttcaatgcagagaatggaaagtagcgcatccctaaggctggactccagatctgcaccgccggccagctggatctgactcacgtggcttctgatgaatctgcgtttttacaaattgagcaggacagatcatagattctgatttatg

SEQ ID NO: 657 - DNA, 275 bp, Homo sapiens
cttgaaggagtggctaaggttggacaattacacgttcactgcagctgctgtcggggccgtgtttggcctcaccacctgcatcagcgcccatgtccgcgagaagcccgacgaccccctgaactacttcctcggtggctgcgcggagctgaactctgggagcacgcacgcacaactacgggattggcgccgcgcctgcgtgtactttggcatagcggcctccttggtcaagatgggccgcctggagggctgggaggtttttacaaacccaaggtgtg

SEQ ID NO: 658 - DNA, 270 bp, Homo sapiens
ccggcaccagcaaggacggccaggacggtgctcccggcgagcctgggcctcccggagatcctgggcttccaggtgccatttgggcccaggggacaccggggatctgcgacacctcagcctgccaaggagccgtgttaggaggggtcggggagaaatcaggctctcgaagctcataaaattcaccgtgaggaggcaagtgacaaaggacgcccgaagcacaattggacggtcattaaggagccggggttttgcagcgggtgacgtccagag

SEQ ID NO: 659 - DNA, 280 bp, Homo sapiens
tgaccatctgccaaaccagatgcaggcagaaacctgctagttagctgaacatacgaagcagattattctcactgttctgggtcaaagccaccagctaataaatccagttggtatacccacaaataaaaactcactgtaaattaggggctaccagtggagactgtgtcccagaaatcaatagagatttctgacatcaagtctccatgcactggccatgctcaaagtcaggtgctgtgtcagcttcatgggtctgcgtactccaccagcttgggaggaggat

SEQ ID NO: 660 - DNA, 185 bp, Homo sapiens
ggactgtttagtgtgttcccctttgtgggtgggttcctatgatacttattatagaacacagtggatcctttttgaatgttccgtggaaggcccaggagttcctcgtgaacccaggatactgcagctttattaaagttaaagaaactgtaacatatctcttatatattaccaccgtttaacgtttt

SEQ ID NO: 661 - DNA, 250 bp, Homo sapiens
gaagaaataacagtcaggttgttggagtccctgaagaagaaaaacaaaataatatgttaaaactgagaaaccaaatagtagaaggttagatttaaaaacagagaactggctgggtgtgatggctcatacttgtaatccagcagtttgggaggctgaggcaggcgagtcacacagtcaggagttcgagaccagcctgtccaatatggtgaaaccccgtttctactgaaaaatacaaaaattggccaggcac

SEQ ID NO: 662 - DNA, 315 bp, Homo sapiens
agctcaccagggcctacatggcctttattttctgcactataaaaggaaaaaggattagaaggataatagttacatttgatattaagtaaaattttggtatgcattgtattaagggatgtaaagtaagagaaattgtgtattatcaaatgacaaagacctgatcagccttgagtaaggggctcaggaggcagtagtactagcatcttaggagtagaggagtcctgtgggataagtaaaagtatgtctttggtttgataacagtgagagctattaattttagaaagtcgagttactttgtatgtagcaatacaagga

SEQ ID NO: 663 - DNA, 325 bp, Homo sapiens
ggtgaagcaggcaggtcaggtccaccactgacacgttggcagtggggacacggaaggccatgcagttagcttccgttcagctcagggatgaccttgcccacagccttggcagcgcagtagaggcagggatgatgttctggagagccccgcgcccatcacctcgtgccgaattcggcagaccaggccatcaggtaagccaagatgggtgcatacaagtacatccaggagctatggagaaagaagcagtcttatgtcatgcgctttctctgaggctcgctgctggcagtaccgcagctctctgctctcacagggctcccgcccaccg

SEQ ID NO: 664 - DNA, 365 bp, Homo sapiens
gctttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagttacattccttcactccttttcctacccaagggggaagactggagcctaagctgcctgctactgggctttacatggtgacagacatttccgtgggatagggagatagcaggaagaaaggtaaactcatagagtgtcattcactgggtttgatattggcttagctgccagtctccatttgtgactatgccatccatctataatggagg

SEQ ID NO: 665 - DNA, 294 bp, Homo sapiens
gcagactgtgagtcaattaaccgtcctttttataaattactcagtctcaggtagttctttacagcagtgtgagaatggactaatacacttaccaccagcacaaagctagtaagtggtggaattgggatacgtaataataatgctaataactcacacctgtaatcccagcactttgagaggccaaggcaggtggatcacaaggtcaggagttcaagaccagcctggccaagatggtgaaccccatctctactaaaatacaaaaatgagccggatgtggtccgtgcttaatccccc

SEQ ID NO: 666 - DNA, 270 bp, Homo sapiens
agatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttcttcataagcatgatttggatcttatatgtagagcccatcagggattgattttgaattttacatgta

SEQ ID NO: 667 - DNA, 295 bp, Homo sapiens
cggcacgagcttatcttttagcgtgtaaatcagatcatattcctcccctcactaaacgaacaaaccagccagaaaactctttaactccttcctttaataaaatccaggcctggcgcaatggctctcgcctgtaatcccagcactttgggggcccgaggtgggtggatcatttgaggtcaagagttcgagaccagcctggccaacatggtgaaaccctgcctctacttaaaatacaaaaacaaattagccgggcgtggtggcagctcctgtagtcgctacttggggggttaggcag

SEQ ID NO: 668 - DNA, 255 bp, Homo sapiens
ctggttcctgcagccattgaaaaacctttttccttgcaaattataatgtttttgatagatttttatcaactgtgggaaaccaaacacaaagctgataacctttcttaaaaacgacccagtcacagtaaagaagacacaagacggccggccgtggtagctcacgcctgtaatcccagcactttgggaggccgaggcgggcggatcacaagggcaggagatcgagaccatcctggttaacacggtgaaaccccgact

SEQ ID NO: 669 - DNA, 150 bp, Homo sapiens
attcgttgcctcaatcttgtctcaggatcagtctgggttctgggttcttctttttctttttttttttttgacggggttcggttctctcgcccagcctggagtccagtggtcccatctcagctcactgcaagctcccccttcccgggttaa

SEQ ID NO: 670 - DNA, 245 bp, Homo sapiens
gttgagtggatccccaacaatgtgaaaacggctgtctgtgacatcccacctcggggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggggtccgagtacc

SEQ ID NO: 671 - DNA, 155 bp, Homo sapiens
cagaagtagaccttccagagccccagtttgtaaatgaacctgtgtcacatttgataaacactatcctgggcgcccccgggccacccgccgagtgacgccaaagccctggttgactcttacagccccgtgggtgtgtgggaggccggccgttctgg

SEQ ID NO: 672 - DNA, 270 bp, Homo sapiens
gaacacagtttgggaaactttttgttcatttgttttaataagataccttaggtagctatttccttagaacacgagccgggtgcagtggctcacgcctgtaatcccagcactttgggaggcccaggcggcggatcacctgaggtcaggagatcgagatcatccggcccaacatggtgaaaccccgtctctactaaaaggacaaatattagccagccatggtggcaggcacctttagtcctagctactgtggaggctgaggcagggaattca

SEQ ID NO: 673 - DNA, 185 bp, Homo sapiens
caaaacagaccaggcacagaaagctgaaggttgctggagatgccaagtgaagtgtgtgcatttttggataactgtgtacttctggtgactgtacagtttgaaatactattttttatcaggttttataaaaatgcagagttttgttttacttttttttttttttaaaaggctatgttgtgggccac

SEQ ID NO: 674 - DNA, 228 bp, Homo sapiens
tggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctctaagatagaggatttcttagagagacgcctgcagacccaggtcttcaagcttgggct

SEQ ID NO: 675 - DNA, 252 bp, Homo sapiens
cttttgctgaggagagctttacttccaactatgtggtcaattttgggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaattctcccattattaatgtgtgggagtctaagtctct

SEQ ID NO: 676 - DNA, 259 bp, Homo sapiens
cgaaatgatttctttacgtcatgtattggtttccttcttcaccttgaacttttgttgaactgtatgtactttaccccaaacctgttaatattttgagcgcttctatgtgaaagcaaagaaataattttaatactctggcattcataaattttattgatgagattatttattttaaaggtttgaggtaacatctctggttgtaccaaaggaggaaataaatatggtttcttaatctcttgcatgttttcttataaataat

SEQ ID NO: 677 - DNA, 208 bp, Homo sapiens
agtagctacacagtccggccgtggtgcagtaaaggcggatcagcagaggttgaggtcgatggggcaggaccaaggtccagagaggaagcacaggggtatgactcccaggtgcagggaattgccagagctgtcttgagctccaagtacaacacttctcatctagccagcgaacgtggatgtcggtgttggctgctgaaaaacagtcaat

SEQ ID NO: 678 - DNA, 198 bp, Homo sapiens
cttggactggagcagaaggctgagaacaggaaggggctggtccctggtactagttttggttttttggtggtttttttttttcttgttttttctcacagaacagggcaaagctgagtgtccctggatgagttaagcaggaggattaatcatgcccagtgcttctccactttaaactggttttcctgggaatttgcaatt

SEQ ID NO: 679 - DNA, 257 bp, Homo sapiens
gttttcgagaaaaatgtcttcaacaagaccagccggactgagagtgagattgcattttttgggggtatgaccatcgtctacaagaacagcattgacctcttcctatacgtggtgggctcatcctacgagaatgagctgatgctcatgtctgttctcacctgcctgtttgagtctctgaaccacatgttaaggaagaacgtggagaagcgctggttgcctggagaacatggacggagccttcttggtgctggacgaga

SEQ ID NO: 680 - DNA, 227 bp, Homo sapiens
ggctgaccagatgggaaaatgcaccccctcaggcaggtggccaattagaaaaatatgtccttttggcagctgcagccctggggttaatatgtgagacttggcaagttagagcctgggcaggatctcagatccactcccactcccgggatctggcatccaagtgtctgacacagccatacgtggcagtgggtgtaggagcctgcctggggtgctgacccactggacct

SEQ ID NO: 681 - DNA, 195 bp, Homo sapiens
ctcgtgccgaatcatcagagaattgcaaatcaaaaccacagtgagctatcatctcaccccaattagaatggctatcatcaaaagacccaaaaaataaatgctggggaaaatgtggataaacggaaactcttacatacattgtttgtggatgtaaggtagtatagttattatggaaaagagtatgaaggttcctca

SEQ ID NO: 682 - DNA, 145 bp, Homo sapiens
ttaagtcatataatgtccatccagcattaaaggttgcacttattgaccctaaaactggcgattctgcaaccaagcaccttaaacaagcaggtctctattttaggtaacattgaaaatttaaagttacttggtccaaggagatgct

SEQ ID NO: 683 - DNA, 125 bp, Homo sapiens
cgtgcgattcgcagagcacttggtttgctttgcgttggcatttagtatagttttaaatcagtactctatggaacaactgccaaaattgtacgaatttgaggccattaaaaggtaatggaaaaaaa

SEQ ID NO: 684 - DNA, 235 bp, Homo sapiens
aatagttactgaaatgacgagacctgtttgcacagcattaataagaaccttgataagaaccatattctgttgacaagccagctcacagtttcttgcctgaagcttggtgcaccctccagtagacacaagatctctcttttaccaaagttgagaccagagctggtggattaattaatagcttcgatatctggccatgggtacctcattgtacctatcatcagaatggcagagatga

SEQ ID NO: 685 - DNA, 130 bp, Homo sapiens
ctgacctccttgaataataccctggccaacatacgtttggattctgtttctctcaggcatgccaccaaggatttgcatggaggtcgaggttagcacttgaagtagccactttatcaagtcatttatggag

SEQ ID NO: 686 - DNA, 220 bp, Homo sapiens
tgatgcgtgatagcttaagcttggggagaaggtcttttccactgcctagctaagcagtctgggagagcatggggatcatttctatgtgtgttggtaatctggtcagtaaggttgagacttaggttaaggttcccctggaaattccttaattgtttattagctctacctaggtgtggtaggccgatgccagatttggagatttgagttctcttacatggct

SEQ ID NO: 687 - DNA, 165 bp, Homo sapiens
gttttgtcttgcgggtctgtcagggttggaaagtccaagccgtaggacccagtttcctttcttagctgatgtctttggcagaacaccgtggctgttacttgctttgaggtggaggcggttgcatttacgcctgtaaatgtaatcaatcctaaataagtgtagggt

SEQ ID NO: 688 - DNA, 108 bp, Homo sapiens
gacctctcccaggagcaagcccctggatgcccagacagggcccccccgacctgcaacacgagtctctctaagcaaggttaattcgaaggcccaaggatgaacgctatt

SEQ ID NO: 689 - DNA, 170 bp, Homo sapiens
ccaatatctactggctgtgtgacctggagcaggtcccctaacttctccaggcttttgtttccttatgtgaaaatgggatgagcaacacctggatcttgctatcttttggactactgacccagtacttttggatggaatatacttactattttaaaaaattcaaggcaggt

SEQ ID NO: 690 - DNA, 164 bp, Homo sapiens
gaaaacctgaagcctttcctcttatatgtggacatgacagggatacccacttttaccaccattattcaacttgattactggaggtcttaggctacagcaatcaaagggaagaaataaggggatcccaacccgaagggaggaagttgaattatccctgtttgcag

SEQ ID NO: 691 - DNA, 270 bp, Homo sapiens
cttaaggttacttttatattactctggaatcaagtattttaaattgtatttttttttaaatgatctctcagcaataattgtttgaaactatccatatataaggttatcagacctacagttccctaagaggaactgcatgttctcttcaatcagaatatacagtagaagcaggtatatcttccatgcagtttcagtagtaagcactacttatacctacataagagttaaaatccagatgtgggaccttttgataccatcagtgatatatat

SEQ ID NO: 692 - DNA, 200 bp, Homo sapiens
agcatcttggagagttttgtggggtgctggcatccatcaaccaacaaaataccaaaatgactctaggtaattataagtgaagcaaaaccactgggcagggatgataacaggcactgtactttacaggagtcagcgtatcacaatcgcatgctcgggactatgttcagccactaaacctttaggtttcatgagggccaggg

SEQ ID NO: 693 - DNA, 161 bp, Homo sapiens
gtgaagagaagtgaaatgttgtgcctgacactgtaacactgtaaggattgttccaaatactagttgcactgctctgtttataattgttaatattaggacaaccagtagacaaatgcagcagcaagtcaattgttattagcagatattgtcctcattgcatg

SEQ ID NO: 694 - DNA, 180 bp, Homo sapiens
ccgaactgatataacctaccctgctggattcatggatgtcatcagcattgacaagacgggagagaatttccgtctgatctatgacaccaagggtcgctttgctgtacatcgtattacacctgaggaggccaagtacaagttgtgcaaagtgaggaagatctttgttggcacaaaagggat

SEQ ID NO: 695 - DNA, 207 bp, Homo sapiens
agccttttaggtgctgacatcagacatcagagattaccaccaggtccatggtgtagatggatagcacatctcagtttgcaggtctcagtgctgaggtcttcaagatctgacagacatgcttttcgcaactacttttaggagttaatgggccaaagttgggatatccatttccattaaagtgtatttgttaatcataatatacacagg

SEQ ID NO: 696 - DNA, 203 bp, Homo sapiens
aaagcagtggacaagaaggctgctggagctggcaaggtcaccaagtctgcccagaaagctcagaaggctaaatgaatattatccctaatacctgccaccccactcttaatcagttgtggaaggacggtctcagaactgtttgtttcaatttggccattaaggttaggtagtaaaggcttggtaatgataacacatgcatacgt

SEQ ID NO: 697 - DNA, 161 bp, Homo sapiens
ccatcctggctaatacggtgaaaccccgtctgtactaaaaaatacaaagagaaaaattagccgggcatggtggcgggcacctgtaggtamccagctaactcaaggaggctgaaggcaaggagaattgacggtggaacccggggaggcgggactttgccagt

SEQ ID NO: 698 - DNA, 143 bp, Homo sapiens
tctcagggacaagtgcaacgcaggtgcgcgtggaattcatggacgacaacgagccgatccatcaatccgaactgtaaaaggccccgtgcgcgagggcgacgtgctcacccttttggaagtcaagagcgagaagcccgaaggtt

SEQ ID NO: 699 - DNA, 191 bp, Homo sapiens
ttcagagtccatgaggcattttatttgtaaatatatgtattacatccctagaaaaagaatcccaggattttccctcctgtgtgttttcgtcttgcttcttcatggtccatgatgccagctgaggttgtcaagacaattgaaccaacttgcggattggaggaggttattctgccatttttccaggctttaag

SEQ ID NO: 700 - DNA, 125 bp, Homo sapiens
taatgcccacaaggtactctgtggatatccccttggacaaacctgtcgtcaataaggatgtctcaagagacctcctctaaaccgcaaggccccccgggagccaaggctcaagttttgaagggggg

SEQ ID NO: 701 - DNA, 313 bp, Homo sapiens
agaaccccaacatgcggctgtcgcagctgaaacagctgctcaagaaggagtggctccgctctcctgacaaccccatgaaccagcgggccgtgccttcaatgcccccaagtgagcccagaacttggggagccagttcacccacgggtggtccaggtcacgactctgcacgcccttaggccaggtcagctgcgagggtcacagagcgttccgggggccaaggcgccgggccctggggcattgctcttatcaccagccacccgtcctcccgccagagggtccctgccccgagtgacaccccatcccctcccatccc

SEQ ID NO: 702 - DNA, 240 bp, Homo sapiens
cggcacgagcggcacgagctcaggaccctccagtcgttcaagctggaattggcaggttttctgcctgtataggcatcggcttcagagtctcaggtgctgcttggcaggaaaatgcagggcaggaggggctgggcctcagctcgaggctcccaggtgcagccccccactccactgcagggcccaggggggccaagaacagccacaacaacacaaaagccaaactgggaacggattcgtaga

SEQ ID NO: 703 - DNA, 167 bp, Homo sapiens
ctagggggcaactcctcccccagcgccaaggacatcaagaagatcttggacagcgtgggtatcgaggcggacgacgaccggctcaacaaggttatcagtgagctgaatgaaaaaacattgaagacgtcattgcccagggtattggcaagcttgcagatgtacctcct

SEQ ID NO: 704 - DNA, 125 bp, Homo sapiens
cttggttatgagactaaaaccattcctcactgctctaacatgctgaggaaatcatctgaaggggaagggagatggatgctcagtagtaacatcaaaggataaagcattattctagcagcatccat

SEQ ID NO: 705 - DNA, 432 bp, Homo sapiens
  misc_feature 156: n = A,T,C or G
cttggactggagcagaaggctgagaacaggaaggggctggtccctggtactagttttggttttttggtggtttttttttttcttgttttttctcacagaacagggcaaagctgagtgtccctggatgagtgaaccaggaggattaatcatgcccantgcttctccactttaaactggttttcctgggaatttgcaattgaaagtggggaggggtaagaatcgtgggaaaaggctgatggtgttcagccaaattcatccttcacgtgcccacccttctacaggcacatgctttggggccatccacggttgcagccaccccatccttaggaagcaccactggccttcctttccggtacctggactcagcatcactcccagcctcttggagatgcagccttcattcagcacacagctcagctctgagttcggttt

SEQ ID NO: 706 - DNA, 480 bp, Homo sapiens
ggctgaccagatgggaaaatgcaccccctcaggcaggtggccaattagaaaaatatgtccttttggcagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcctcatcctccgcctggcgtacaggtctaagccaggcgagggcaagctcatcttctgctcaggcc

SEQ ID NO: 707 - DNA, 270 bp, Homo sapiens
ctcgtgccgaattcggcacgagccactttggttttcttttttgcgtgtggcagttttaagttattagtttttaaaatcagtactttttaatggaaacaacttgaccaaaaatttgtcacagaattttgagacccattaaaaaagttaaatgagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 708 - DNA, 450 bp, Homo sapiens
gacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcatgacagcgatacagtacttaagtgtctgtgtagacaaccaaagaataaatgattcatgggtttttttaaaaaaatcgagtttttttttttttt

SEQ ID NO: 709 - DNA, 122 bp, Homo sapiens
gacagacctctaattcacaatgatgtaagagttctttgttattcaggcaaaggcaaagcgaataaacaatatcaattggaatggtgctggtcttaagtttaacaactcaagtaaatgggtcc

SEQ ID NO: 710 - DNA, 108 bp, Homo sapiens
ctcgtgccgaattcggcacgagctccagcctaggcggcagaacaagactctgtctcagaaaaaaaaaaaaagggaaaggaaaattggccttaaggtgaatttcccatt

SEQ ID NO: 711 - DNA, 282 bp, Homo sapiens
cagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagt

SEQ ID NO: 712 - DNA, 182 bp, Homo sapiens
cggcacgagctggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctttcaaggatgttcgtcgtggcaacgttgct

SEQ ID NO: 713 - DNA, 256 bp, Homo sapiens
gcgcggtgaggttgtctagtccacgctcggagccatgccgtccaagggcccgctgcagtctgtgcaggtcttcggacgcaagacagcgacagctgtggcgcactgcaaacgcggcaatggtctcatcaaggtgaacgggcggcccctgtgagatgattgagccgcgcacgctacagtacaagctgctgggagccagttcttcttctcggcaaggagcgattttctgtgtttagacatccgtgtccctgtaaagggt

SEQ ID NO: 714 - DNA, 239 bp, Homo sapiens
gaacactggtctcgggcccgagaagacctcctttttccaggctttaggtatcaccactaaaatctccaggggcaccattgaaatcctgggtgtccgcaatgttgccagtgtctgtctgcagattggctacccaactgttgcatcagtaccccattctatcatcaacgggtacaaacgagttctggccttgtctkttgagacggattacaccttcccactttctgaaaaggtcaaggcct

SEQ ID NO: 715 - DNA, 226 bp, Homo sapiens
tccttctgcacatgaggccagtataggcaacgtcacatttgtttgtttcaaatatgcagtgtggtattttgtttactttgcatttaccgtgagcaaagatacttcttggaatggctgcagtgaggccgtgtcattggctcacaaaagtgactcataggtaatttctgtgtttgcattccactgctctgttccctaaggtccttgactttctccccaggattccact

SEQ ID NO: 716 - DNA, 359 bp, Homo sapiens
ccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaaaaaaaatatatatcaatgttttccaataaaatacagtgactacctgaaaaaaaaaaaaaaaaaaaaaaaaaaaaaaaaaaaaaaaaaaaaaaaaaaaaaaaaaaaaaaaaaaa

SEQ ID NO: 717 - DNA, 432 bp, Homo sapiens
gaaaaactgaaagcctttcctcttatatgtggaacatgacaaggatacccacttttaccaccattattcaactgattactggaagtcttagctacagcaatcaaagagaaagaaataaaggggatccaaaccggaagggaggaagttgaattatccctgtttgcagatgatatgatcttatattggaaaaacctaaagactccaccaaaaaatgattagaactgataagcagattcagtaaagtttcaggactcgaagtcaacatacaaaattggtagcatttctatatgccaacagtgaacaatctgaaaaagaaataaaaaaggaatcccatttacaatagccaccaataaaatacctaggaattaaccaaagaagtaaaagatctctacaataaaaactataaaacaccaatgaaaaaaaaaaaaaaaa

SEQ ID NO: 718 - DNA, 555 bp, Homo sapiens
ccaatatctactggctgtgtgacctggagcaagtcccctaacttctccaagcttttgtttccttatgtgaaaatgggaatagcaacacctagatcttgctatcttttagactactgaccagtacttttgaatgaaatatacttactattttaaaaaattcaagcaagatgaaaattacaagaagttctgaaatctcaccactctcatagtgattttagagttaaaagaaataacatgtgtaagatggtcagcacagagcctggcactggataagtactcagtggacatcagcccgggccacccatcctgcctgtcactcagagagggctgggccaggttgatcgctgagctcctctcacccccagcaccagctcattccaggcagctgccagagaggaagacagcccagctacaggagaacatcgtatggggacaagggcactcccctgacagaaatgcccatcctggtcgggcatggtgcctcatgcctgtaatcccagcactttgggaggccgaggcgggtggggtcacctgaggtcaggtgtttgagacagc

SEQ ID NO: 719 - DNA, 510 bp, Homo sapiens
caagctactgactgtaagaaaatgttttaaaatcatttctccagcaagggactcgtgtacagaatatataaagaaccttccaaactctataatacaaaacaaacatactcagtttaaaaagaggcaagagacttgaccaaaaataagcacatgaaaagtcattccacatcattagacattagggaaatgcaacttaaaattatagggaaagggaaaaaaataggatgcgataccactatacacctatgaaaatggctaaaataattactggtaattctaagtgagggtgaagatgtggagcaagtgaactctcatgcattgccggtgggaatgtaaagtgatgctgccaccttggaaaacagctgggcagttttttttgttttgttttgtttttgtttttttgagatggagtctcgctctttcacccaggctggagtgcagtggacgatctcagctcattgcacctctgcctcggtcaagcgattcttctgctcagctagctccatactg

SEQ ID NO: 720 - DNA, 527 bp, Homo sapiens
gtaggacatggtcatcctgtcatctgtcactgctggatgacatcctccctgtagatgaactcagggagaagggagtcttccacacgtgcttggagagaggatctccccagcccccagtcttaaactcagagcacatacatgggaaaatgtgcagaataccattccccattcagcaaggatcaggccatcttcagcctgaacgcaaacccatgcgggtccagggtatcagccctgggcgagagggctgcgtgacccaggcaggatgggggtgcagagcctggacaggcagcaagtccacgggagagttaaaatgtctatgggaaaatgggctgggcacggtggctcacgcctgtaatcccagcagtttgggagaccaaggcgggtgtaccacttgaggtcaggagttccagaccagcctgaccaacatgacgaaaccccatctctaccaaaaatacaaatattagccgggcgtggtggcacatgcctgtagtcccagctactctggaggctgagacaggagaatctct

SEQ ID NO: 721 - DNA, 579 bp, Homo sapiens
gaaccttttccattttttttcctttattctcagcaaacagcaattccactgccagagaggtagtttcctcttttctgcaccatgcagctccctgtcaacagcttatatacagcggtttccacttgtgtctcctgtgttaagctctaagcaacttgaggacggggctcacactctagtcagtgctgtctgaaagcagcataatatgagtcaccagtgtaacacagccacataattaaagattttttaacagccacattataaatgtaaagaaaaaagtcggccgggcgcggtggctcacgcctgtaatcccagcactttgggagaccgaggcaggcggatcacgacgtcggaagatcgagaccatccttgttaacacggtgaaactccgtctctactaaaaatacaaaaaattagccaggcatggtggcggatgcctgtagtcccagctacttgggaggctgaggcaggagaatggcgtgaacccgggaggcagagcttgcagtgagctgagatagcaccactgcactccaccagcctgggcgacagagacagactctgtctcagaaaaaaaaaaaaaaa

SEQ ID NO: 722 - DNA, 396 bp, Homo sapiens
gcgagaaggtgtcaggagcagcccatttgtgtctctctctctacctctgtgaagggcgcgaatgggcagagcagaacttctagaagggaagatgagcacccaggatccctcagatctgtggagcagatccgatggagaggctgagctgctccaggacttggggtggtatcacggcaacctcacacgccatgctgctgaagctcttctcctctcaaatggatgtgacggcagctaccttctgagggacagcaatgagaccaccgggctgtactctctctctgtgagggccaaagattctgttaaacactttcatgttgaatatactggatattcatttaaatttggctttaatgaattctcatctttgaaggagtttgtcaagcattttgcaaatca

SEQ ID NO: 723 - DNA, 384 bp, Homo sapiens
cctctttctgccaaaaatttatagtattggtatatgtcccaatccaaaatctcactgttagaactcagattttcaggtctttccgttagtctcactttttccactggaacaccttcacttttttcaaatgtgtcagcaactgtgaataaaaacaagccagagaatagctagaaaacagaggctgcaagagataacagtcaatttagagaaaacaccgttagcttattatcttaaattgtgcagaaatctgttcaactaatagagacagaagatccatgaaaaatagaaattttcagatttttggccaggtgcggttgctcatgtctgtaatcccagcactttgggaggcagaggcgggcaaatcacctgaggttaggagtttga

SEQ ID NO: 724 - DNA, 620 bp, Homo sapiens
tttagttattgtgaatttgttttctatgctagtaattcagtttggcatttagaagatttctttgtataaatgaaactgttgcctcctacaaataaagtattttcaaattcttaaatatttttaaatgttccaggatctgtaatttaaatgtcaaaggttaccagtgaatcgtaattgtctttatacttccttaatgagttgctaaatactctttaatccttaaaaagaaaatagaaacacccatactttaaatcagtttttaggtctgatatgcttgctacctgtcaaatttctctgatagttttttccttgtgtacctctgttcatgacattcctccttaactggcataccctttcagttcttgggttggctcaatctttaagatcctgatggaaacccaggccagtgtttcttaaagtagtttccataaaacattagttacatgatctgttactagatatcatgggaaaaatgggttccaaggtcaaataagtttgggaaactcaaatgacacattttaagcagacttgcagaagtgttttttaatttcaaagatctcaaaggcttagtctgctgatatccattgtgactctcaagatgacagtatagtctataattt

SEQ ID NO: 725 - DNA, 617 bp, Homo sapiens
ggcaaaaataagggaggaatatttcaggtagagggaatagcttgtgcaaaggccctgtggcaagagaaaataaagtgagatcaagaaatagaaagaaggccaatgtgactggagatgagtgagtaagggggagaaagcacaaggtggctccagagatggaagcaggttcctcatcttacttcttggtcaggttaccaaggtatttggttttcattctaagaatatcaggaatcatttaagaattttaagtgaggggtgacatgatttaaattttttaaagtttattctggcttaatgtagaaattagattggaggggaacaaaagcaaatgcagctgggtgcagtggcacacacctgtaatcccagcactttgggaagccgatgtgggaggatcacttgaaaggtcatgagttcaagaccagcctggccaacatggagaaacccatctctacaaaaaatacaaaaagtagccggccctggtggtacacacctgtaatcccagctgcttgggaggcgaggcatgagaattacttgaacccaggaggcggatggaggtggaggttgcagtgaaccaagatcacaccactgcactgcagcctggacagagcaagacccca

SEQ ID NO: 726 - DNA, 355 bp, Homo sapiens
gagaaagaacattggtaaaaggtatgaattccagaattaaagaaataatttggggatttctagataagaggatatatatgaacatgcataccttacaccttcatatacacaaccttaaatcacaaataaaacaaaataaacaatacaaattataccaccaagattcagaagatatcagacgaaataattagagaaagtaaaaatatgctgtctccattatattcataatgtttcattcttgacactaataattagaggctttaaatttttaaatgatttactttttactaacattgctgaaaaaaactaaagacatacataaatggaaagatgtcytgtgtttatggattggtaa

SEQ ID NO: 727 - DNA, 270 bp, Homo sapiens
gactgctcctcattacccactcacctcagcccctagcaatcatcaatctatgttctgtctctggatttatctattctgaatatttcgtatacatggacttatctgtgaccttttgtgtcgagcttctttcacttagcatgatgtttgcaaggttcttccccattatagtatgtatcagtactacactttttaagagtaatattgtaaagtatgtatacatcacaatttgtttatacattcatccaatgatggacatttgggctgtttcca

SEQ ID NO: 728 - DNA, 589 bp, Homo sapiens
gttatttctgaaaaacaaagaaatacattttaaaatagcaaaggagaccatgaatgggatgtcttctctgaaggccagggcttccagtgtgctgatcctgttgtgagagatcctccatgcatccagagaggacagatttttttggaaaacctttcagtagctgttttcatgcaactttattactgtcagttaaaatgaaaagactggattggtggaggtggagtcattcccagcatctcttggtgaatcagagctgtgaagctattctgcttagaagttgacccaaggatttggtgggagaactggataaattagttttaatctaaaagccttgacactaacaggatgtgggggaaaacataaacttctaggacttaggagacctgtgcagccatcttggttgcctcactagctcttcctctgttggaggataggtgaaattattgccataaccacctcagaaggccatttgaaaatcttggccaggcgtggtggctgacgcctttaatcctactagcactttgagaggtcaggcaggcggatcatttgcagtcaggagtttgagaccagtctggccaacatgatgaaa

SEQ ID NO: 729 - DNA, 560 bp, Homo sapiens
cggcacgagcggcacgagctcaggaccctccagtcgttcaagctggaattggcaggtttctgcctgtataggcatcggcttcagagtctcaggtgctgcttggcaggaaaatgcagggcaggaggggctgggcctcagctcgaggctcccaggtgcagccccccactccactgcagggcccaggggggccaagaacagccacaacaacaacaaaagccaaactgggaacggaatcgtggaaaaaaccctcataggcttttgggaacttacaaagaaatgcccacatccattctactaacatggcatctactaacgtggcatctactaggatgccacaaaacagacaaatccttccacgtaaggctggacacgtgtcagggcggtgtctcaaagctgggccacaggcagcatccacggccaagccactgggtggaggagacggtgctggggaggagccggagggaggggccggggctgttccttaggcagaacggctcacctgtggtgtgcgcacagcaggattgtggggacacaagatgcccccttcattcatcagttac

SEQ ID NO: 730 - DNA, 468 bp, Homo sapiens
gttcccactcctactggaagacccatgtcggtttccggaaccccaccagtttacccataagcaagactaaacctgatccttgggcaaaagttcctaacccctactttaccctcccaccctcacttttaaatccaccatactgaatgccacactatggaatgcagctacctgccaagcaaggcaatagaaggcaaaaaatggaagtgaattaagatgaactcatctgaaatacacaaatgcattactatctgaagataccagcaagagtttagtctacgtgtataaggctcccagtaggatttagctaggctactagaagttagactgctttcgcattaaacagctaacttcatccacagcaaattgactcaatcaggaaccttcatttgaaggtgtgttagaggatggggtcgatagctgtctttttggtgaaagaaaaggtgcatttcaagaacttggggggcaaga

SEQ ID NO: 731 - DNA, 460 bp, Homo sapiens
gttaaagtccatctctcccactagaaagaaagcgtcaagaaagctgaatctaatgtctatttactcctgtgcccctagcacctagcagcacagtgcctggcacataatggcattcaatatagatttgctaatacgcttattgcccagtgaatcagcagtttctgaaaggaggggaaggaggagacaagctctctgaagaaaacctgaatcagttttatagcctttgcttatgctcagccctggtgctctccatattgtctaccacactaagcattgtggacaaacataaaaatttaggactgttatttttgttttgttttttgtctgttggtttttcatgagagactattaatctagtccatgtgattccagaagaagtaggatccagggtaaattcaaaggagaaaaagcatatttgacttagctgctttaaattttatgttctttcctgacttttggg

SEQ ID NO: 732 - DNA, 454 bp, Homo sapiens
ctcgtgccgaattcggcacgagatattttctgtttctctttttcactctctaaactctttttgtataaataaggattatcctgggcataattcatttgaatatgaaaccaacatactttctttcatttttgtgaaaaaataaccaaaaacatgtattaatgtgatacaaagaaagtctcattcacacaatcaacaatgaggctaagaggtagctaccatgtggctaatgaatgtgcctaggtaacttcctgtttctattcaaaactgctgctttatttgtacattcagaaatatttttttcaactatgaaatttcaatatcaattttttaagccagtttctgcaaaaggaaatgacctgtcatttgatgtgttcatgtgtgttttgtgtttggatagtttatatcatgccattctataaaatgtatgttttcaaaccaaaaaaaaaaaaaaaaa

SEQ ID NO: 733 - DNA, 355 bp, Homo sapiens
ctctgtggcccctgcgaggaagcttgctccgggagtggtctttgggcataggcacctgcgtcactgtggcgaggtctgcttttgtctctgaccagctaacatcctcagatggctgccggcttccaccgcagagcaaatgccgctgccttctgtggagagcagagtgagagtcggcgaggcagcattgtttgtagctgaaggcaggccgggccgcgggaaatggatggtgatggctgtaatttggccctgttacttattcattaatcgcatgcaggtggtcagccagccagcaagacctgctttttgaaatttcaatttccagagggctcctcgtgtctgcactgtgtggcattaa

SEQ ID NO: 734 - DNA, 536 bp, Homo sapiens
gcaaaattaaatgcaccaatagtactaaataaaggtaggcaggaaggcacctaatgtactacaatagcttgtataacatcagcctcatccagtgatcaaggtgaccaaataaattatctttaacacacacacacacacacagagtatagactccaaagtttccattgtaagacaaattctctgacactagtgcacacttgatgccctggatcctcaagacatcaccgggtgccgggtgcaggggctcacgcctataatcccagcactttgggagcccaaggtgggcggatcacgaggtcaggagttcaagatcagcctggccaacatagtgaaaccccgtctctactaaaaatacaaaaaaaaattagctggatgtggtgccaggtgcctgtaatcccagttacttgggaggttgaggcaaggagagtcacttgaacctgggaggtggaggttgcagtgagccgagatcgtgccactgcactccaacctgggtgacagcacgagactccatctcaaaaaaaaaaaaaaaaaaaaaa

SEQ ID NO: 735 - DNA, 347 bp, Homo sapiens
gatgatgacttcaccacctggacccagcttgccaagtgcctccatatctgggacctggatgtgcgtggcaaccatcggggcctgtggagattgtttcggaagaagaaccacttcctggtggtgggggtcccggcttccccctactcagtgaagaagccaccctcagtcaccccaattttcctggagccacccccaaaggaggagggagccccaggagccccagaacagacatgagacctcctccaagaccctgcggggctgggcctggctcagaatctaacctatttattgactgtcctgagggccttgaaaacaggccgaacctggagggcctggatttcttttgg

SEQ ID NO: 736 - DNA, 256 bp, Homo sapiens
catccctggcatccctgggcccccgggtcccatgggccagccaggcaaggctggccactgtaatccctctgactgctttggggccatgcgatggagcagcagtacccacccatgaaaaccatgaaggggccttttggctgaaattcccacctgctttgatgaagactccgttgggataaatggcaaagcttataggactttttacaggtgtgaatgtttttttggtgtggtgtggtttattgctgtaaaattttaa

SEQ ID NO: 737 - DNA, 256 bp, Homo sapiens
atttataagttacctgtatttatatttatatgcccgctctcatggtgaaggctggacaaggtgctcctctggcccctccttcttacctcagatgcctgaacagaacaaggcaaacccgtagcagcctctcaggagctgacaggtcctctttcggggctcaggagggttggcacacacccagcggcctgcagagtagcttattaccacaactgtccgctttgtgcttctagggtgacacatggcatgggtagaactg

SEQ ID NO: 738 - DNA, 159 bp, Homo sapiens
cctggacgtacaataccacttccgctgtcacggtaaagtccgccatcagaagactgaaggagttgaaagaccagtagacgctcctctactctttgagacatcactggcctataataaatggggttaatttatgtaacaaaaaaaaaaaaaacccttggg

SEQ ID NO: 739 - DNA, 252 bp, Homo sapiens
aagaactgggtagatgctcatatgaactgtgaagatattgccatgaacttcctggtggccaacgtcacgggaaaagcagttatcaaggtaacccacgaaagaaattcaagtgtcctgagtccacagccatagatgggctttcactagaccaaacacacatggtggagaggtcagagtgcatcaacaggtttcttcagtcttcgggaccatgcctctaaggtggtcgacacgagctgaccctgtctgtcaaag

SEQ ID NO: 740 - DNA, 284 bp, Homo sapiens
gtccaacctgcgctacaaccacatgctgcggaagaagaagaacctgctgcttcagtacaacagcggggaggacctggccgtcaacatcatcttccccgagaagatcgacatgaccaccttcagcaaggaggccggcgacgaggagatctaagcagcgttcccacagccccctctagattcttggagttccgcagatcttactatacgcggtctgtcctaatctttgtggtgtcgctatctctagtataaatctggtaacgctacgcttacatatattgtctttg

SEQ ID NO: 741 - DNA, 270 bp, Homo sapiens
cacacctgcagtcctcgctactttgaaggcctgagcctgcagaggttgaggctgtagtgagtcaaaattacaccactgcactccagcctggcaatcagagtgagaccttgtctcaaaaacaaaaatacctagaaatcatctactctgtctttaatgtgaaatgttcttatgatagctatctttctgagttccttttttctgagcactaaacacacctgtggtcttatctttggggtctggaacagaccttatgtacaggtcaaagcaacg

SEQ ID NO: 742 - DNA, 270 bp, Homo sapiens
aagccctcggcccccaagaagggagacagttctgctgaagaactgaaactggccacccagctgaccggaccggtaatgcccgtccggaacgtctataagaaggagaaagctcgagtcatcactgaggaagagaagaatttcaaagccttcgctagtctccgtatggcccgtgccaacgcccggctcttcggcatagggcaaaaagagccaaggaagccgcagaacaggatgttgaaaagaaaaataaagccctcctgggacttggaataa

SEQ ID NO: 743 - DNA, 159 bp, Homo sapiens
ggaaaggtgatagtagttttatttgatactgataaatattgaattgattttctagttattttttatcattttctcaatggagtagtataggactgtgctttgtcctttttatgaatgaaaaaattagtataaagtaataactgtcttatgttacccaaa

SEQ ID NO: 744 - DNA, 281 bp, Homo sapiens
cagcgccgcgatgactgccactctccgcccctacctgagtgccgtgcgggccacattgcaggctgccctctgcctggagaacttctcctccaggttgtggacgacacaacaagccggaagtggagtcaggagtagcaaagagctcctgttacaacctgtgaccatcagcagggattagaggaaaggttcttattgagggctccatcaactctgtccgggtcagcattgctgtaaacaggctgatagaggtcaggaggttttgtaccaaaggtcatgcgcta

SEQ ID NO: 745 - DNA, 209 bp, Homo sapiens
cctggctttcctccgcaagcggatagaacaccaaccctttccgaggcccctaccacttccggggcccccagccgcatcttcttgcggaccgtcgcgaggatgctgccccacaaaaccaagcgaggccaggccgttcttggaccgttcaaggtgtttgacggcatccaccgcctcacgacaagaaaagcggatggtggttgtccgtcgcc

SEQ ID NO: 746 - DNA, 182 bp, Homo sapiens
atattatattatgtaccataaatatttcctgtatctgactgcctgaacatattaccacatcctgtgccttagtatcctacagagacaaaaagaaaggaaaaaaaaaaaccctttgttcaggtttttatgtaaatatttttcatgtccccttctttcctttacgcactaatttatacccaggt

SEQ ID NO: 747 - DNA, 266 bp, Homo sapiens
aaaactcaggggctggcggggtgtgcaggtatggtgagaatttgccctctgcaagctctcctggagctcttgtctgtttgatggatggtccgccgctttatagcttctcattctggctcctactgcttccttgaggatacttccctgcttgtagtccctagccagaggttgatgcactagaggaaaggccctctgatcacagatcagagcttgtgaataataataatttttatctctctggtaacagctgatagggtgagtaagag

SEQ ID NO: 748 - DNA, 200 bp, Homo sapiens
ttcggtttttctcttccttcgctaacgcctcccggctctcgtcagcctcccgccggccgtctccttaacaccgacaccatgccttcaattaagttgcagagttctgatggagagatatttgaagttgatgtggaaatgccaacaatctgtgactattaagccatgttggaggatttgggatggatgatgaggagatgata

SEQ ID NO: 749 - DNA, 252 bp, Homo sapiens
gagccgccgccatgtctgcgcatctgcaatggatggtcgtgcggaactgctccagtttcctgatcaagaggataagcagacctacagcactgagcccaataacttgaaggcccgcaattccttccgttacaacggactgattcaccgcagactgtggcgtgagcggcagccgacgcaaaggtgtcgtggtggtcattaagcggagatcggccagcgaagctgccacctctatgtgcggacacatacaagatt

SEQ ID NO: 750 - DNA, 141 bp, Homo sapiens
ccctggcctggtctgctgatggccagactctgtttgctggctacacggaacaacctggtagcgagtgtggcaggtgaccattggcacacgctagaagtttatggcagagctttacaataaaaaaaaactggcttttctgaa

SEQ ID NO: 751 - DNA, 213 bp, Homo sapiens
agtcgccaatatgcagctctttgtccgcgcccaggagctacacaccttcgaggtgaccgcccaggaaacggtcgcccagatcaagtctcatgtagcctcacttgaggacattccccgaaagatcaagtcgtgctcctcgcaggcgcgcccctagaggatgaggccactctgggcagttcggtgtagaggcctatctaccctgagtagcaggcc

SEQ ID NO: 752 - DNA, 202 bp, Homo sapiens
aaactattatacaactgtttttgcgactttataggcaggtaaattttgctattactattgaatacaaatgacaattcatttatgaccactcaaacagcgttagtaaccatttagtgacaaaggattaaaacatccatctggatgttaattttgaagatgtaattatatgttgtttaaatttttccaggcatctgaaaaccct

SEQ ID NO: 753 - DNA, 217 bp, Homo sapiens
ggtttttggtttggagacatccaaagcctgaagccaggtgggtgtgggcaggggctgcattttatgaaactgcccagcaagctgtgctccctggggccccaggatccacctaactggcctggcacctggtgccaacgtgctgctgccgccaggataatgcgccttcccacaggtgccctgcctgagtcgtgtcatccaggggcctggtagccccaag

SEQ ID NO: 754 - DNA, 202 bp, Homo sapiens
caaacccactccaccttactaccagacaaccttagccaaaccatttacccaaataaggtataggcgatagaaattgaaacctggcgcaatagatatagtaccgcaagggaaaagatgaaaaatttatacccaggcataatatagcagggtctaacccctataccttctgcataatgaattaactagagatacctttgcaagg

SEQ ID NO: 755 - DNA, 222 bp, Homo sapiens
ctcgtgccaattcggcagggggtttcaaaggctgttattgagacagcagatagagccaagctgcaacctatagctttaagctgtgtactgaatattggggcttgtaaactgaagatgtcaaattggcagggagcaatttacagattgttttagagggctctttaactagagccctcaaataccaaagcattttaccccagagctcaagatggcaaggattaa

SEQ ID NO: 756 - DNA, 190 bp, Homo sapiens
gacaaatgggactgatgtcatcttgagctcttcatttattttgactgtgatttatttggagtggaggcattgtttttaagaaaacatgtcatgtaggttgtctaaaaataaaatgcatttaacctcatttgagagaatgccctttagtttaatgcatatttaaactcaaattgatcccgtagtgttcccg

SEQ ID NO: 757 - DNA, 175 bp, Homo sapiens
cggcacgaggaagcgcgcccccggggccggtcccggaggttcggatccgcatctacagcatgaggttctgcccgtttgctgagaggacgcgtctagtcctgaaggccaagggaatcaggcatgaagtcatcaatatcaacctcgaaaaataagcctcagtcgttctttaagaaaa

SEQ ID NO: 758 - DNA, 190 bp, Homo sapiens
ccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttagtaa

SEQ ID NO: 759 - DNA, 253 bp, Homo sapiens
gcagcctgaggtgatctgtgaaaatggttcgctattcacttgacccggagaaccccacgaaatcatgcaaatcaagaggttccaatcttcgtgttcactttaagaccactcgtgaaactgctcaggccatcaagggtatgcatatacgaaaagccacgagtatcttaaagatgtcactttacagaaacagtttgtaccattcgacgttacaatggtggagttggcaggtgtcccaggccaagcaatgggcttg

SEQ ID NO: 760 - DNA, 219 bp, Homo sapiens
ggctgatgatgccaatgtggttcgtgaccgtgacctcgaggtggacaccaccctcaagagcctgagccagcagatcgagaacatccggagcccagagtgcagccgcaagaaccccgcccgcaccttccgtgacctcaagatgttccactcttacttgagagtggagagtactggatttaccccaccaaggctgcaacctggatgccatcaaagtctttt

SEQ ID NO: 761 - DNA, 167 bp, Homo sapiens
gcaagaccattagctctttttataggctcgagaacaacaggatgctttggtcctgtatcagcaggacgctttttgggtagatcctacttccaccctactatcgggtagatcctactttaccctagctatgtgcacatttcaaattccatgtaataaagtagacacaa

SEQ ID NO: 762 - DNA, 225 bp, Homo sapiens
aaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtctccccgtaagaccttcgggtcaaggcagaggcaggaactcactcg

SEQ ID NO: 763 - DNA, 150 bp, Homo sapiens
ccccgaccccctgcagtacatgcgggccgaccaggcagcccggtggcctgagacagcatgacgccgaggtggatgccacacttaagggccctgaacaaccagtttgggagcatcccgagccccggggttcccgaaagaccctttttgaac

SEQ ID NO: 764 - DNA, 178 bp, Homo sapiens
tgaacttgctgattctgtagcaaaacctgggtgggggttggggtggggggtagtttactttgttgtaaggacttgataacctggctacagcgttttctatgaaatctacttggatcccatgcctaaaatttggagcatatgtacaaaaatcattttacggttttattttataatcatt

SEQ ID NO: 765 - DNA, 160 bp, Homo sapiens
tgaacttgctgattctgtagcaaaacctgggtgggggttggggtgggggggtagtttactttgttgtaaggacttgataacctggctacagcggttttctatgaaatctacttggatcccatgcctgaaatttgggaagcatatgtacaaaaatcatttt

SEQ ID NO: 766 - DNA, 141 bp, Homo sapiens
gcgtgtgcggctccagcccagcccgctgctcactttccaccctctatccacctgcctctggcttctcaggcctctgctctccgacctctctcctctgaaaccctcctccacagatgcagccatctccgggtccctcctagt

SEQ ID NO: 767 - DNA, 150 bp, Homo sapiens
gcgtgtgcggctccagcccagcccgctgctcactttccaccctctctccacctgcctctgggttctcaggcctctgctctccgacctctctcctctgaaaccctcctccacagatgcagccatctccgggttccctcctagtctttcctt

SEQ ID NO: 768 - DNA, 209 bp, Homo sapiens
gtggcagccatctccttctcggcatcatggccgccctcagaccccttgtgaagcccaagatcgtcaaaaagagaaccagagttcatccggcaccagtcagaccgatatgtcaaaattaagcgtaactgcggaacccagagcattcacaacaggttcgtagagattcaagggccagtctttatgcccaacattggttatggagcacaaaa

SEQ ID NO: 769 - DNA, 225 bp, Homo sapiens
gtggcagccatctccttctcggcatcatggccgccctcagaccccttgtgaagcccaagatcgtcaaaaagagaaccaagagttcatccggcaccagtcagaccgatatgtcaaaattaagcgtaacttggcggaacccagaggcattcacaacagggttcgtagaggattcaagggccagatctttatgcccaacattggttatggagcacaaaaacacgcaca

SEQ ID NO: 770 - DNA, 197 bp, Homo sapiens
taacaaacgtgttttttaaaaaagcctggtttttctcaatacgcctttaaaggtttttaaattgtttcatatcttggtcaagttgagatttttaagaccttcatttttaatttgtaataaaagtttacaccttgattttttcaaaaaagtcaacaaactgcaagcacctgttattaaggtcttaatataaaaaaaaa

SEQ ID NO: 771 - DNA, 176 bp, Homo sapiens
ggagattccaagggcttctctggagggggattggctgcagtgtagatttgcctctgaggaggctgccccagacttggcctcctcatagcccctcctgacctctcccttctctggtcctggcatccctggagaagtaggggtcttgacctaagttagatttagatctccatgtcaca

SEQ ID NO: 772 - DNA, 295 bp, Homo sapiens
ctcgtgccatttcggcagctccccagctgccaccaccaagattggcccccccgcatccacacagtccgtgtgcggggaggtaacaaggaattccgtsccctgtaggttggacgtggggattttttcctggggctcagagtgttgtactcgtaaaacaagggatcatcggatgttgtctaccaattgcatctaattaccgagctggttcgtccaagaccctgtgaaggattccattgtgctcatcgacagcacaccgtacccacagtggtacgggtccactattcgctgcccctgg

SEQ ID NO: 773 - DNA, 210 bp, Homo sapiens
ggctgcacgaaacataccggtaagtggggcaagactgttatcgagtaccggtcacagaagacctcacgcctccccatcattgacattgcacccatggacataggagggcccgagcaggaattcggtgtggacatagggccggtcttcttcttgtaaaacctgacccagacacaacacatccgttgcaacccaaggccccgtgctctctct

SEQ ID NO: 774 - DNA, 265 bp, Homo sapiens
ctcgtccggaaaagcgttcaagctcaacacccactacctaaaaaatcccaaacagataactgaacttctcacacccaatgggaccaattgataacccgatagaggactaatgttagtagaagtaacatgaaaacattgtcctccccataagcctccgtcagattaaaacactgaactgacaattaacagcccattatctacatcacccaccaggtcatatttaccctcactgtcacccacaaagggcgtgcttataggaagggta

SEQ ID NO: 775 - DNA, 320 bp, Homo sapiens
ccaacatgggccgcgttcgcaccaaaaccgtgaagaaggcggcccgggtcatcatgagataagtactacacgcgcctgtggctaacgacttccacacgagactaagcgcgtgtgctgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacacttaa

SEQ ID NO: 776 - DNA, 215 bp, Homo sapiens
gagcagcttttggctgcgtaactgtgaactatgtgaccatatataattctcgatcattaatttttgaagatacttgtggctggacaaagtgcattcctctgttaataaactttttatttattacagcccaaagagcagtatttattatcaaaatgtcttttttttttatgttgaccattttaaaccgttggcaataaagagtatgaaaacgcaaa

SEQ ID NO: 777 - DNA, 277 bp, Homo sapiens
tgcagaaggagatcactgccctggcacccagcacaatgaagatcaagatcattgctcctcctgagcgcaagtactccgtgtggatcggcggctccatacctggcctcgctgtccaccttccagcagatgtggatcagcaagcaggagtatgacgagtccggcccctccatcgtccaccgcaaatagcttctaggcggactatgacttagttgcgttacaccctttcttgacaaaacctaacttgcgcagaaaacaagatgagattggcatggcttta

SEQ ID NO: 778 - DNA, 305 bp, Homo sapiens
tctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagttaaggagaagtatgccaagtacctgcctcacagtgcagggcggtatgccgccaaacgcttccgcaaagctcagtgtcccattgtggagcgcctcactaactccatgatgatgcacggccgcaacaacggcaagaggctcatg

SEQ ID NO: 779 - DNA, 200 bp, Homo sapiens
ccccaatggaaaaatcccttctcccacttttcttaaccctacaagatatgccaagattctatagcatctgaatttgaaaacctctactaattcatgaggcaatctatttgataatggcatgatttagttagtgttccttttttagagataaagcctcactgcactccagccggtccacagagtgagaccctgtctccaaa

SEQ ID NO: 780 - DNA, 314 bp, Homo sapiens
cggcacgagctctcatggaaagggggctggtacctgtcaaagtgttattttatgcaacaatatagtcactttttattttggcaattagaagtagactcaaaggagattacaatttggttgctggcagccattctgggtttcttgattttagtactccaaagaatatggtggtctcatggagtagctgaccactaaggaggggaggattaaaagggaatcacttatcagtttttagcataggatgcattaaggaatttcaacgggtaactgacaatcgtttgttaagaagttaactgtatcatagctcactactg

SEQ ID NO: 781 - DNA, 317 bp, Homo sapiens
gcaattcctacaagctcccgtacagctggatcggcacaggccacgtggtatacaatggcgccttctactacaatcgcgccttcacccgcaacatcatcaagtacgacctgaagcagcgctacgtggctgcctgggccatgctgcatgacgtggcctacgaggaggccaccccctggcgatggcagggccactcagacgtggactttgctgtggacgagaatggcctatggctcatctacccggccctggacgatgaggcttcagccaggaggtcattgtcctgagcaagctcaatgccgcggacctgagcacacaga

SEQ ID NO: 782 - DNA, 375 bp, Homo sapiens
gaacaatggcggagctgggcgaagcgaatgaagcggagtttgcagcgccttggttggccgccgagcagcagaaggcgcagtttattgcacaggggcatcacttcatggggttatgttgggtataaatgtgtggagaagccagggtatcgcctagactctcgcactgaaaattgtctctccagctgtgtagaccccttcattgacaccactcttgccatcaccagtcggtgtgcccagattgtacagagaggaggccagtaggccatcccccaggagagtgacagacgcaaggcacttgttcactaacgcagatttaagggtcagtgggggagggctatcacccatttgtcagatcagcatcacgctgttgatcaa

SEQ ID NO: 783 - DNA, 371 bp, Homo sapiens
ggtcatccagcaggtgttcgacaatggcagcatctcaaccctagaagtgcttgatatcacagaggaaactctgacattctcgcttcctggagggtgtccgcaatgttaccagtgtctgtctgcagattgagctacccaactgttgcatcagtaccccattctatcatcaacgggtacaaacgagtcctggccttgtctgtaggagacggattacaccttcccacttgctgaaaaggtcaaggccttcttggctgatccatctgcctttgtggctgctgcccctgtggctgctgacaaccacagctgctcctgctgctgctgcagccccagctaaggttgaagccaaggaagagtcggaggagtcgaccgag

SEQ ID NO: 784 - DNA, 300 bp, Homo sapiens
gcttctccccatctttcaaaagaatcacgaaatttcttctgcaccttggctattctgtttaaatctgataatcagttgatctcaggtttttcactgtacattactttgcagatatggacagcctttacacaaaataatttttaaatgcttaattattttaatttgttctcttaaggtaaccttcagttattttgaattaatttaacttctcaattatgccaaagttgcacttgcatgaaataaatattattttgtccttgtatagactggaacagtaataaatttatctgaattaaaaaa

SEQ ID NO: 785 - DNA, 172 bp, Homo sapiens
tggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaaa

SEQ ID NO: 786 - DNA, 377 bp, Homo sapiens
gagataaccgtgcctgttcagagtgtctacagtaagagctggacaaactctggagggacacagtctttgagacagctcttttggttgctttccacttttctgaaaggttcacagtaaccttctagataatagaaactcccagttaaagcctaggctagcaattttttttagttgcaactaagtaagatatactacaaactaaggatgctgctagactaaggaataaacagcaaggtaccaaagtacagcaaagcaacaacaaaggctctgtatttgcagaggggtctatcatgcttttaagagaaaagaagagtacagggaaaaaattcagatagacataagagtattttggatgccattaaactttgtcaataacc

SEQ ID NO: 787 - DNA, 172 bp, Homo sapiens
catgattggatacatttctattttgttttcccttctgctttttgatggaacagcacagtaagttgaatcaagtcctgctcatgtgtgaagaagaaactcttccttctttacattaatgccatagaagaagtcaaaaaaggacaattagcaagcagtgggcttctgggaaaaa

SEQ ID NO: 788 - DNA, 379 bp, Homo sapiens
cgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgccttaggggtggctgttaattcttcagtcatggcattcgcagtgccccagtgatggcattactctgcactatagccatttgccccaacttaagtttagaaattacacgtttcagtaatagctgaacccg

SEQ ID NO: 789 - DNA, 376 bp, Homo sapiens
ctcgtgccgctcacattgcatgcaagtttgctgagctgaaggaaaagattgatcgccgttctggtaaaaagctggaagatggccctaaattcttgaagtctggtgatgctgccattgttgatatggttcctggcaagcccatgtgttttgagagcttctcagactatccacctttgggtcgctttgctgttcgtgatattagacagacagttgcggtgggtgtcatcaaagcagttgacaagaaggcttcttgagcttgcaaggtcaccaagtcttcccagaaagctcagaaggctaaatgaatattatccctaatacctgccaccccactttttattcagttgtggaagaacgctctcagcactcttttttccaa

SEQ ID NO: 790 - DNA, 340 bp, Homo sapiens
attcacacacctaccaatggaagatgagagctaagaaagtcagctatcccgaattggtgagtcgcagctttacagtcttcaagaactacaactcatttataccacaagtatgttgacgtaattttcagcttaccgaacatatgaaaatttccctctctctctaataaataccctccaaagcccagaaatttggctttgctactgacaaccctttggtaaaccactactcgcaggtaaaagagtttaacctcacaaagctgcaattatctggatttgaatatgcttcccccctctacacatatacctctctcctctaaggccatccatgcttttctgagct

SEQ ID NO: 791 - DNA, 280 bp, Homo sapiens
cagcatttcaagtgccagaagtataactttctaaggagagaagggttgtcacattataaaatctttaggaaaatgtgaactggaaaacgcttcggtcagttttagtgacatagcctgtgatgatgggtctggtgactattattgcggaccgtggtacccagttttaggaatgtggagaaaggaattctgttgattccgttgaggaatctgtagcgtatgcattcgttctgttaagagcaaatctaggagaagtgcttcagctgcccagtgcgccgtgggg

SEQ ID NO: 792 - DNA, 217 bp, Homo sapiens
tggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcggcttaatccaagcctacggttttcacacttctagtaagcctctacctgcacgacaacacataaa

SEQ ID NO: 793 - DNA, 287 bp, Homo sapiens
aaaaggagggaaacgtcaactccattgcaattacttatcttcctcttctatctctgttatacgccggggcatagaatgctcgtatacatctctttaacaaccacaaaccttaagccatgtagatgaagttagtgcatcaacgggatacagttccatattgccttaaaccttcttgttttagacacacttacatttatatccaaattgcagattattctgcagagagggaattgcatgtttgtgttgtatatttagtatgaactttttcagaatataatatttcttag

SEQ ID NO: 794 - DNA, 288 bp, Homo sapiens
tgtcaaagcgctaaccagccaggggcaggcccctgatgcccggaagctcctgcgtgcatccccgggatgaccagactcccggactcctcaggcagtgccctttcctcccacttttccttcccccataggcacaaggctctgcttctgcttctgcctgcaagttctctctgttgttggagccttgagccttgctctctggggcacagagggggttcactctcctgcctgctggggacctatggaagggggcttcctggccaaggcccccctctttccagaggaggagca

SEQ ID NO: 795 - DNA, 275 bp, Homo sapiens
cttccatcagtcccactggaatcactggagctgggatggccttcagagttgttccacatgaggcaagggggccatgtttttgtaccccacattgaagagtactggatatgggctggccctgggaagaggtgtgacctagggtgaggaggctccctgaagtagaaggcaatttgtagcttgagagcttatagtgtaacagcaatcccaacatcagggaaaaggagccccttagtcctctaagaaaggtaactgcatggcacactactgcatcccac

SEQ ID NO: 796 - DNA, 275 bp, Homo sapiens
gaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaacctggacccagtagagaaagcccttcgagatgccaaactagacaagtcacagattcatgatattgtcctcggttggtggttctactcgtatccccaagatt

SEQ ID NO: 797 - DNA, 150 bp, Homo sapiens
cggcacgagaaagactaaatcagtagagttggaaaagctttataaccggtgtgtcatatgcttgctatttaaagctgtgtgttggttttgtttttctgccacattcactaggtttttaataaatattttcccaaaatgggaaaacaaaaa

SEQ ID NO: 798 - DNA, 345 bp, Homo sapiens
gcagccctggctaagttaatcccaccgctttcagtggtagaaagaattccctgagtgggccaggctggtgccctcctcctaccctggcttttctgagtgagctgcctggagccctcatcccctctcccaggctgggctggccctgggcggggccactgtgtgctggcccactgtgacctgacccgaccttgtgcagcccccctgccctggtgtcctgggttttcgtgatgatctttgctctgtttccagtggggtttgaagcagagttcaggggaaccctgcccaaggtcctcctgttcagacattcctatgttgaataaagtatgtttgacttccccggaaaaa

SEQ ID NO: 799 - DNA, 245 bp, Homo sapiens
cggtctcagaactgtttgtttcaattggccatttaagtttagtagtaaaagactggttaatgataacaatgcatcgtaaaaccttcagaaggaaaggagaatgttttgtggaccactttggttttcttttttgcgtgtcgcagttttaagttattagtttttaaaatcagtactttttaatggacacacttgaccacaaatttgtcacagaattttgagacccattaaaaaagttaaatgagaaa

SEQ ID NO: 800 - DNA, 268 bp, Homo sapiens
cccaactggagtgttgctttgaagatgacgccttcttatattttcatagcaaatgggtggtatcaaaatcagacattgcttcttgctgataaaaagcctgaaggaaataagtgaaactacatctatgggaaaaaaaaaaacattgagaagtgcaaatgttcgcatccttttgtttttaaaagatatgatgtcagaataaaatgtggaaacatacgggaaactagtctagactttaaagaattgtgatcaggtcacattgttaataaaa

SEQ ID NO: 801 - DNA, 135 bp, Homo sapiens
ctaggatggggggcatggccctggctgccagatgcccacagcaccctggcatgacctgccacctctgcttccacaccggagccagctacctctcctgtgcctgccactcaataaacagtgtctgcgccccaaaaa

SEQ ID NO: 802 - DNA, 150 bp, Homo sapiens
attgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacattaaaa

SEQ ID NO: 803 - DNA, 384 bp, Homo sapiens
tcttccctctgctcctgaagaagacactatctttatctaccaagccactttgctatgcaaacgtccttgaaaagatagtccagaaaaaaagctgtcagatactttctttgcaagacgtgcagacatatgactctctcccaagggtggtctcattaacttagagcaaaatgaaagtatagatatcttttttgatgtgcaataagtgacaataattttgcagcagaagatatgctccacacactggtataatatatataatcaattctgattcttacacatagcagtgtcaattgacataccattgcagtaattgttgcctaattcttgcctccaaatgaattcaatatgcaattgcatttggcccattaaaaattctcttgggac

SEQ ID NO: 804 - DNA, 369 bp, Homo sapiens
tcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaggatccaggataagggaggcattccccccgaccagcagaggctcatctttgcaggcaagcagcttggaagatggccgtactctttcctgactacaacatccagagggagtcgacccttcacttggtcttcgcttagaggtgcattcagg

SEQ ID NO: 805 - DNA, 382 bp, Homo sapiens
ctcgtgccgaattcggcacgaggccccactccgcgcctggggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtccttcaacatgatcctggaggaatcgtggtggtgctggtgttcacagggtttgtgttggcagcccacaattaaggcgtgcttcgccggatgaagaagcgctacccacgacgttcgatataggtggtcatattcgcgagctatttcctcatctccatgttttgaggagatcataggctttgtgtttgca

SEQ ID NO: 806 - DNA, 345 bp, Homo sapiens
aattcataggttttgatgtcattgttgaagttatttgtaattcagaaaccttgcttgtgtgatacatagtaagtctcttcatttattactgcttgtctgttgttatatctggagttatcaaaagcaatagtgcaccaattaagatgtgctcaaatcaggacttaaatcataggcaccacattttttcatgtcagactagttactttgttgattctcagttactgtaggcatcaaaaggcaaaaatcaaaaaaaaaaaaaaaaacttcgggggttccttttggggcggccgggggcccatcgtttttccccccggggggggtcccaggtaagtttccccattcgcc

SEQ ID NO: 807 - DNA, 396 bp, Homo sapiens
caccagtggggcatttttacgaaccccaggctccctctgctgaggtgggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaaggactgggaggctgcacaggtgactatccagtcttcagggacattttcagcaaattcaagtggacaacaacaaccgcctgttactgcagcaggtctcattgccagagctgcctggggatacagcatgaaagtgacagggaagggtgtgtctact

SEQ ID NO: 808 - DNA, 394 bp, Homo sapiens
gtcccaggtgcggctgctgtggaaggacccgcgaaacgtgggttggaaggacaagaagtcctatcgttggttcctgcagcaccggccccaagtgggctacatcagggtgcgattctatgagggccctgagctggtggccgcacagcaacgtggtcttggacacaaccatgcggggtggccgccttggggtcttcttcttctcccaggagaacatcatcttgggcaacctgcgttaccgctgcaatgacaccatcccagaggtctatgagacccatcagctgcggcaagcctagggaccacgggtgaggaccccccggatgacagcaccctcaccgcggctagatgggggctcttcacccagccccaggggtggccctcctcagggggagttaga

SEQ ID NO: 809 - DNA, 403 bp, Homo sapiens
gaacatcacctaccactgcaagaacagcgtggcctacatggaccagcagactggcaacctcaagaaggccctgctcctccagggctccaacgagatcgagatccgcgccgagggcaacagccgcttcacctacagcgtcactgtcgatggctgcacgagtcacaccggagccttgggcaagacagttatttaatacaaaaccaccaaggccttccgtctcgcccatcatcgatgtggcccccttggacgtttgtgtcccagaccaggatttcggcttcgacgtttgccctctcttcttctcgtaaactccctccataccaacctggctaccttccacccaacaaattttcccccaacccggaaacagaaaagcaacccaaactgaaccccacaaaagccaaaa

SEQ ID NO: 810 - DNA, 351 bp, Homo sapiens
ccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaacttgctacaaaagccgctcgcaagagtgcgccctctacttgaggggtgaagaaacctcatcgttacaggccttgtactgttgcgctccgtgaaattagacgttatcagaagtcactgaacttcttattcgcaaacttcccttccagcgtcttgtgcgagaaattgctcaaggctttaaacagatcttcgcttcagag

SEQ ID NO: 811 - DNA, 218 bp, Homo sapiens
  misc_feature 11, 12, 13, 14, 15, 16, 17, 18: n = A,T,C or G
aagagatcgannnnnnnntggcccacatggtgagaccccaactctactaaaaatacaaaaattagctgggtgtggtggcattgtgcctgtagtcttagctacttgagaggcttaggcaggagaatcgcttgaaccttggaggcagaggttgcagtgtagctcgagatcatagccactcgtgctccagcctctgtgtgcacagttgagactctcacctc

SEQ ID NO: 812 - DNA, 352 bp, Homo sapiens
ctcgtgccgaattcggcacgaggatccctgcagaacccaccaaccagaacgtggtttgcctgaggctgtaactgagagaaagattctggggctgtcttatgaaaatatagacattctcacataagcccagttcatcaccatttcctcctttacctttcagtgcagtttcttttcacattaggctgttggttcaaacttttgggagcacggactgtcagttctctggggagtggtcagcgcatcctgcagggcttctcctcctctgtcttttggagaaccagggctcttctcaagggctctagggctcccaggctgtttcagccaggaaggccaaatcaagggtgagtgtgga

SEQ ID NO: 813 - DNA, 340 bp, Homo sapiens
cggcacgagactcaacaacctaattttaaaactggacaaacacttgaatagacatttcttcaaagaagagatacagatggccaataagcacattgtcttagtccacttttgtgttgctgtaaaggaatacctcaggcttgggtatattagtccaccttttatactcctgataaagacatgcccacgactcagcaatctgcaaaataaagaggtttaatggacttacagcttccacctggctcgggaagcctcataatcatggtggagggcaacgaggagcaaggccatgtcttacgtcattgcagcaggcaaagagagagcttgtccaggcaaactcccc

SEQ ID NO: 814 - DNA, 367 bp, Homo sapiens
cccccacaagaccttcgacccctctctgaagccaaaatatgcaaagtgtgaccagtgtggaaacccaaagatgtgtgttcagcctgtgccgcggctgctgcaagaagcgagcctccaaagagactgcagactgcccaggtcacggattgctttttaaaaccaaattggagaggtctctggcctggaaaggaggcccacccttagctccaggagcctcaaccagcagcacctggaccaccaggtggcttctcgaggtcatgggcagtccttggccttaaggcccacaacccccacccccaggacttcttctggagcctggacacgcctacttaaggaaattccttttactcagggatctctcctactc

SEQ ID NO: 815 - DNA, 296 bp, Homo sapiens
ggccagttgtggtgctggtgcagctggagcgagaggaggaagtcacaggccctgtcattgcggcctctctttccgcagaaacgtgaagagggccttgttggttggtgattggagatgccaggtccaataggcctcatctccatcaagggggcttaccttccagcaagaggcccaaggtgaagttggacttttttggccccagccacttggtgcccacaactacactctgtactacagtgagtaagcgcttacaatgggattgtgaccaggagtacaaattcagcgtggatgtaaaa

SEQ ID NO: 816 - DNA, 221 bp, Homo sapiens
cggaccctgggccaaagcccggatccaggcgggagcagaagctaaagccaaagcccaagagagttgcagttcagcacttgtgccagtaccagtaccaataacagttccagttccagttccagcaccagttgttggtttagttcttgtgccaaccttaaccgcaattttaaaatttgggtcttcggttggccttgggtagatctgtgtccaagaccaattgg

SEQ ID NO: 817 - DNA, 230 bp, Homo sapiens
ggaaaatatgttgtgttcttcttttaccctcttgacttcacctttgtgtgccccacggagatcattgctttcagtgatagggcagaaggatttaaggaactcaactgcccaagtgattgggcctcttgtggatctcacatcctttcaactaggaatgggcaaatcaacctaggaacaaggggggcctgtgcccccttgcaaatcctttggtatadagccccgaggcgaac

SEQ ID NO: 818 - DNA, 163 bp, Homo sapiens
atcctaccaacttttacctccaacaccttgtaacagatcagagcgtaacgagcactgctcactctgtaaaggggcctcaacattagtgggtacacatttcacatgggcctttgggaaaaccctttttgtcccgctgaaagtcaggctcacaaaaattacgggt

SEQ ID NO: 819 - DNA, 194 bp, Homo sapiens
ccatttgcttcccagccctgtgagtttttacccggctttgcctgccacctctgtcccaggacacgctttccctctcggggatgtgtgatgaactcccaggagaagggaagattgggagccacggcaagatatggaagctcttcccctcagcttttccactagggcacgccagccacgagccctttataagcgtg

SEQ ID NO: 820 - DNA, 351 bp, Homo sapiens
aatgaactagttaaacatggtctgcgtgccttaagagagacgcttcctgcagaacaggacctgactacaaagaatgtttccattggaattgttggaaagacttggagttacaatctatgatgatgatgatgtgtctccattcctggaaggtcttgaagaaagaccacagagaaaggcacagcctgctcaacctgctgatgaacctgcagaaaaggctgatgaaccaatgggacattaagtgataagccagtctatatatgtattatcaaatatgtaagaatacaggcaccacatactgatgacaataatctatactttgacccaaaagttgcagagtggtggaatgctatg

SEQ ID NO: 821 - DNA, 214 bp, Homo sapiens
ctggctccctcccacccaaccaactttccccccaacccggaaacagacaagcaacccaaactgaaccccctcaaaggccaaaaattgggagacaatttcacatggactttggaaaatatttttttcctttgcattcatctctcaaacttagtttttatctttgaccaaccgaacatgaccaaaaaccaaaagtgcattcaaccttaccaaaaaa

SEQ ID NO: 822 - DNA, 345 bp, Homo sapiens
ctgaggctgatttggagcaatataaaaaagctttaactgatgcaggatgcaaccttaatcctttacaatatatcaaccagttggaaggccttttaccaagatggcctcagctccggccagctatggcagcactaccactaaaccaatgggtcttttatcacgagtcatgattacaggatcacagtttgtgatggaagaagtaagaacctggttttgaaacagcaaaatctacctgttactcgtattttggcacactctcatggagatgaagtccacaccccgacactgatgcctatagatattttgacccaaaatgctgcgggacaatcacagctcagtcccaga

SEQ ID NO: 823 - DNA, 360 bp, Homo sapiens
ctggcatcaaaggacatcgaggattccctggtaatccaggtgccccaggttcttccaggcccttcttggtcaacagggttgcaattcggcaagtccaaggacctgcaaggccccagaaggacctgttggacccagtggacctcctggcaaagatggaaccagtggacatccaggtcccattggaccaccagggcctcgaggtaacagaggtgaaagaggatctgaggtctccccaggccacccagggcaaccaggccctcctggacctcctggtgcccctggtccttgctgtggtggtgttggagccgctgccattgctgggattggaggtgaaaaagctggcggttttgccccgtatta

SEQ ID NO: 824 - DNA, 150 bp, Homo sapiens
cttttatattgctaagggtaaatatgcatcatttttagtggctgcatagagttccattgtgtggctcttgcattatttatttaaccaaccccaataaatacaactgctaatttttcacctattaaagttcaatacccactcttaatatat

SEQ ID NO: 825 - DNA, 151 bp, Homo sapiens
gcctccaagatgacaaagaaaagaaggaacaatggtcgtgccaaaaagggccgcggccacgtgcagcctattcgctgcactaactgtgccccatgccgtgcccaaggaccaagggccaattaaggaattccggtccaattccggaacacta

SEQ ID NO: 826 - DNA, 173 bp, Homo sapiens
gcaaatattccaggggaaagaaaagacaaaagtttgctgcaatgcacttccacagtactctttcccgttctaatgacatctggttaatgaggcacaagctgagcgtgacttcctttcatattggagggaaggcaggacattaagggacccagagggagccaaggaggcaggac

SEQ ID NO: 827 - DNA, 190 bp, Homo sapiens
tgaactgttatcccattgaaaagaccgagccttgtatgtatgttatggatacataaaatgcacgcaagccatatctctccatgggaagctaagttataaaaataggtgcttggtgtacaaaactttttataccaaagggtttgcaacattctataatgagtggtttactggtaaatataggtatattttt

SEQ ID NO: 828 - DNA, 150 bp, Homo sapiens
ctttgctttatttttcaggctacaatacaggtcagagacaatggcttataaaggtttagtgttggcttcaggatgttacaaggcagtccagccttaacctttttttacaattcaggcaaaacttccaggaaagagtccttttgtccctct

SEQ ID NO: 829 - DNA, 197 bp, Homo sapiens
ggaggtgcagccatctccttctcgctggcgatttggaagacactctgcgacagtgttcagtccctgggcaggagagcctccttccaggattcttcctcacctggggccgcttcttccccaaaaggcatcatggcggccctcagaccctttttgaaggcccaagatcgtcaaaaggagaccaagagttcatccgcaca

SEQ ID NO: 830 - DNA, 165 bp, Homo sapiens
ctaaactaccaaacctgcattaaaatttcggttggggcgaccttggagcagaacccaacctccgagcagtacatgttaagacttcaccagtcaaagcggacttactttaactcaattgtatccaataacttgaccaacggaccaagtttacccttagggttaaca

SEQ ID NO: 831 - DNA, 141 bp, Homo sapiens
gaagatcaccattgctgactgtggacaactcgaataagtttgacttgtgttttatcttaaccaccagatcattccttctgtagctcaggagagcaccccttccacccaatttgctcgaagtaatcctaggaatccttggtg

SEQ ID NO: 832 - DNA, 150 bp, Homo sapiens
agggataacagcgcaatcctattctagagtccatatcaacaatagggtttacgacctcgatgttggatcaggacatcccgatggtgcagccgctattaaagggttcgtttgttcaaccgattaaggtcctagcgtgatcttgggttcaag

SEQ ID NO: 833 - DNA, 150 bp, Homo sapiens
cacagattccgtcctttaccagctgcagaatcttgggcaagttacatagcctctgtgagcctcatcggtaaacagtgggggttatgatacccacctcacagggttgttgtgaggatccaattaggttgatttagggaagcacctaggcaa

SEQ ID NO: 834 - DNA, 150 bp, Homo sapiens
atagaatacacccttttacatcactcacactagggctcatacacctctcccaggacctttaactgaagggaatcaaatggctgatggcctagttgctactacattatctattgccagccaatttcacattttacccatgtttaatgcctt

SEQ ID NO: 835 - DNA, 251 bp, Homo sapiens
cccagttgaccgcccggcaccactagctggctgggtgcacccaccatcaacctggttgacctgtcatggccgcctgtgccctgcctccacccccatcctgacactcccccagggcgtgcggggctgttcagactggggtgccaggcatcttctagcccacccggggtgttccccacatgcagtactttatacccccatccctcccttggtccacttaacttagagcagttccattcctccccgccatcttt

SEQ ID NO: 836 - DNA, 251 bp, Homo sapiens
atttgctgcctggaaaattctcggatatgaccgctgtgatgcgggctggttggcggatggcagcgtccgctaccccatctctaggccaagaaggcgctgcagtcctactgaggctgcagtgcgcttcgtgggtttcccagataaaaagcataagctgtatggtgtctactgcttcagagcatacaacttaatgtccccttagggcgcatcagttttaaaggtcattaagcacatgtaaaggtgtttttttt

SEQ ID NO: 837 - DNA, 363 bp, Homo sapiens
ctgaaaacaccaggtatttcaggagacgcctgaaagagatggggtttcatcatctatggaaattgaagactctccagtagtgcctttgatgctctacatgcctgcaaaattggcgcctttggacgggagatgctgaagcggaacatgcggtgttcgttgtggttggatttcttgcaccccaattattgagtccatagccaggttttgctgtcagcagctcataccaaagactacttgatactgctttaaagagatagatgagtaggggactattgacggtcagtgattcctgactcggttgtgactctactgacaggcctttgacgagacgacgtatgaggaacaaagtcatagcctttttgg

SEQ ID NO: 838 - DNA, 256 bp, Homo sapiens
ctcgtcacattttcggcaggttaaaagttctgttaactaactgaaagggggaaaagaactcttaagaagcagcaaggcagttaactccagaaagtggcttctacacctcagactaagggaaaaatgaacagggagggactccaacgattggaaaggtcctgccagcctggattcagacctctgaggagagtactcggtgtacaggacatgctgcctgtagtctagtgccaggaaacttctgagggtaccctgttaw

SEQ ID NO: 839 - DNA, 380 bp, Homo sapiens
caaacaccagagtctgtacttttctataacacagctcagattaaggtagggcatatgcaaggaggttctcacctccctaaagaagggacttgaatttagggcttaattcaccctccttcaatacaactttccccttcttgtttgacatgccagatactgctttatgcaggctgtaccccttgaaaatcctttctacagtgctgctcacaaagagcccagttcgcctcctacctccattgctgacttgaattcacagtcgccgagtctacctagctttcttggagcagtctagcaaaatttctatttgtacgttcactaattatctacaaggacaaaatcagttgtatttacaaactctacttcagtgtttgtttaggttt

SEQ ID NO: 840 - DNA, 272 bp, Homo sapiens
cggcaccgcgctcgcctgattcgggccgaacccaaaggatcaatcgatccgagtgcaagaccacgccggacttcaagcctccagaagcctttacaacgccaatcaacgaacctaataagtagcttgtcctgcctgaggagcgcttcgaggtgccataaagacagcaggaggatttagtagggccagaggactcttctcggcctttagcccgttcatccttgctaccctcgctcaggtacaaacgaggagagccgccgtccagcatgccgctt

SEQ ID NO: 841 - DNA, 119 bp, Homo sapiens
ggactattagagatggcatctcatcgatgagagagaatcacaatcagaatggaagcactttgagtatctgaagagtgaagagcattcatgttttgacaggtcctgcttcccactatcct

SEQ ID NO: 842 - DNA, 320 bp, Homo sapiens
ctctgaagttataggcatttcttgctgtttaatagttacattatcacaaaacaagccctattcatgattgaggactatggaaatagtgacttcttgaggaggcaccaaactttcctagaactgggtactctcagatagtggctgctatttctattctatttcagtgacgtagggttgggctgatgtaaatagacatcatattactaaatagagtcctataaaatgcaatcacaggtgcccgggagtactagttttaaacatttccttaacaggagacaatccagcaaaagcttcttctctatacaggtatatctctaact

SEQ ID NO: 843 - DNA, 223 bp, Homo sapiens
ctgggcatttgccttgtagctgaagctatgggtctctgcattgtttgatggttgctttcttgattttgtttgccatgtaacaaattactgcttgacatgttggcattcatattaattacgggagtaattctgtgtatcttactgtgactccgaaaactgtagtattggtgtcatggggatgtacgttattttcaagttatttcattaaagagaaactttaaaa

SEQ ID NO: 844 - DNA, 231 bp, Homo sapiens
gcgatatgccaacgtaccaagaagtcgggatcgtcggtaaatacgggaccgctatagggcctcctccgaaaataggtgaggaaattgaaatcagccagcacgcaagtacacttgctctttctgtcgcaaaaccagatggagagacgagctgtcgggatctgcactgtggttcctcatgagacagtgctgcggtctcgacgtacatacactccgtgtacggtaagtcccatc

SEQ ID NO: 845 - DNA, 180 bp, Homo sapiens
ttgcactttttgggccttttttttatagcttggaacaacaaaataccaccctacaaacctgtatttaaaagagacagagatgaccacgtgaaatttgcctctgtccaaacaattcatccgtgtgtatgtgtatgtgtgtgagtgtgtaagccgccagttcatctttttatatggggtgtg

SEQ ID NO: 846 - DNA, 151 bp, Homo sapiens
attaaaaggtctaacatacatgagtcccagacaataaaagggtatgatgttggggcagggaaaaaaattggaggacatcatgccatcatttcccacatttggcgaagcatataaatgtacatggtcagaggttcagccaaactccaggcag

SEQ ID NO: 847 - DNA, 250 bp, Homo sapiens
cggcacgaggttttgttgagcatgacagcctgcagcaggaaatatatgtgtgcctatttgtgtggacaaaaatatttacacttaggggtttagagctattcaggaggagatgtcacagaagcagctaaaccaagggctgagcaccctctggattctgaatctcaagatgggggcagggctgtgctttaaaggccctctgagtcatctgttagggccttggttcaataaagcactagcaagttgaaaaaaa

SEQ ID NO: 848 - DNA, 150 bp, Homo sapiens
catcgttccaatgcttgttcactgttcctctgtcatactgtatctggcatgctttgtaatacttgcatgcttcttagaccagaacatgtaggtccccttgtgtctcaagacttttttttttcttaattgcatttgttggctctattttaa

SEQ ID NO: 849 - DNA, 205 bp, Homo sapiens
gagtcatttgtgcaagtagacggggtctgtgggtgcaggccctggagggaacacaattgcctggaggcttctgtgagatcgggagaggaaggagaggcagtctcttgacaaaataagtatttttattcatttgtatttattaaatgaaaaacaattccaatggtgtcctgttgtgtggtggaacctaatgactgttgaataaagt

SEQ ID NO: 850 - DNA, 259 bp, Homo sapiens
gccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatcgcccaacatttggttatgggagcaacaaaaaaacagggcacattctgcccagtggcttccggagttcctggtcc

SEQ ID NO: 851 - DNA, 336 bp, Homo sapiens
gtggtgggctgagccagggtctaggtttctgtgggggacactgaatctcccagtgttcagtctcccaggactctgctgcctcagccagagcctccatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttactttaactgaccatttaagttttttaataagtttttacaagaaagttaacattaaaagattacagcttctgtctccttaaa

SEQ ID NO: 852 - DNA, 216 bp, Homo sapiens
gtcaacaaccgcttcgagctgataaacattgacgatcttgaggatgaccctgtggtgaacggggagaggtctggctgtgcgctcacagacgctgtggcaccagggaacaaaggaaggggtcagcgtggaacacagagagcaagacggatggagatgacaccgagacagtgccctcagagcagtctcatgcaagtggcaaactccggaggaggaaaa

SEQ ID NO: 853 - DNA, 327 bp, Homo sapiens
ccctcttcctccttgtttctctctttcctctggaactcccaccttttcttctattagctgcatgttggtttttgtctgttacaaattgagctactgtaatcattagtgtgtaggtctttgtgtgggaatattctttctcttctcttgtgttattatctaaaagtgcaatgcctttgttgcagggtaggtgaatattttacattttaagaaactcccaaattgtgttctaaagttattataccattttacatcccctgcctcctgattggtgagcaagagttccagtttcgtcacataatcaccaccaattgctatgatctgtgtttt

SEQ ID NO: 854 - DNA, 160 bp, Homo sapiens
ttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcaaaaa

SEQ ID NO: 855 - DNA, 188 bp, Homo sapiens
ttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactctttgggggaagagaa

SEQ ID NO: 856 - DNA, 337 bp, Homo sapiens
cttattcaggaccggcacttcttaatgtttgtggctttctctccagcctctcttaggaggggtaatggtggagttggcatcttgtaactctcctttctcctttcttcccctttctctgcccgcctttcccatcctgctgtagacttcttgattgtcagtctgtgtcacatccagtgattgttttggtttctgttccctttctgactgcccaagggctcagaaccccagcaatcccttcctttcactaccttcttttttgggggtaagttggaagggactaaaattgtggggggaggtaggaggcacatcaataaagaggaaccaccaagctgaaaaa

SEQ ID NO: 857 - DNA, 183 bp, Homo sapiens
tgcacacggaaagaactctgtttaaatgctcagttcagaacactttgggccacatagtgattttggaaaacaggataatcgtggtgtaaatgagtgtttcctttcaaagtccactgcagagcttttatccatatggtatgcacatgtagccaatattggtttctttttcttaatatatatatt

SEQ ID NO: 858 - DNA, 303 bp, Homo sapiens
gagtagttcttggtaggtgcaggaatagtagtgtcatttggaatactggtcatctttctgacatcacagtagaaaccaaaccttggatttagattcaaaagggggggaaatgggtcttttcatcaaggcaactccccttctccaagtcacttacatcatagataaattttagcttccagtaactgagggatttgtttcctaacggcattggaggcttcatcctctctacgataaggttgcagaaatgggaggagctacccgtgggttgcttttgattacccttaggagggagacaggtttttg

SEQ ID NO: 859 - DNA, 243 bp, Homo sapiens
attggtcaaccaaggtggaagccaagagaacaagaggggaggttaatgtggtccattcggatcaatcttcctgggcacagaacaagatgaagaaaaatggaaagtagattttgagaggcaaatagaaatttcccgcatagcccttttaaagacactctaattctgaaaaaaggttacttctagttggttgcctctcataatctcgcctcaaaattccatggtttctataaataaaggtagtaa

SEQ ID NO: 860 - DNA, 335 bp, Homo sapiens
gcaaaaacagggggtgctgtagaccggctgacggacaccagcagatacacgggctcccacaaggagcgctgtcgatgagagcggcaagggtcaagggcattgcgggacggcaggacatcctggacgacagtggctacgtgagcgcctacaagaatgcaggcacctacgatgcctaaggtgaacgaagtaaggcttgggaagaccgccctcccaagtgcggctgccctgccagagtcaggctgggtctaagggcacgtggagcaagaaatcctggtccctcctctggaccttccaccagagcttcctgcctagtccactggcttggccaccaggct

SEQ ID NO: 861 - DNA, 283 bp, Homo sapiens
gtggggaagagcaacaggcgagatgcctcattctactggaacatcactgtgggtgaacagagatttccaggttttaccctcttaaaatatttgtaccacaccgacaagagtccagtcaccagggctcaaaggaacttctgcttgtagcagcccgcctccctgtgccccagcctccttaatgtgtgcactctcgaggggcacagctcacgaggctgggtttggggccaagtgcttgttcattccagcatctaacatcataaggtggcccagatttcttgattcg

SEQ ID NO: 862 - DNA, 219 bp, Homo sapiens
caaaggctgcgaggttgtggtgtctgggaaactccgaggacagagggctaaatccatgaagtttgtggatggcctaatgatccacagcggagaccctgttaactactacgttgacactgctgtgcgccacgtgttgctcagacagggtgtgctgggcatcaaggtgaggatcatgctgccctggcacccaactggtaaggttggccctaaggagccctt

SEQ ID NO: 863 - DNA, 206 bp, Homo sapiens
gtccacatgacccttgtggcacagatgcccacgtatgtgaaacacacatggacatgtgtcccagccacagtgttatgctctgtggctggctcacctttgctgagttccggggtgcaatgggggagggagggagggaaagcttcctcctaaatcaagcatctttctgttactgatgttcaataaaagatagttgccaaggctgaaaa

SEQ ID NO: 864 - DNA, 221 bp, Homo sapiens
ctcatcgcagttctccccacggctactccaggtccagtcttgaaatccgtcctctccatggacttcccacatccctctctgctctaggtttgattaacagaaggttgtaaatgaaaaccagcatctccgagggcagccatggtctactgacagatggcaagttactttgtaacctgtaattttgtttttttgaattttgtataaataaacaggctaactaa

SEQ ID NO: 865 - DNA, 90 bp, Homo sapiens
tacacaatggtgctattctgtgtcaaacacctctgtattttttaaaacatcaattgatattaagcatgaaaagattattggaaagtaaaa

SEQ ID NO: 866 - DNA, 380 bp, Homo sapiens
gattaaggaagtccaggagttttacaaggacacctacaacaagctgaaaaccaaggatgagccccagcgggaaacgctgaaagccatccactatgcgttgaactgctgtggtttggctggggggcgtggaacagtttatctcagacatctgccccaagaaggacgtactcgaaaccttcaccgtgaagtgctgtgctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaaga

SEQ ID NO: 867 - DNA, 379 bp, Homo sapiens
acagattcacaatttagaagaccgtttgaagaaatatgaaaagaatgtatatgcaacaactgtggggacaccttacaaaggtggcaatttgtaccatacggatgtctcactctttggagaacctaccgaatttgagtatttgcgaaaagtgctttttgagtatatgatgggtcgtgagactaagaccatggcaaaagttataaccaccgtactgaagttccctgatgatcagactcagagaattttggagagagaagatgctcggctgatgtcatggctccgatcttcatcttgaagaagagtgacattgggtgactgctgcttggaaaactgtccacacttgctactctttgagaatgaagttgtcattcagggccct

SEQ ID NO: 868 - DNA, 105 bp, Homo sapiens
cacccagaggctggcccagtgagggcccgcacaccacccacgtgcctccagacagcgagtgacatcccatctcctcctctgcattaaagatgacctgctgaaaaa

SEQ ID NO: 869 - DNA, 362 bp, Homo sapiens
ctcgtgccgaattcggcacgaggaagaatgttgatggtgctagaagaatttgagaagaaatactcctgtattgagttgtatcgcagtggtgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggtttcccaaagagaaacaa

SEQ ID NO: 870 - DNA, 368 bp, Homo sapiens
gtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagtttgcaggttttcgcaggccaagcaattggggcttggacacaaggtcggtggcccaaaaagagttctgaatttttgctgcacatgcttaaaaacgcagagaggtattctgaacttaagggtttagattagagtctctggtcattgagcatatccaagtgcaca

SEQ ID NO: 871 - DNA, 200 bp, Homo sapiens
ggcagaggcaggaaactaactggtgtgagtcaaatgcccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaagtaaaa

SEQ ID NO: 872 - DNA, 307 bp, Homo sapiens
gagactccatctcaaaaaaaaaaaggaatcggacgaagacccacaggatgttgaagacaactttctgaagtatttttgagggacagcgatgtggccctcttttttaaagaataacgtgtcctgctttggcagagaagaagaaattagccactgcccgttttaaaggaaagatcgacctcttctgttttgttttgttttcctttcttttccctggccatgaggacaaaaattacttgagtggcccttaaaagagggaagtttgtttttcagctgttctcttttgcccgtaggggggagggttgggatt

SEQ ID NO: 873 - DNA, 306 bp, Homo sapiens
atagaataggaagtttctaaaagaaaacaattaagagcaaaattggttttgagtatagaaactgaaggatggcagtcttaactcataagtttttttacagagcacagatgggtaaactagcatgcaccatgttttttgtacatatcatgtgagcatgagacatggttttttacaatttttttaaatggtgaaaaaaagtcaaaaagaagggagggacatttttgtgacacatgaaaacactattaaattaaatttcagtatccaggaaataaagttttattggcacagctgtgctttattgtcttt

SEQ ID NO: 874 - DNA, 180 bp, Homo sapiens
ccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttaccaaaaaaaa

SEQ ID NO: 875 - DNA, 192 bp, Homo sapiens
ggaacatcaagattggaagcagaccagttaggaagttatagccatgattcaggtgagaaacatggtagttgagaccaagatggtagttctagaggtggttagaagtagtcacattctgtatatactttaaagatagagcggacacatttttcctggtgaatacgatggggttagtgttaaggagtagagaaa

SEQ ID NO: 876 - DNA, 199 bp, Homo sapiens
cggaaagctatcataatctttgttcccgttcctcaactgaaatctttccagaaaatccaagtccggctagtacgcgaattggagaaaaagttcagtggggagcatttcgtctttatcgctcagaggggaattcttccctaagccaactcggaaaaggccggtccaaaaaataagcaaaagcgtccccggggcccgtcct

SEQ ID NO: 877 - DNA, 317 bp, Homo sapiens
tacactcgcccgcgccatggcctctgtctccgagctcgcctgcatctactcggccctcattctgcacgacgatgaggtgacagtcacgggggataagatcaatgccctcattaaagcagccggtgtaaatgttgagccttttttggcctggcttgtttgcaaaggccctggccaacgtcaacattgggagcctcatctgcaatgtaggggccggtggacctgctccagcagctggtgctgcaccagcaggagggtctgcccccctccactgctgctgctccagctgaggagagaaagtgaagcaagaaagaggatcc

SEQ ID NO: 878 - DNA, 170 bp, Homo sapiens
ctcgtgccgaattcggcacgaggagactttgaggatcccaggattcagtattcctggcccagagggcccttgctggctactgggtgttagtttgcagtcctgtgtgcttccctctcttatgactgtgtccctggttgtcaataaaatatttcctggcctcctggagaaaa

SEQ ID NO: 879 - DNA, 306 bp, Homo sapiens
acacaccacggaaagagaagggttcacgggaagagaagcagaagccccaggctgagcggaaggaggagaaaaaggcggctgcccctgctcctgaggagggagatggatgaatgtaagcaggcgctggctgctgagcccaaggccaaggaccccttcgctcacctgcccaagagtacctttgtgttggatgaatttaagcgcaagtactccaatgaggacacactctctgtggcactgccatatttctgggggcactctgataaggacgggctgggtccctgtggtactcagagtatcgcttccctg

SEQ ID NO: 880 - DNA, 217 bp, Homo sapiens
cagatctgaatgttcagttctagccaaggtagattttactttcaactttttaatcagtatcactttctgtgcttaactatttggtggttaccttgtctgttttcatttgtctaaaattctgcagagatgactaaaatttgacataatgggggtaaatggattgttaagggtaacttcagtagaggattaaagcaagatgccattttccccatgactt

SEQ ID NO: 881 - DNA, 173 bp, Homo sapiens
ctcgtgccgctggaacacccacgctgacttcgccgacgagtgccccaagccagagctgctggccatccgcttcctgaatgctgagaatgcacagaaattcaaaacaaagtttgaagaatgcaggaaagagatcgagagagagaaagaaagggtcaggcaaaatgatcatgccg

SEQ ID NO: 882 - DNA, 187 bp, Homo sapiens
gtttgaatataatgtagaaggagtgacttccaaggaaatggctacccaacttgccttcatgcgcctgctggccaactatgcctctcagaacatcacctaccactgcaagaacagcattgcatacatggatgaggagactgcaacctgaaaaggctgtcattctacagggctcttatgatggtggact

SEQ ID NO: 883 - DNA, 183 bp, Homo sapiens
ccaagatgccgaaaggaaagaaggccaagggaaagaaggtggctccggccccagctgtcgtgaagaagcaggaggctaagaaagtggtgaatcccctgttttgagaaaaaggcctaagaattttggacatggacaagagcaacccgcccaaaagagacctcaccgctttgtgaaatggcccgc

SEQ ID NO: 884 - DNA, 313 bp, Homo sapiens
tttccgtggagctgtcgccatgaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacct

SEQ ID NO: 885 - DNA, 197 bp, Homo sapiens
tcagccgctacctatccatcttatggaggacacgcggacctatactaccccattgactttccctatcaggaccttaggactcgtctactttgggactggtgatggccattgtacgactgatggatatctctatctcccgtatcccccatctatacaccctacatcaaggactccccatcagagttgtcccctatttt

SEQ ID NO: 886 - DNA, 335 bp, Homo sapiens
tgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacattccaccttgtgggctcaagatggcagttaactttcattggcaatagcacagccattcaggagctctttcaagcgcatattggagcagttcactctccatatttcccccgcgaagggccttctcccactctgtgacacagagcgcaggggcattggacgcagcatttgagtttta

SEQ ID NO: 887 - DNA, 275 bp, Homo sapiens
aaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttctttttttttccttttttgtctatgaaggtgctgtttattttttttgggcctgtttgatgtatgggttaaacaatgttgtccaacaattaacaggggattttattttgctgagttgttctaacacaaaa

SEQ ID NO: 888 - DNA, 317 bp, Homo sapiens
ctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatcccacaagattttttaggcacatattaattacctgaactcgaaaaccattatgggcattcaagtgtgggcactctagttttgccccatagccacgtgacgtgat

SEQ ID NO: 889 - DNA, 399 bp, Homo sapiens
cggcacgagcccctgtgtgtggggatgaatgcttcaaggttgctgtcaggaaattcttaatctttgaatttgtatcttataagtcaagtccaatggaatgtccatgagagggctgggctttggattgcacacagtcctgccacctcccagcgtccctgtgcggttctcaccttctggccccccggcatcttaggccctgccagacctccctatcttcctcctacgtagagacttctactgccctctaccgcggaagagacatgggtgtgagcacgggagggtttggggtcaagtgcacactccctgggtatcttgggattggagcgtggtggtaccagcccagtctgggctggcaacactgctgtttgttcaccaggcgacttagttgggggtaagcct

SEQ ID NO: 890 - DNA, 124 bp, Homo sapiens
aaaaactcgaggactgtatttgtgactaattgtataacaggttattttagtttctgttctgtggaaagtgtaaagcattccaacaaagggttttaatgtagattttttttttgcaccccatgct

SEQ ID NO: 891 - DNA, 322 bp, Homo sapiens
ctcgtgccgaattcggcacgagtgaaattttactgccaatttttcaaaatacctgcttttgatgagtacagttacagtcaaatactgtagttagacaaattcttttttaatggtatattaatgttgcataccaaattgtatgagttaaacgtctcttcctgtgcagtttcatattagtggtgttttcagtgtaggtatcttaatatcaacttatcgtgggttttgggtatgtaatataattttagctcaatttgcaattctgtctgtatactttatgtcaatgtgaggttggaattaaaaggtagccctatgtcttaaaaaa

SEQ ID NO: 892 - DNA, 403 bp, Homo sapiens
gttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatcttgggcgcctggctcacgaggttggctggaagtaccaggcagtgacagccaccctggaggagaagaggaaagagaaagccaagatccactaccggaggaagaacagctcatgaggctacggaaacaggccgagaagaacgttg

SEQ ID NO: 893 - DNA, 255 bp, Homo sapiens
gtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcgaaaaaaa

SEQ ID NO: 894 - DNA, 305 bp, Homo sapiens
ctttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttgggggaacctcagaacttggtctattttggtgtcgtggaacctcttactgctttcaatacacgattaggtaatcaactgttttg

SEQ ID NO: 895 - DNA, 179 bp, Homo sapiens
gctacctgacccccgacctctggaaggagactgtattcaccaagtctccctatcaggagttcactgaccacctcgtcaagacccacaccagagtctccgtgcagcggactcaggctccagctgtggctacaacataggggttttatacaagaaaaataaagtgaattaagcgtgaaaaa

SEQ ID NO: 896 - DNA, 123 bp, Homo sapiens
caacctgaaaaaggctgtcattctacagggctctaatgatgttgaccttgttgctgagggcaccagcaggttcacttacactgtttcttgtggatggctgctctaaaaggacaaatgatgggg

SEQ ID NO: 897 - DNA, 265 bp, Homo sapiens
gaattcggcacgaggggaagttcagcttaatgtttaagaaaataagttttaactctatgaagattcctttaaaaactaaaggtagatctaccatttgatccagcaatcccactactggatctaccagaggaaaagaagtcattatatgagaaagacgccttcacattcacgtttgtagcagcaccattcacatttgcaaagcatggacccaccccaaatcccataatcaacaggtggataagaaacatggtatgtatataccaga

SEQ ID NO: 898 - DNA, 238 bp, Homo sapiens
tgctgacccagtttcctcccattgtggagggtctgcaggaatagcagtggtggctgcttgatttccctgtcgacagactgatcagccggtgtttctgcttggcttaaagtactctatgccctgtttttgagttgagagatgtcagtacctaaaggctttacactaagatggaatatgagaggagagtttagtcccctcctaatggttgtaaggaggtcagggcggacatttccttcag

SEQ ID NO: 899 - DNA, 100 bp, Homo sapiens
ctttacaaaaaacatatatgagtgtttgtgatgacatttattcctacatttgatttattgcttggttgattgcagagtatttgagcagactagtgactca

SEQ ID NO: 900 - DNA, 255 bp, Homo sapiens
cgtgggtgtatctgtaagagtaggatctgttaggattagtcataagactgtcagtaatcctgaagatggatgagataatccaggcccaggttcccaggggagggaaaatggagaaaatataaaagatgtgaaaaggaaaaggaaggtaataacaacaccaaagtgataatgatagttaaggaggttgctgacagggattatattagttacatacatactccttaacagttaatacattacaccttcaaaaaaaaa

SEQ ID NO: 901 - DNA, 354 bp, Homo sapiens
gccaaaatgaagtttaatccctttgtgacttccgaccgaaggaagaatcgcaaaaggcatttcaatgcaccttcccacattcgaaggaagattatgtcttcccctctttccaaagagctggagacagaagtacaacgtgcgatccatgcccatcccaaagatgaatgaagttcaggttgtacgtggacactataaaggtcagcaaattggcaaagtagtccaggtttacaggaaggaatatgttatctacattgaacgggtccagcgggaaaaggctaatggcacacctgtccacgtggcattcaccccaccaggtggttatcactaggctaaactggacaaagcccccaaaag

SEQ ID NO: 902 - DNA, 199 bp, Homo sapiens
aagccatgagcagcaaagtctctcgcgacaccctgtacgaggcggtgcgggaagtcctgcacgggaaccagcgcaagcccgccaagttcctggcctaagacggtggagttgcagatcagcttaaggaactatgatccccagaagggacaaggcgcttcttcgggcaccgtcagcttaagtcactcccggcctaagttct

SEQ ID NO: 903 - DNA, 277 bp, Homo sapiens
aagcattctaccacagttctattttgactcccacttgtaataactcctttaaaaaattccatgtttaaccatatgaccctgcttgcttactcatattctccctccctctcccttcctttctctctcttccagaagtcatttgcctggtttgaaatattttgtagggattgcttattatattatttgagctgatgacctcaggacaatgtctacacacacacacatacatacacgcacacaaattctcagctgttggaggagtgggcttgggattcag

SEQ ID NO: 904 - DNA, 282 bp, Homo sapiens
tccatttcagctatggagatgacaatctggctcccaacactgccaacgtccagatgaccttcctacgcctgctgtccacggaaggctcccagaacatcacctaccactgcaagaccagcattgcctatctggacgagcagctggcaacctcaagaaggccctcctcatccagggctccaatgacgtggagatccgggcagagggcaattagcaggttcacgtacacttgcccttaaggatggctccacgaacataccggtaagtgggcaagtcttgttatcg

SEQ ID NO: 905 - DNA, 131 bp, Homo sapiens
cccaggcaccagggcgtcgattggtgggcatgggtcagaaggattcctatgtgggcgacgaggcccagagcaagagaggcatccttcacccttaagtaccccatcgagcacggcatcgtaaccaactggga

SEQ ID NO: 906 - DNA, 227 bp, Homo sapiens
gaaaaacatagccaagattgttttcctgagacacttagagaagaaagtgttttaaatgctatttttaaaaagcagtagtaagacctcatatacaggttgcgactttttactcattggatatggataaacctccaccatccccctctctcaactacttgcccccgaccttggatagttggcttgcttggaagcctacttgaattatccaaacatagttattagaaaaa

SEQ ID NO: 907 - DNA, 123 bp, Homo sapiens
gagagagaagagagaactagtctcgagtttagtttttgttttgttttgtttgagacagggtctaactttctgcactccagcctgggcgacaaagcaagactccgtctcaaaaaaaaaaaaaaa

SEQ ID NO: 908 - DNA, 304 bp, Homo sapiens
aaagaatagatgagctggctattctcagttttgtcctaagccacatgtacttagagaggtgatatagtctttgacatccaacgcagttatttatttatagtatgttatttagtcatagtatgagcttgtatatgttattgaatgccatcaaagaaatttgacataacagatacacatctttgttttgagggggaaaagggaataaatagtcaacacttatcacagtgcttggcaattattagtgttcaataatgctggcattacagtgtgctttgtaatagctgctgctttcatttgacaactc

SEQ ID NO: 909 - DNA, 263 bp, Homo sapiens
tcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttctctattaatcaagggaacttcaaaggtaatgggatggtcggactcacaggctgagacctcgttcaccccaagcattt

SEQ ID NO: 910 - DNA, 171 bp, Homo sapiens
ccaggtgggaggttagtgtggcccgggcgtccgctcctcagcggatgtggcagccccgagccatggctctcgccgtccgagtcgtttattgtggcgcttgaggctacaagtccaagtattcttcagctcaagaagaagttagaagatgagttccccggccgcctggaacaa

SEQ ID NO: 911 - DNA, 194 bp, Homo sapiens
gtccttttagccttttttaaaaactccatttatattacatttgtaaccatggatactttaatcagaagcttagccttggaaattgtggactcttggagatgttattagtgaaggttcggcacctaaactaaacctgtaaattatgatgatggtattcaaagattatggaaattaacattctggcccctgaaaaa

SEQ ID NO: 912 - DNA, 192 bp, Homo sapiens
atgcgctacttaatggaagaagatgaagatgcttacaagaaacagttctctcaatacataagacagcgtaactccagacatgatggaggagatgtataagaaagctcatgctgctatacgagagatccagtctattgaaaagaagcccaagaagaagttaaaaggagaggttgaccgtcccaaaatgccctg

SEQ ID NO: 913 - DNA, 184 bp, Homo sapiens
ttggactcagcttccatcattgccacagacccgacatgtaaggaccaggggggcctagcttgggcggtggctgaaggaatacaagtcagaaaatgaggaagactttgtggctaggaagaaagacctttccagcctgggcaacaatagtgagacccaatctttaaaaaaaaatttaaaaatttag

SEQ ID NO: 914 - DNA, 157 bp, Homo sapiens
caaaaagatgactgagaagactgttaaagcaaaaagctctgttcctgcctcagatgatgcctatccagaaataggaaaattctttcccttcaatcctctagactttgaggagttttgaaccctgccctaagggcaccagattgcgaaccttcccctt

SEQ ID NO: 915 - DNA, 176 bp, Homo sapiens
ccaggcagggcgatgtctgccatccgtggccatttgcaaagaccccaaagacccctgttctggttccctcttctcccccatgaatatcctcttcacacacatgtacatgcgaaccacacacaacacgcaactcgtgagacccgggacctccccaggacccccagtttcctggtttg

SEQ ID NO: 916 - DNA, 186 bp, Homo sapiens
ctgtagtaagaagagattcaggatgctagaggtgaatatttgggtcatttacatgtacactacatagcaagttgatactcatgttgcatgttcttttaaattagtaattttgtgtcttaggtctttaacttccaatactccatcatgtatgtacccttcccatgtttgcttctgataatgggaaat

SEQ ID NO: 917 - DNA, 217 bp, Homo sapiens
acaagcgcgtgtgcaaggagatcgccattatccccagcaaaaagctccgcaacaagatagcaggttatgtcacgcatctgatgaggcgaattcagagaggcccagtaagaggtatctccatcaagctgcaggaggaggagagagaaaggggagacattattggttcctgaggtctcaccttggatcaggagattattgaggagtcctcacataagga

SEQ ID NO: 918 - DNA, 153 bp, Homo sapiens
cgcctatttaaaggttcgtttggttcaaccgtttaaagctcctacgttgatcctgaggttcagaccggagtattccaggttcgggttcctatcctacttctaaattccttccttgtaccgaaaggccaagagaaattaaggcctacttacaaa

SEQ ID NO: 919 - DNA, 184 bp, Homo sapiens
ctcgtccgaatttcggcacggccgggcctttcagcctaggaggagctcaagggtcggccgcaattcacaggagggtggcccggaccatcggcatttctgttggatccgaggaggcggaccaccgttccaacttatcctttcccaggaggccctggcccccaagagggagcaagtcttcttgagg

SEQ ID NO: 920 - DNA, 246 bp, Homo sapiens
gcattgcctatctggacgaagcagctggcaacctcaagaaggccctgctcatccagggctccaatgacgtggagatccgggcagagggcaatagcaggttcacgtacactgccctcaaggatggctgcacgaacataccggtaagtggggcaagactgttaatcgagtaccggtacagaagacctacgcctcccatcatgacattgcacccatggacaaggagggcccagcaggattcgggtttgg

SEQ ID NO: 921 - DNA, 268 bp, Homo sapiens
ccagagcaaaactgttgtgccttctatttatctttgatttcagtcttggcaattgtttaaaaaaaaaatctaggatttgttttattaggttcagagtatgtggggaattatagaatccctctttcatcactttgtgtatgtctttgttaacatattgttatgcctaatctaaaattgagtctcaactggaatgcctttaagacagatgcttctttagaggtctttgacctaaataggttcagcatttgattttattccggtacaatca

SEQ ID NO: 922 - DNA, 251 bp, Homo sapiens
ggctgacctgacctgatgtccattcatcccaccctctcacagttcggacttttctcccctctctttctaagagacctgaactgggcagactgcaaaataaactctcgggtgttctatttatttattgtcttcctgtaagaccttcgggtcaaggcagaggcaggaaactacctggtgtgagtaaatgccccctgagtacttcccccagcccaggcagagacctccttcagtgccggcgcaggacttttttt

SEQ ID NO: 923 - DNA, 271 bp, Homo sapiens
ttaaaccgaagtaaatttaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagagtacgggaaggcgaagaaagatagaggaagatagggaattaggagataaaacatacttttggaggaaaagttaatttcacctcaaagtaggaaa

SEQ ID NO: 924 - DNA, 140 bp, Homo sapiens
gctgaggcaacttctcctagaatctcaatctcagctcgatgccgccaagagcgaagccagaaacagagcgatgagcttgccctggtcaggcagcagttgagtgaatgaagagccacgtagaggatggtgacatagcttgg

SEQ ID NO: 925 - DNA, 139 bp, Homo sapiens
ctggtaggatggtcctcttgtacttcgtgtgctccgacccatggtgacgatgacacaccctggtggcatgcccgtgtatgttggtttagcgttgtctgcattgttctagagtgaacaggtgtcaaggctgtcaactgtt

SEQ ID NO: 926 - DNA, 141 bp, Homo sapiens
atggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcctt

SEQ ID NO: 927 - DNA, 142 bp, Homo sapiens
cttgcaccagcccttgtgggactcccaacacaaggacaaagctcaggatgctggtgatgctaggaggatgtccctcccctcactgccccacattctcccagtggctctaccagccttaacccattcaaaccagttaaatttt

SEQ ID NO: 928 - DNA, 152 bp, Homo sapiens
atggatgaagtgccttcccattatgctgtaccctgggcagagtggacagttacgacccttggttcgagcccagggtcagcttcgggcactcttgggttaccaagcaaagtgacaaatggtccatgagcggaaggttaggcaccttaaggcag

SEQ ID NO: 929 - DNA, 189 bp, Homo sapiens
ggcatggcagcatcttcctgacggtcaccttagggcggctggcgtcgcgtgcagcacagcattctgagaccttcggggccggagcagacttcctttggtctgcttctcgaaggttcaattcacagagcacttcatatctaccacgggtatgttcctaaaacatccctgagttcaccaccttggccagaa

SEQ ID NO: 930 - DNA, 201 bp, Homo sapiens
gccatccagactgaggaagacccggaaacttaggggccacgtgagccacggccacggcccaataggaagcaccggaagcaccccggcggccgcggtaatgctggtgggctgcatcaccaccgaatcaacttcgacaaataccacccggctactttgggaaagttggtattgagcctttaccctttaagagggaccagactt

SEQ ID NO: 931 - DNA, 151 bp, Homo sapiens
ctcgtccaatttcggcacggttaaaaaccctgtcctacacataccattctcaagcaccggctcctagggtaatcaatcatgggcatactgctaatgcctctgattccagctcatatggaggaatatgtttactctctttgctaaagtgaag

SEQ ID NO: 932 - DNA, 152 bp, Homo sapiens
gtgcgatgtttcaggaggcttggaggaagggggtttccagttggagagggacaccccactgagaaggtcaaacaatttcaaagtttgggattgtatcaggtggcatggtcctggtcaccaatttataatgtaagtagagattttacaatagg

SEQ ID NO: 933 - DNA, 232 bp, Homo sapiens
aaaacatggagttgttcctttggccacatatattccgaatctataagaagggtgatattgtagacatcaagggaattgggtcctgttcaaaaagggatggccccacaggtgttaccatggcaaactggaggagtctacactgttacccagcatgctgttggcattgttggtaacaaccaggttagggcagatcctgccagggattatgtcgtatggcccattagcactctag

SEQ ID NO: 934 - DNA, 246 bp, Homo sapiens
taaagaaggccctgaaagctgaatgggggtcaaaatgaaaggtgaattcaaggctgaaggaaatagcaaattcaactacacagttctggaggatggttgcacgaaacacactgggggaatggagcaaaacagtctttgaatatcgcacacgcaaggctgttagactacctattgtagatattgcaccctatgacaatggtggtcctcatcaagaatttggtgtggcgttggccctctttgcttttt

SEQ ID NO: 935 - DNA, 171 bp, Homo sapiens
agttggggcgcccagctgccaacaccaagattggcccccgccgcatccacacaggtccgtgtgcggggaggtaacaggaaataccgtgccctaggttgggacgtggggaatttctcctggggctcagagtgttgtactcgtaaacaaggagtcatcgatgttgtctacaat

SEQ ID NO: 936 - DNA, 316 bp, Homo sapiens
tttcttacaactatttgtctctgaatagttttctcttaaaatttgacaaatattaaaaacattgtccttccttctttggttacagtggagtctcttctgttttgccaggaaagttaacatattttttcttcatttttgttcatcatttataaattagatggtatagattttagcaaatagatctcaagagctggattcaattagcagctttttaggacataaacattaaagggttagatggaaaagattgttttgactgacttgataaatgacaggctgtgtttgatgtccgccaggattggctggagctggtccc

SEQ ID NO: 937 - DNA, 297 bp, Homo sapiens
ctcgtccaatttcggcacggaaaaaacgttgaattgatgatgcagttttcatatatcgagatgttcgctcgtccagtactgttggttaaatgacaattttatgtggattttgcatgtaatacacagtgagacacagtaattttatctaaattacagtgcagtttagttaatctattaatactgactcagtgtctgcctttaaatataaatgatatgttgaaacttaggaggcaaatgctacatatatgcaatataaagtggtaatgtgatgctgatgctgtaaccaagggcagataa

SEQ ID NO: 938 - DNA, 318 bp, Homo sapiens
gccacatctgccagagcctggagtctgcgaaggccgggacccggttccccggcccacagtgggggtgtgcaacccgagagactgggttgcaaattcgtgaagaatcagcatcatgtttggcagctgagtattggagccaggagcctcccatgaggttttgagaacagagtgctgtttgagagctggcagcagcatctcagcccaagagaagtgtatattccagaggatgtcagtccaaggaccagtagctgccatagtttggattctgaaactaactggcatcaacactggggtagaacatgctttccttatgtatca

SEQ ID NO: 939 - DNA, 405 bp, Homo sapiens
gaaatttgaaaaaactttctctttgccatttcttcttcttcttttttaactgaaagctgaatccttccatttcttctgcacatctacttgcttaaattgtgggcaaaagagaaaaagaaggattgctcagagcattgtgcaatacagtttcattaactccttccccgctcccccaaaaatttgagtttgtttttcaacactcttacacctgttatggaaaatgtcaacctttgtgaggaacccaaattaaagttgagaaatataaacccttaacatttgcaccacttgtggcttttgagtatcttcacagaggggaggtttaaaccccaacttccaagggtttaactacctcagacactttcccatgggtgtgatcccaatgttaggtgctgcctcgcagagatg

SEQ ID NO: 940 - DNA, 406 bp, Homo sapiens
ctcgtgccgaattcggcacgagctcatccagggctccaatgacgtggagatccgggcagagggcaatagcaggttcacgtacactgccctgaaggatggctgcacgaaacataccggtaagttgggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaagggcccaagtactttccaatctcagtcactctagggctctgcactgaatggctgacctgacctgatgtcattcatccaccctctcacagtttggcttttctccctctcttt

SEQ ID NO: 941 - DNA, 405 bp, Homo sapiens
gtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagcttttgcaacctgtcctctgcctctgccatcatgggcaaccccaaagtcaaggcacatggcaagaaggtgctgacttccttgggagatgccataaagcacctgatgatctcaagggcacctttgcccagctgagtgaacttcactgtgacaagctgcatgtggatcctgagaacttcaagctcctgggaaatgtgctggtgacccgttttggcaatccatttcgggcaagaatta

SEQ ID NO: 942 - DNA, 409 bp, Homo sapiens
ttcagacacactcccttctgccttccggcttaaagctgtggatgatccacgtttttgtttttttaatgttaaatgtgtaactcagtattactgaaaaggtacccacattttgaatagtagttatcactcttaggtcagacagccatcagaattctcccacaccaagtgcatgtcagttgttgagaaaacatagcaaaaagagccgtacgctctttacagatactaatgtcaagagttaaacctcctcaggttcaacctgtgataaaagactagtgcttcccagtacttgcatgggggttcactatttataggtttcttgggagtatcacagggaaatcacaattacaccactttaggccctatgtgtagcaggtcacaacttacccttgtgtgtttagatgtgtatgaa

SEQ ID NO: 943 - DNA, 185 bp, Homo sapiens
taacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaa

SEQ ID NO: 944 - DNA, 346 bp, Homo sapiens
ggaattcctgggagccccgagccggaacacggttctgtccaggagagccaggtatcggagcagccggccacggaagcagcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccaggatgctgaacgagcccccttgggagcttgcggacatctcagatgttgagggggaggttggcgccattaggagaagggggcccccagattgaacttcattc

SEQ ID NO: 945 - DNA, 340 bp, Homo sapiens
agttggctatgccttttcagacattgatttggacagctcaccaacccctgaaggggccgttcagcctggttagttttctacctactccgagtgtcctcccctgccccaccagattgctgcaggggcgcggtgtgcctggcagccaaattgttgacacttcttttttcctatgcactggttttacacagctgtcatttttctttcaaaattgcagcagttccacagatgtgtgcatttggacaaatagtacttaaaaccaaaccaaccaggcacttagcccagctcctcaatactacctggaaaagcattggcattattttcaataatatcacagcactta

SEQ ID NO: 946 - DNA, 371 bp, Homo sapiens
ctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccattccgccccagggcccctgcctgtgcctgccttgcaaccccctctgcttgggcacggtgtctcttgcattgcctgcctttttgccttcacctcttttctgccccgcccctgcacatttggggtttcagcccccaggcttgacagctccttgggggcaggcctcaataaatgtgaacctgctaaa

SEQ ID NO: 947 - DNA, 387 bp, Homo sapiens
cttctgaagaccgaggaggcaaaggccgagggggcccaggacctgctcagagagtgcccaaatctgggcgttccagctccttagacggagagcaccacgatggataccacagagatgaaccttttgggggccctccaggcagtggcaacccttctcgagggggccggagtggcagtaactggggtagagggagtaacatgaactctggcccgccgaggcgaggagcttcacggggtggtggaaggggtcggtagaagcttggactgagtaccctgaggcctctctggacaatatgtaagagactcttgtgggctcaccaagagaaacaaaaggaggctgcaccatgttagccctgaaatctttttcgggcactgaatcccaggacct

SEQ ID NO: 948 - DNA, 333 bp, Homo sapiens
ggctgactgactgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaccatcaattgatattaaaaatgaaaga

SEQ ID NO: 949 - DNA, 329 bp, Homo sapiens
gcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatggggccctaggcagactgcaagcccgaccgagcacttggactcgaactctgtgccgggaggggccccacccctcctttttcggtttcctctggtcttttttttcaatttctattacgaggttcattcttttcgagc

SEQ ID NO: 950 - DNA, 244 bp, Homo sapiens
ccgtattgacaccataatggtgcaataaatacggcacagaggcaggaactgtgtttctttcctcaatgccgtatttattgcaccattattgtgtcaatacggtgaccaataaggccagttatggccgaatgaataaattgacactctgaactcaaactttggtcggtattagggccatttatattgccatatgagtccaattaggcagtcacttatttccaaacttggtccgaattcggcacgg

SEQ ID NO: 951 - DNA, 260 bp, Homo sapiens
cggcacgagccagatagtaagacagctgagttttcctcagttttctcgtcttaacactagtggacaattctagcattttgtttggaggatttcagagttaacctcatggaattcaggattttttagcaagtttgcttttgggtttatctttgcttttagtaatcatgtgtggctgtgtcttgtcacacagtgtactttgaaacagagtgtcccttgtctctgcgcttcactcactctcaggggtcatgtaagtgctcatc

SEQ ID NO: 952 - DNA, 227 bp, Homo sapiens
acagtgcacaggctagcctggagctcaccaggcctggggagctgggacggggccccgctgccggacctgcagcccttggacaaatggggaacaatttgccttcctgaacgggaattgcaggggaggaggctgatgctttaaatgaagaggatgtgttgggtttggaggtataaccctgctcctctctcccagatctgtgtcaatataaggtcgtgtaagatctctca

SEQ ID NO: 953 - DNA, 272 bp, Homo sapiens
gttgctgaactgcagggtcaaattcgtgtttgatttaaacaacttcaggagacctatttaataaatctttcttaaatctttattatgcctaaagtagtatactgaagttagaattgttatacaatgtgagatagcatgaaatataaaacaaaggatacagggaaggtttcaattttcatatagccttttccaaaaactgaattagcattcctatcttttagagttagcaagtaagtattttatttaaacccaggggccaaagcccctaatat

SEQ ID NO: 954 - DNA, 252 bp, Homo sapiens
gtttgccgagaggtctgtggcaaagttggagaaaaccatcgatgacctagaagatgaagtctatgcccagaagatgaagtacaaggccattagcgaggaactggacaacggactcaatgacatcaccttcctctgagcccacaacagcgtggccacctcagctctcttctctccctctcctttccattctctctatatgggagagggagcacagcacagagggagccgagattttccacacattttacacac

SEQ ID NO: 955 - DNA, 156 bp, Homo sapiens
ggaaggagactgtattcaccaagtctccctatcaggagttcactgaccacctcgtcaagacccacaccagagtctccgtgcagcggactcaggctccagctgtggctacaacatagggtttttataccaggaaaataaagttgaattaagcgtaaa

SEQ ID NO: 956 - DNA, 253 bp, Homo sapiens
gcctgactacttcatctgcaaaatggagacgataataatatctatttcatatagctgtcaggagaatgaaaaaatatatgtaagtacttaggtcaatacaaataaagggctaaataaatttggctactgttgttagggacttagtcatggtttttagagccattaaatcaaatgtcattgattggtgttaaaaggcccgtttgtacaatctgtgggattaaaatcactatgtgagtagggccctataattgtt

SEQ ID NO: 957 - DNA, 252 bp, Homo sapiens
ccgggatgtggggtgtggtgtgtgccctcatagatgggggtgggagtgtggctggtgtgtgtgtcaaaccctcactcacccacgcactcacacacagcattctgttctccatgcaaagttaagatcgaatccatccccttgtagggggaaaaaagggaaaaattaacccgaggagggtctgtaatctcgcaggccacagacagatccgttcccttctctgtggcattccccctcaggtctatatagagtgtt

SEQ ID NO: 958 - DNA, 391 bp, Homo sapiens
tttccctttatgtatatattttaacaatccgcttggacacgaacaaagccacacttctaactgcttctggcgaactgattttatttttaatttttttcaataaagatattcttagatactgaaagaaatagttaatgagtttgcatttgtgcttgagaaaatttggctcaagtccatttggctgtagtgtcaacgatgtttccagtagtgtttagatttggtgtcttcaaaggtagttgattaaaaccaagtgtgtcttaaatatcttggtatcagaataactttgtatgttaccaacttaaattgctagaataaggtaaattgatacacaactgctatttttaatttagactttgacctaatttgggtttcaaaaccattttggctactg

SEQ ID NO: 959 - DNA, 601 bp, Homo sapiens
cagaattcccctttccctcaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgtttgggctttctaatgtaggctattttccttgttgcatcttttct

SEQ ID NO: 960 - DNA, 577 bp, Homo sapiens
ctcgatttttaagaggtatttaactctttacttgcactgagaatggcaaatctccctgttctatcacccgcctgtccactgggctcaccgtatctgtacaacgcttggcttcctgtctcactgcagctgtgtgcctgtctcccctgactttggggtctgtgtgggtcaggcggtcccttccagctctcggccacaggtactgtctcttcaagagtgttctaacactgctgctccaccgaaaacattcaagtccttcatccctctggactccgccatggtcaggcgtgggagcagcactccaagcccctcctctcactcgtggagcacaaggtgtgcggcacattcatgacagaaaggccctccagttactgcgacagccaacctttgtaacatgcgaaatccccatgggtgccgggctatctgccccgacaccaacagcacccttatgcagtttggggggttcccatggctcatagtggggcacactcccacccgcaacacttagcatcatgatggcggccttcatcaggacgtccacactgcaaggacattggcaccaccttacccaaccgtgtgt

SEQ ID NO: 961 - DNA, 453 bp, Homo sapiens
caactttctgtgaacacccagtctgcgtcctgggtctgctaggttcgatgatggcgaactcgtatctgcatccggtgcaagttttagctggcagaggtgagaccggtggtgctggtctgcctttgccaactatagccagtctggagacttgataaaatacttcagtgagaccagcttctcatcaacttgggcccggcgtgctgggcctgaaagtcacactacatgcactgcctttgggagtcagctcactccctgctcccacctggaaccttgccagcgtgaaggaggcttccaggtacttcaccctgtcaaccacctctgaatccccaccaggcgccttcctgggtggattcaacaagatgattttgccctttcccagttctctccttcactttcgcatcagttgttttctatgaaaacagtggattggttgggttttgtgcagggtcttgg

SEQ ID NO: 962 - DNA, 404 bp, Homo sapiens
gaagtttgctgcttagagttggaagtgcagcaggcaggtgatcatgctgcaagttctttctggacctctggcaaagggagtggtcagtgaaggccatcgttaccttgggatctgccaggctggggtgttttcggtatctgctgttcacagctctccactgtaatccgaatactttgccagtgcactaatctctttggagataaaattcattagtgtgttactaaatgttaattttcttttgcggaaaatacagtaccgtgtctgaattaattattaatatttatgctacttcattccttaactctccctcatttgctttgcccacagcctattcagttcctttgtttggcaggattctgcaaaatgtgtctcacccactactgagattgttcagcccccgatgt

SEQ ID NO: 963 - DNA, 403 bp, Homo sapiens
ctccgtctcaaaaaaaataaaaataaaaataaaaagtaaaacaggtaaaattaattgtaatatgtcttatttaacccaatgtatttaaaatattattttaatatgtaattaatatagaaattatcaagataattaagatatattttccttttctactaagtctttgaaagcttactccacatctcaattgggactagccacatttcgagtactcattagctacatatggctagtggctaccatattaacacaggtgtaggtcaccaacgtcttaacaaaggagtccacttgctgcagggaccagagatggaacatcacttgctaattttctcattagggatcacatctccatgactgtctgagtgacctttggggagtatggattatgactgagtggctcacc

SEQ ID NO: 964 - DNA, 305 bp, Homo sapiens
ccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacagtctgctcctttttttttgtccgccacacgtaacttagatgctcctttaaataaagcgtttgtgtttcaaa

SEQ ID NO: 965 - DNA, 404 bp, Homo sapiens
ccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgttt

SEQ ID NO: 966 - DNA, 367 bp, Homo sapiens
cgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatgggcacaactgtccacgtaggcattcaccccagcaaggtggttatcactaggctaaaacttggacaaagaccgcaaaaag

SEQ ID NO: 967 - DNA, 261 bp, Homo sapiens
ggggaacgcagcgttctccaggagggggacccggctctccttctgcagtgcaggcgaaggcctagatgccagtgtgacctcccacaaggcgtggcttccagactccccggccggaagtgatgcttttttgccttgggccctgggtttgaagcagcctggctttctcttggtaagtggctggtgtcttagcagctgcaatctgagctcagccacctacacaccaccgtggccgacactttcattaaaaagtttcctgagaaa

SEQ ID NO: 968 - DNA, 324 bp, Homo sapiens
tgtgaatgacacctctctactatataacgagtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtgccctgttttgtgttgtgtctcttgggtggggttgttttgggg

SEQ ID NO: 969 - DNA, 381 bp, Homo sapiens
cgcggactggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcttagaatacaggtcaacccacagaacaaagcggatttccaaggcatctccccagagcgagcctttgctggattttctctttgccagcaccatcctgcaccttgttgtcatgaacttggttgggctgactcattctca

SEQ ID NO: 970 - DNA, 351 bp, Homo sapiens
ctcgtgccgaattcggcacgaggccgggtcagccctgacaaaggtcagctagccccttgaggacatcagctttggcctcaggtccctaatggcagcagaaccactgacagagctagaggagtccattgagaccgtggtcaccaccttcttcacctttgcaaggcaggagggccggaaggatagcctcagcgtcaacgagttcacagagctggttacccagcagttgccccatctgctcaaggatgtggsctctcttgatgagaagatgaagagcttggatgtgaatcaggactcggagctcaagttgcaatgagtactggagcttgattggggagtggccaggaactcagg

SEQ ID NO: 971 - DNA, 280 bp, Homo sapiens
tttcccatttgaataatcgtacctctttatattaacaaactttatggtgatattttcaaattctttctatatcacttcttaactggccacaaatgtttgtaatacttgagtgtcttctctgagtttcaaaatgacttgctcagatagggacctcacattatttttccatttctgattcctccctttccccaacttttaccaaaggataccacatgcgttggtaaattcagcctattttcatcattaaaaaaaaaaaaaaaccctcggggactttctggag

SEQ ID NO: 972 - DNA, 390 bp, Homo sapiens
ggaaggaaaggaagagaaacgggcgggtggcctgacacccagcagccaggtgtctataggttttctgtcctgggagggggctgtcagggtgatgccgcctgcagagagggggtcattctgcgaggtttggcttcagacccctgtgccagccggccctgtgattcggaaatgatggggcactgtgtgagagaccccaggagaaacacaccagtgctgctttttgacatatctctctccatctccccttttcagcgcgctgctctgtctctggataaacacacattcaagagtctcagtccccgctcttgccaccatctcctcctctcgatctcctctcccgcttcaaaagactccagagtcttctcgggtctcagagaagggctgagtcca

SEQ ID NO: 973 - DNA, 300 bp, Homo sapiens
gcttgggcttgtaaagagagatattcatgcaaatttcaactggagaatgaggattaggtctaatttgggagaataacagcagctgattgacagtttattaggtattgcctcttttaatcatctgaagagcctaggaggtaaaaattagtattattcctgtattgcagataatgaaattagagtataaagagaggatattatttgtcccggggggatatatatatatagtatgcatctcagcccagcaggcttgactcatgagtcacatttttcaccacacccctttgagcccacaccacc

SEQ ID NO: 974 - DNA, 300 bp, Homo sapiens
cccaaagaaactgaaaaacctgatacatgaaaaaatgtgttatagggatagattatgggcaattgcacagaagtagccctaaaaacctggctgactttcactgtcattaactatattttgaagtgttgcattaaaatattatcaatctgttactggaaggcaggaaaggcaatcttgtgatacatgtttttcttagtaaggagctcccaatttatattttcttttctcaaaatttagaggaaaatttcctatggagcctagagatcatgtactgctagctactggcattaaaatttaaaa

SEQ ID NO: 975 - DNA, 335 bp, Homo sapiens
ctcgtgccgaattcggcacgagcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccacggcagaggaaatctgggagagggtctaaaggtgcgggagtttgatttaagaaaaccacttctacagatactggactcttggtttgg

SEQ ID NO: 976 - DNA, 213 bp, Homo sapiens
ccagggtaatggggcctggatagggagactctgtggccatacaggtctcacctctgcactggatgcctagggacaaagtccacctgcctcctggggccttccaggcccctgcagtctgtctctgccagaccccacacgctgctattgaccggctctccagatcacctctgaacttccaataagagaagaggaggaagggagttgttaagagcg

SEQ ID NO: 977 - DNA, 207 bp, Homo sapiens
cctgctgggaggtgattggatcatgggggtggtttctaatggtttagcaccatcctgctagtgctttctcgtgatagagttcttcacaatatcctggttgttttaaaaagtgtggtatcaccgtgcccctgtacctggtctcttctcctggctgggccatgtcgaagatgtggcctcgcttcttcgtgtgaactcttckggtcatgg

SEQ ID NO: 978 - DNA, 321 bp, Homo sapiens
  misc_feature 276: n = A,T,C or G
ctcgtgccgaattcggcacgagagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaatttaactccatatgtgttcctcttgttctaatcttngtcaaccagtgcaagtgacccacaaaattccagttatttatttcc

SEQ ID NO: 979 - DNA, 329 bp, Homo sapiens
cttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgttccccagccaagctcttaagcacatgtaggcccctgagaccttcctggttcctgcctgggggccaggctcctcttcccccagcccccgggagcctcccccaggttcctcgaggcccgacctgttaggggtagagcccttggccc

SEQ ID NO: 980 - DNA, 320 bp, Homo sapiens
tttgaacatgagtgagattagaaagcagccaaacctttcctgtaacagagacggtcatgcaagaaagcagacagcaagggcttgcagcctagtaggagctgagctttccagccgtgttgtagctaattaggaagcttgatttgctttgtgattgaaaaattgaaaacctctttccaaaggctgttttaacggcctgcatcattctttctgctataataggcctgtgtgtaagctgacttgcccaaggactcttgttaacagttaacttaggagtcaagtctcagtgataaagcgtgcaccgtgcaggccgccatatgccg

SEQ ID NO: 981 - DNA, 265 bp, Homo sapiens
ctcgtgccgcctggtgctttatttttgttttaatcttttgttgccagtgatgattttcctattctgcaaatagtgtatttcctggattacacatagtatggtttcctgaagtattctgataaatgtgttttttaaaacctcaatatactttttaggaaaggagcatcttgttatgcataaagcagagctaaaactaaatttctttcatgtgctctcctacttcctctagtgtcaatcacggtataagtgtgtaatcctctaaaaa

SEQ ID NO: 982 - DNA, 327 bp, Homo sapiens
gccagtcttaagcgtccagactcaggtgccactgggcttcctggaaggcctggccctcctggtccccccggccctcctggagagaatggtttcccaggccagatgggaattcgtggccttccgggcattaaggggccccctggtgctcttggtttgaggggacctaaaggtgactttggagaaaagggggagccttgccctccaggaagaggtcccaacggtttgccttgagctataggtctcccaggtgacccagagcccttccagctatgtgcagaaatgtgccgcagacgggtgagcgcaggccccccagggggttggcaggaa

SEQ ID NO: 983 - DNA, 326 bp, Homo sapiens
gaaaattgtgagagccaagttgacttcaggaactgaaacatcagcacaaagaagcaatcatcaaataattctgaacacaaatttaatattttcgcttctgaatgagaaacatgagggacattgtggagttagcctcctgtggagttagcctcctgtggtaaaggaatttaagaaaatataacaccttacaccctttttcatcttgacattaaaggttctggctaactttggggatccattagagaaaaatcctctgtcaccagattcattacaattcaaatcggagagttgtgaactgttatcccattgaagagaccgagcctctg

SEQ ID NO: 984 - DNA, 322 bp, Homo sapiens
aagtgcttcttgccaccatgaacatcttgttcacacagtttaagaggctcaaggggacaagtccatcctcgtcatccaggccccagcgagtcatcgaggaccgcgactctcaactccgaagtcaagcccgcactctgattacctttgctggaatgataccataccgaacgtctggggacaacaatgcgaggctggtgcagatggaggtcctccatagaattaagtgccatgctttgtgggagtctgggtcggcacactgtcagtacatcaggcacatgggcccactaggctggggtttctggttttgtttctgttgtgtttt

SEQ ID NO: 985 - DNA, 305 bp, Homo sapiens
aagaattccagcttgaggtgagtgggctactaggggagatgaactgcccgtatctttcactgacatctggggatgtgaccaagcgccttctcattcagaagaactgcctcctcttgctcacatacctcatctcagaactagaagctgccagaatgctctgtgtgaatgctcctccaaaaaaagctcaagaaggaggcggtagttaggtctttcaagagttgaaaggcatatgttattgctctaggattgtccacaccctccagccattataactatgttcccaattttttcagcgggatttaaaa

SEQ ID NO: 986 - DNA, 295 bp, Homo sapiens
gtttgctgagcccctggtgtgtaccatttagagtataagctacataaggacaaatgaatcctctaacaagcagtttgccaatgactggtgggaaaaatagctactgctattaagaacttactatgtgctaggtattgtggtaagaatatacaatactgtctaatgaggtagcgacttgatacccgttttgtggattgaaaaacaaggctcagaaagctttagggacatatccaggatcacacggctaagtagtgaatcctgttgaccgcctttctgtccgtgagggtgttggcta

SEQ ID NO: 987 - DNA, 270 bp, Homo sapiens
cagactgcaaaataaaatctcggtgttctatttatttattgtcttcctgtaagaccttcgggtcaaggcagaggcaggaaactaactggtgtgagtcaaatgccccctgagtgacttcccccagcccagggccagaagacctcccttcaggtggccggcgcaggaactgtgtgttgtcctacacaatgggtgctattctgtgtcaaacacctctgtattttttaaaacatcaattggatattaaagatgggagggttattggggaaatga

SEQ ID NO: 988 - DNA, 228 bp, Homo sapiens
tacataaaaaagtaagactaagtattgctgaatttgcagttatgttgtcgtgtataagagctacttccaggtgtggttacaaatgaacccatggaatgatgactcatgttctcctcgtgggtttgtgccgtcctgctttccaaataggtattgaatttatgcattagtctggtgatttcagtctgtgaaatattttgggtctataccactaaacatttcatagtctgc

SEQ ID NO: 989 - DNA, 221 bp, Homo sapiens
gaacgagctgatgttttgcgcttgctttgtaattttggcttggttttactaatacataacctcatgtaatctctaaaaatctacacaggcattgatccatttcaacacaaaggtaaatttaaaatgcaggctttgttatttgccacaggaggtgcatgraaaattttcggccactattttccaaataggtagtgtcatttgggtgtgccatggcctcctgt

SEQ ID NO: 990 - DNA, 187 bp, Homo sapiens
gtcgtcttgtttttgcttcattgcatgacataacccttcccctcaagctgttcctatatatacatgcacacacaaaataagccagacagatggcaatttgatcttccttttttaaaaaaaaaaaaaaacctggggggtctttctggggccgccgggccccattcgttttccccccgggggggtcccm

SEQ ID NO: 991 - DNA, 235 bp, Homo sapiens
agacactcatgtagaaattattcaagaagttattgtctaagagatgagcagtaggtaagaaaacctcagtcattgactcttcaatgtaatgatcagagtttaaaccattttctaataataaattaaatcttcagttgaacaaattattttgtgaatctgtttcactcaatggattgtaagaggctcctaaatttgagttgtttgctaatcatttcattcgcatcattagggatct

SEQ ID NO: 992 - DNA, 246 bp, Homo sapiens
gttttatagcctggactgctacctttcaaagcttggagggaagccgtgaattcagttggttcgttctgtactgttactgggccctgagtctgggcagctgtccttgcttgcctgcagggccatggctcagggtggtctcttcttggggccagtgcatggtggccagaggtgtcaccaaaccggcagtgcgattttgttaaccagcgacgaactttcgaaaataagcactggttgctacctgataaa

SEQ ID NO: 993 - DNA, 344 bp, Homo sapiens
caggcactcagaatggtccagcgttttgacataccgacgtaggcttttcctacaatacagcctctaacaaaactaggctgttccgaacccctggtaatagaattgtttacctttataccaggagggtttgggaagcaccaaaatctgcatgtggtgtgtcccaggcagacttcgaggggttcgttgctgtaagacctaaagttcttatgagattgtccaacaacaagaacatgtaagcagggcctatggtgggttcatgtgtctaaatgtgttcgtaacaagatcaagcgtgctttccttatcggggggcagaaatcgttgtaaagttttgaggcacagcacag

SEQ ID NO: 994 - DNA, 317 bp, Homo sapiens
ctttccgtggagctgtcgccatgaagggtcgagctgttcagttttagcggggtacaagatctaccccggacacggaagggcgctacgcagggaccgacgggaaggttttccagtttcttaatgcgaaatgcgagtcggctttcctttccaagaggatctcggcagataaactggactgtctctacagagggagcacaaaagggacaatcggagaattcaaagaaagacccccgagcagtcaattcagagacatactgtcatctctgctgatatatgccagaggatcagaacctcagtggaaggctcacgggacagct

SEQ ID NO: 995 - DNA, 327 bp, Homo sapiens
cccaacaagatagcaggttatgtcacgcatcttatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaccctccaggtcactcagcctacagttggggatgaatttcaaaacgcctcggggccctcttttgaatttttttctgtagtgctgtattatttccaataaatctgggacacaaaaaaaata

SEQ ID NO: 996 - DNA, 315 bp, Homo sapiens
ggaaggccaaaatcaagagtgagatgtagaaagttgtaaaatagaaaaagtggagttggtgaatcggttgttctttcctcacattggatgattgtcataaggttttagcatgttcctccttttcttcaccctccccttttttcttctattaatcaagagaaacttcaaagttaatggggatggtcggatctcacaggctgagaactcgttcacctccaagcatttcatgaaaaagctgcttcttattaatcatacaaactctcaccatgatgtgaggggttcacaaatcctccaaataaaaggtatgacttaaaa

SEQ ID NO: 997 - DNA, 296 bp, Homo sapiens
tagactagttatgaagaaaccccactacattcaatggaattggtgcttaaaatctcatcgatgtgctgtctctggagtgataagaaagggctacatctcccgaaatgatttctttacgtcatgtattggtttccttcttcaccttgaacttttgttgacctgtatgtactttaccccaaacctgttaatattttgagcgcttctatgttaaagcaaagaaataattttaatactctggcattcataaattttattgatgagattattattttaaaggttggggtaacactctggtg

SEQ ID NO: 998 - DNA, 187 bp, Homo sapiens
ctcgtccaatttcggcagggaaaagcccggagtttgcgctgagcttggctgctcgctgggtcttggatgtcgggttcgaccacttggccgatgggaatggtctgtcacaatctgctccttttttttttgtccgccacacgtaactcagatgctcctttaaataaagcgtttgtgtttcaagttaaaa

SEQ ID NO: 999 - DNA, 192 bp, Homo sapiens
ccggaatgccaacgcagagccagctgttcagcgtactcttttagagaaatagaagattgtcggcagaaacagcccaggcgttggcagcagggttagaacagctgactgaggcttactacctgaaggacaactgactgagagcagagatggaggacttctgttaacggcggattctttgtttaaatcttgacg

SEQ ID NO: 1000 - DNA, 265 bp, Homo sapiens
ctttcgggaagttgaatattaatctgtacccaaaacgtatttagtaaaatatttgcccccgccaccctgccatgctgacataacaacttttataatgttgaatagatgatatgggaaatactaataacaacagtgtaattttgcaggcagctttaacttatatacattgcttgatttttttcaaagactaaatatgtcatttatactttgtttattttctccaaggaggttgtgtaaaatatgcctgctgctttcctttggagga

SEQ ID NO: 1001 - DNA, 191 bp, Homo sapiens
ggatgatgaatggcatgaagctgagtggccgagagattgtacgttcgaattgatagaaacgcttaagcagttgccttttttaacatcgatacgagacctctgaatttgtatttttccttgttaccattttaatttgttggctggatgtataagatgtttaaaaaattcagttgcttttgggggtaatttga

SEQ ID NO: 1002 - DNA, 251 bp, Homo sapiens
cggcacgagggaagacattgaacgtatggtccaggaagctgagaagtacaaagctgaagatgagaagcagagggacaaggtgtcatccagaattcacttgagtcctatgccttcaacatgaaagcaactgttgaagatgagaaacttcaaggcaagattaacgatgaggacaaacagaagattctggacaagtgtaatgaaattatcaactggcttaataagatcagtcttctgagagggagtatttgcac

SEQ ID NO: 1003 - DNA, 173 bp, Homo sapiens
agaccttcatgagctgcaatctcatcactggaatgttccagcgactggacaagctgaggaagaatgccttcgccagtgtcatcctttttggaaccaacaatagcagctccatttctggagtctgggtcttccgaggccaggatcttccctttcccttgagtccagattgcgca

SEQ ID NO: 1004 - DNA, 213 bp, Homo sapiens
tgagggagtacgtcgagtcgcagctgcagcgcacagagactggagcgacggagaccgtcacgccctcagaggccccggtgctggcagctgagcccgaggtgtacaggggcactgtgttggcactcactggaaataacttcgttgacaccattgacagaaggattaaccttcatcaagttttatgtacatggtgtgagtcattgtaagactgct

SEQ ID NO: 1005 - DNA, 150 bp, Homo sapiens
gacccccgaagctccagagggcatgttacagtgctcttctggctctgcatttgtggacggcttaagtgttaacagctcagtgcggccctttccccccgtgtgtgcggtggctgcctctgcagcaacggcaacgggcacgtgtcacaacct

SEQ ID NO: 1006 - DNA, 162 bp, Homo sapiens
atacttaattgcaaatatcccttgtatgaggttaactaaaaaaattttgctatgtctgatctacatgtttgcattttgttcaactaattaatatttgkagattgcaagtttgtttaaaataactttattgaggttttaagtccgattcgttctaaggtgcct

SEQ ID NO: 1007 - DNA, 150 bp, Homo sapiens
gaagagttctcattatattttcttataagttattcctagtaatttgatatcattatttatattttaaacctaggaccagtaatttctttgccagttccaccagcttaagctatatctcatacttactttctccctccctacaagtagacg

SEQ ID NO: 1008 - DNA, 285 bp, Homo sapiens
gtgaaactgcactgctccatgctggctgaagatgcaatcaaggccgccctggctgattacaaattgaaacaggaacccaaaaaggagaggcagagaagaaatgagccctccctcggcgaacgtcccagcaggccacaccagctgtttcccacctgctgtgcagtacaccttagatgttcagaggccgcttctctccactgaggagctatgagatacgcacaatacttgctgttcacgttatgactctcatgcaagcaaaatacacagtttcattgttctgaaaaa

SEQ ID NO: 1009 - DNA, 260 bp, Homo sapiens
attttctggaaacacagaagtacttgacggagagttaggcctgtattctataaatctattaatggtagcaaagtgcataagacagggatttctttgagatgaaaggagtcctgaagaagagcattggaattaatatttggatgtggtattgtagaaatacaatgggtaaagtaaccctaatgtgggaataaaagtcaagggaaaggtcttgaataagtacacagaatataggctaaaaatattaaggggaggaaaatgga

SEQ ID NO: 1010 - DNA, 163 bp, Homo sapiens
aaacttggtgtatatcatatatcactttactttagaggaattaagatttcacataaatccatttccaggttccaaagaccaggaagaggcttggtttttgttttctcttttatctgtctttacagtctccttgtcttttcttaggagagaaggtactgagaaa

SEQ ID NO: 1011 - DNA, 173 bp, Homo sapiens
ttcggttagggggatatttttcaaacctctcgctttatactctgatatagggtgtgtttatgaacttgttaaatgttatttaatcatgcagatttccaatcagtgtattgctcatttactgacaaaaagggaaaataccgaacacagaaaggggaaataaactgacttttata

SEQ ID NO: 1012 - DNA, 160 bp, Homo sapiens
caccgctacacgaccgggggtatactacggtcaatgctctaaaatctgtggagcaaaccacagtttcatgcccatcgtcctagaattaattcccctaaaaatctttgaaatagggcccgtatttaccctatagcaccccctctgccccctctagagcaaa

SEQ ID NO: 1013 - DNA, 189 bp, Homo sapiens
gctgggcgaaatgcagcacatgtggcctttagggacctcaagagcatgtgaccctgaaccagctctgacccaggaagaagactccacccctgaattcaagtgctccattggatcagcttcccaggagttcagcttcgggttagtacataaggccaccacaatgctcaggaaattattttggaaaaacgt

SEQ ID NO: 1014 - DNA, 157 bp, Homo sapiens
aaaccgctagcttgttgcaccgtggaggccacaggagcagaaacatggaatgccaaacgctggggatgctggtacaagttgtgggactgcatgctactgttctagagcttgtctcaatggatctagaacttcatcgccctcttatcgccgatcaacc

SEQ ID NO: 1015 - DNA, 192 bp, Homo sapiens
ggcgactctgcaccacgcaggggaagagaaagcaggagccgtccagcacggaggaaggcgaccatggccaaggagttggggtacgcagttcacaacggtcctgaccacttggcatgaactttttccaaatgccaaggggggaaaaccagtcgcccttgagctgcatacttaagacatcaggcatgcccttct

SEQ ID NO: 1016 - DNA, 232 bp, Homo sapiens
tgaacacagtggacatctcagaacgagagaaaagtggcacagctgcgaggtctctacaagaaggctgggcttggcaaggagagacgccatgtcacctacgttgtagccaaaaaaggtgtggccgcaaagtgcgccggccagctggagtcagaggtcatttcaaggtggtggactcacggatgaggaggaccacagagcacagcaacgtaaggacacaggaaaaacacacacg

SEQ ID NO: 1017 - DNA, 151 bp, Homo sapiens
cggcacgagtttccggtttgggggatgagcgttgctatttaattactaatattattgaattgccttagaggaggccgggcgagcccgttgtttcttgaaggaccctttggccccagcagagcctcttacagtaaagtttttggttccgcaa

SEQ ID NO: 1018 - DNA, 167 bp, Homo sapiens
ctcgtccaattttgggccgaggggaaaaattgcccaggatgctattaaattcaccacggtctttagccattgcacaaacggtagttttgttgttgttgggcttgcttccacttgttcctttgccagccttacaggggggaaaaggcagggtttacagagggattgtt

SEQ ID NO: 1019 - DNA, 197 bp, Homo sapiens
acagcaacagggtggtggacctcatggcccacatggcctccaaggagtaagaccctggaccaccagcccagcaagagcacaagaggaagagagagaccctcactgctggggagtcctcccacactcagtcccccaccacactgaattctcccctcctcacagttcgcatgtagacccttgagagggaggctcctagg

SEQ ID NO: 1020 - DNA, 152 bp, Homo sapiens
cgcgccgccatcatggacaccagccgtgtgcagcctatcaagctggccagggtcaccaaggtcctgggcaggaccggttctcagggacagtgcacgcaggtcgcggtgggagtttcattggacgacacgagccgatccattccattccggtc

SEQ ID NO: 1021 - DNA, 230 bp, Homo sapiens
taaatttatactcctgtttcccaggatcttgagcttttagtgtgctatacctatgtgtcttaatcgtgggccactgtgccaataaacaaaaacatctgtttgggtttacctcagttgcagtagttattttcatttgagaagttgttctcagattattgtttcagttatatagaggattactagactagttatgaggaaccccactacatccaatagaattggtgcttaaa

SEQ ID NO: 1022 - DNA, 244 bp, Homo sapiens
gcgaaaggtgctggaccatcgagacaaggtatatgagcagctggccaaataccttcaactgagaaatgtcattgagcgactccaggaagctaagcactcggagttatatatgcaggtggatttgggctgtaacttcttcgtttgacacagtggtcccagatacttcacggatctatgtggccctgggatatggttttctcctggagttgacactgcaggagctcttcaagtcaattgaatcgag

SEQ ID NO: 1023 - DNA, 174 bp, Homo sapiens
aacctgcatattctttctatcattcttctaattgtgggcctctattccttaggatattccttcctctctttttttccttttctcacctgttcacaaagtatttttttttgaaatagggataaatacgtacgtgaggaacagatgtgttcatcttaaatcattatttgctcacat

SEQ ID NO: 1024 - DNA, 231 bp, Homo sapiens
ctcgtccaattgggcgaggggggcccctcttgggtccctcctctgccatcacctgaagacccacgcaaacactgaatgtcacctgtgcctgccgcctcggtccaccttgcggcccgtgtttgactcaactcagctcctttaacgctaatatttccggcaaaatcccatgcttgggttttgtctttaaccttgtaacgcttgcaatcccaataaagcattaaagtcatgaaa

SEQ ID NO: 1025 - DNA, 276 bp, Homo sapiens
gcattacctggcatgggaggtccagggccagtgggaactccggacatacctcttggtacagctccatccatgccaggccacaaccccatgagaccaccagcctttctccaacagggcatgatgggacctaaccatcggatgatgtcaccagcacaatctacaatccccgcccagcccaccctgtatgagcaatccagctactcccgtgggatgattcctggcaagaatcgggggcctgccgggttctacaccaccctggggctgtggctctccagg

SEQ ID NO: 1026 - DNA, 162 bp, Homo sapiens
ccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggggtagctgacctgacacag

SEQ ID NO: 1027 - DNA, 246 bp, Homo sapiens
ggcaacgttgctggtgacacaaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggagatggccctaaattcttgagtctggtgattgctgccattgttgatatgg

SEQ ID NO: 1028 - DNA, 185 bp, Homo sapiens
cttcaccgaagaaaaatatctaaacatcgaaaaacttaaatattatggaaaaaaaacattgcaaaatataaaataaataaaaaaaggaaaggaaactttgaaccttatgtaccgagcaaatgccaggtctagcaaacataatgctagtcctagattacttattgatttaaaacaaaaaccacaaa

SEQ ID NO: 1029 - DNA, 224 bp, Homo sapiens
ccactctttgatcatggctctctctgccagaattgtgtgcactctgtaacatctttgtggtagtcctgttttcctaataactttgttactgtgctgtgaaagattacagatttgaacatgtagtgtacgtgctgttgagttgtgaactggtggccgtatgtaacagctgaccacgtgaagatactggtacttgatagctcttaggaaatttgctccaaatttag

SEQ ID NO: 1030 - DNA, 228 bp, Homo sapiens
ggatctcctgctggtcagtggggcggcggcagcaccttacccgtggcctggtaccaggtgagcccgctggccgcccgcctgctctaccctacctggcctggctggccttcgcgaccacactcactactgcgtatggcgggacaaccatggctggcgtggggacggcggctgcagagtgagtgccggcccaccagggactgcagctgcaccagcaggtccattcacgtt

SEQ ID NO: 1031 - DNA, 260 bp, Homo sapiens
cacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttctttttaactgaaagctgaatccttccatttcttctgcacatctacttgcttaaattgtgggcaaagagaaaagagggtttgatcagagcattgtgcaat

SEQ ID NO: 1032 - DNA, 261 bp, Homo sapiens
gcgtggcctacatggaccagcagactggcaacctcaagaaggccctgctcctccagggctccaacgagatcgagatccgcgccgagggcaacagccgcttcacctacagcgtcactgtcgatggctgcacgagtcacaccggagcctggggcaagacagtaatttaatacaaaaccaccaggacctcccgcctgcccatcatcgatgtggccccttggacgttggtgccccagaccaggatttcggcttcgacgttggcct

SEQ ID NO: 1033 - DNA, 334 bp, Homo sapiens
caggggcaccattgaaatcctgagtgatgtgcagctgatcaagactggagacaaagtgggagccagcgaacgcacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtacccattctatcatcagcgggaacaaacgagtctggccttgtctgtggagacggattacacctccca

SEQ ID NO: 1034 - DNA, 225 bp, Homo sapiens
cctcattcttcctccggtagcctctcccacctaacctctgcatcccccagcctcatgtcctgccccatcctatcctgcctgatccctggatctcctcagatccctcttctcagacagcgccaggccggggtggggccggggttggggccgagcccacaagctgccccctcccctccctttttgtataatttaataaagaatggtcgcgcttctgtttttaaaaaa

SEQ ID NO: 1035 - DNA, 311 bp, Homo sapiens
tgaactcatatctgtaagaaataaagagaagatatattagttttttaattggtattttaatttttatatatgcaggaaggatagaagtgattgaatattgttaattataccaccgtgtgttagaaaagtaagaggcagtcaattttcacatcaaagacagcatctaagaggttttgttctgtcctggaattattttagtagtgtctcagtaatgttgactgtatttctccaacttgttcaaattattaccagtgaatctttgtcagcagttcccttttaaatgcaaatcaataaattcccaaaatttaaaa

SEQ ID NO: 1036 - DNA, 268 bp, Homo sapiens
gcaagactgttatcgagtaccggtcacagaagacctcacgcctccccatcattgacattgcacccatggacataggagggcccgagcaggaattcggtgtggacatagggccggtctgcttcttgtaaaacctgaacccagaaacaacacaatccgttgcaacccaaggacccaagtacttttcaatctcagtcactctaggactctgcactgaatggctgacctgacctgatgtccattcatcccacctcttaaagttgggactttt

SEQ ID NO: 1037 - DNA, 286 bp, Homo sapiens
tttcagagactgcttaaaattaatccagactggaaaacccacagacttcttgatttaggtgctggagatggagaagtcacaaaaatcatgagccctcattttgaagaaatctaatgccactgagctttctgaaactatgatatggcagcttcagaaaagaatacagagtccttggtataaatgatggcagatacggggttcagtatgatgtcatcagctgcctgacttgctggaccctgtaatcagccctgactttgttaaaggtatcagagggtttggggccact

SEQ ID NO: 1038 - DNA, 251 bp, Homo sapiens
aaaaagcaaaaatgacaacagaaaaacaatcttattccgagcattccagtaacttttttgtgtatgtacttagctgtactataagtagttggtttgtatgagatggttaaaaaggccaaagataaaagggttctttttttttcctcttttgtctattaagttgctgtttattttttttggcctgtttgatgtatgtgtgaacaatgttgtccaccaataacaggattttattttgctgagtgttctaaaaa

SEQ ID NO: 1039 - DNA, 204 bp, Homo sapiens
tctaggtaaagctgagatcacaggaacagcaggtgacaggcctagctatagttaggaatacacaagccgtaaatcgggtccttacagccataccacaaggtacgtccatttggactacaagaagagcttcctttaaagttcctatttcagcataaagaggctgtccttttttttgaggaatagtttggccttgtcctcctgtgg

SEQ ID NO: 1040 - DNA, 218 bp, Homo sapiens
aacccacttggtttaattcaacccccaatgtcaggtttttataggtcagcccagagttctcaagcccagtcacaaagcagagccaggactcaaattcacaccctgtgactgagctgtttccactgtaccatgagacactacccacaaatcgctccttctccagtatctatgacacggccataacaaaccataccccttggacagatattccttaaaaa

SEQ ID NO: 1041 - DNA, 289 bp, Homo sapiens
aaaccaggccctttagaggatcccagagagggaagagaaccaggggcccttttctcttttagaattttcttttaatcagcccaccttttgactccccgcccgccccaatccattatttttttctgccttccgggtcccatccttagagctcgagtcgttccttcccctcctggattccgggtagcagaggcagccccgaaggagggcgggtccccgtttgtccaaggcctggtcgtggtggaggaaggtgttctggaacaataaacggcactatccaaatgtaaaaaaa

SEQ ID NO: 1042 - DNA, 346 bp, Homo sapiens
ctccgccgaccccctggtcgtgaggcctatcctggtgatgtgttctacctacactcccggttgctggagagagcagccaaaatgaacgatgcttttggtggtggctccttgactgctttgccagctcatagaaacacaggctggtgatgtgtctgcttacattccaacaaatgtcatttccatcactgacggacagatcttcttggaaacagaattgttctacaaaggtatcccgccctgcaattaacgttgggtctgtctgtatctcgtgtcggatccgctgcccaaaccaggtctatcaagcaggtagcaggtaccatgaagctggaattcggctcagtatcgt

SEQ ID NO: 1043 - DNA, 166 bp, Homo sapiens
ggctttcaggtgtttagagattttttttgttgttgttaacattcattgcaaaagtactagatggtgtataactctagagttgaattttaagggattccctaatatgtatactatctttttatctgaagtaataaataaacaatgatcttgaaagtccctcaaaaaa

SEQ ID NO: 1044 - DNA, 140 bp, Homo sapiens
taaaaggatagtatatctttaaattctgactggggagtaagaagagaagatattcttacctactaaataaaccacttttgagtagtatgcaatattatgaaatgttacaacactatattaaaataataaaatatttgggt

SEQ ID NO: 1045 - DNA, 250 bp, Homo sapiens
acagtacacacccagcttttctatagagatgaaatatgagcctgtagcttatagctcagcagctgactgcagccagaccccctctttgtttcttaatccttaggggaagtgtgaagttcctgtttctgctttgaaggatgggttggatctctctaaaggatttgaaccacaccttcaaatctagaagtggcctccaccataatctatctgtagactacacaggctttactactgatgcaggcattcatgt

SEQ ID NO: 1046 - DNA, 308 bp, Homo sapiens
ctcctttgaagtcatttattattttataaattgagaacaaccacaccaccaaatgtcacaccttcttataaagtgtgaacaaggaaggtcatgtttttgttggtattttgtcagacttagaggtttcatttcagggcatagtcaaaggcatcatcctccaactacccacttgattatgtatttcagatcctccgtggggccttcttctgacagagattctttgaggtccgcagtagtccttttgtcagcacagctgctaatctacaacttgctgccttctgtttgctggggttgggcttatcatttac

SEQ ID NO: 1047 - DNA, 166 bp, Homo sapiens
agagagggaggagtacagaaggaaggcacttctgggtacttaattcagaaatttctttatatttcagcactggattatcatataatgcaagtgactatggactaagagttagttatggtgtcttatgactagatttattatggtatattaaagtaacaataatatt

SEQ ID NO: 1048 - DNA, 179 bp, Homo sapiens
gtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagtagtcaaaaaaa

SEQ ID NO: 1049 - DNA, 231 bp, Homo sapiens
tcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgaggttgtcctacatgcaagtacatgtttttaatggtggtctgtcttctgtgctgtccc

SEQ ID NO: 1050 - DNA, 280 bp, Homo sapiens
aaataaggaaaggaaaccacagagaaacttgtgtcttcctgctctcctctccggctgcctggcagttattaacctaaacagatagccacaagaggttgggacagaggagggtaaaggctcagaaggaggttcaacctctgactcacctgcccatctctgggccctctgctgacacttggatgctattgttgggtggaagataaatagagtggagaggttggaggaaagtactggtattgcatttaggaggatgtttatcatcccggccctggagggcaac

SEQ ID NO: 1051 - DNA, 251 bp, Homo sapiens
gggccttcaagctctacgacttggacaatgatggctacatcaccaggaatgagatgctggacattgtggatgccatttaccagatggtggggaataccgtggagctcccagaggaggagaacactcctgagaagagggtggaccggatctttgccatgatggataagaatgccgacgggaagctgacccttcaggagttccaggagggtcccaaggcagaccgtccattgtgcaggcgctgtccctttacg

SEQ ID NO: 1052 - DNA, 334 bp, Homo sapiens
  misc_feature 100: n = A,T,C or G
ccccaggagagttggaaaagcttagttctgtggtcactgtgataccatagtccccctgccttgggtagctaacgtagcataccagctggcgttaggaaanctagctaaagctcacagagaggctctgcaaagtgatcgatctttctctgtaatgtctgtaactcatttggcctgctccaggttactacttgattctcttcagcagttaagagttgcattctgaaacactttcagagagtagtgctagtgttgatttctggatctaattctggaaataccagctgtaaaattatatttggaatttacatttaagaaaagcaagcccagtaattct

SEQ ID NO: 1053 - DNA, 342 bp, Homo sapiens
gcgagcccagcgcccccttctcggccctacgtggtgtcgggctacagcggtcgcgtgtacgagaggcccgtgcaggtccttatatcaccttcacggatgcggtcaatgagaccaccatcatgctcaagtggatgtacatcccagcaagtaacaacaacaccccaatccatggcttttatatctattatcgacccacagacagtgacaatgatagtgactacagaaggatatggtggaaggggacaagtacttggcactccatcagccacctgcagccagagacctcctacgacattaagatgcagttcttcaatgaagggggggagagcgagttcagcaacg

SEQ ID NO: 1054 - DNA, 326 bp, Homo sapiens
ggaagaggtcccaacggtttgcctggagctataggtctcccaggtgacccaggccctgccagctatggcagaaatggccgagacggtgagcgaggccccccagggtggcaggaattcctggagtgcctggacccccgggacctctgggcttccggtttctgtgagcagcctcctgcaccatgcaggctggtcagcgagcatttaacaaagggcctgacccttgaaaggcttactgctgcatggctgtttgcatgaaccacgcctggtgaaggagcctgggtgagaacaccatccaaagctggggcaaagatgattccttcagcatg

SEQ ID NO: 1055 - DNA, 272 bp, Homo sapiens
  misc_feature 7, 197: n = A,T,C or G
ccggaancccttggcccctcagcaatagaaggtaagacaagatcacatcccaaggtgggagggggctcgtgccagccctgaaggtggttggaaggtcttttttgtagcagccaggaagggctggctctgcttctagatccacaaagctgcttggatgggggccgtctcaggcggagggccacgagggctgaggagtncaggtctactcttgcctcgggctgcccaggcgacatgccaggggtctgtgttctcctggagcctgtcaggtttgg

SEQ ID NO: 1056 - DNA, 330 bp, Homo sapiens
gtcaaatgagggaacatctgggttatgccttttttaaagtagttttctttaggaactgtcagcatgttgttgttgaagtgtggagttgtaactctgcgtggactatggacagtcaacaatatgtacttaaaagttgcactattgcaaaacgggtgtattatccaggtactcgtacactatttttttgtactgctggtctgtaccagaaacattttcttttattgttacttgctttttaaactttgtttagccacttaaaatctgcttatggcacaatttgcctcaaaatccattccaggttgtatatttgtttccaataaaaaaattcaa

SEQ ID NO: 1057 - DNA, 245 bp, Homo sapiens
gccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccaaaa

SEQ ID NO: 1058 - DNA, 267 bp, Homo sapiens
gttgggaagcggacccggggcctggggacccggcggcgtcagagccaggcaagttgaaccggagcaaacgacttccgatccagtctgcgctgttgcggctcccgtttgggatttgatttgcagcatctttgagcctctacgacaaaaaaccgcgagacggcccagcccttccccggcaccccgaaagagctacttctagagccgccggcgcccatcgattttccacccgggtggggtacacggtaagtctacccaattcgcctatag

SEQ ID NO: 1059 - DNA, 296 bp, Homo sapiens
ctcgtccaatttcgggcgacgggggccactcagaatggtccagcgtttgacataccgacgtaggctttcctacaatacagcctctaacaaaactaggctgtcccgaacccctggtaatgagaattgtttacctttataccaagaaggttgggaaagcaccaaaatctgcatgttgtgtgtgcccaggcagacttcggggggttcgtgctgtgagacctaaagttcttgatgagattctccaaacaaagaacatgtcagcaggcctatggggggtccatgtgtactaaatgtgtgcg

SEQ ID NO: 1060 - DNA, 255 bp, Homo sapiens
ctgtagtcctagttacttaagaggctgagttgggaggatcagttgaacccagtggttctgggttgcagtgagctgtggtcacaccactgaactccagcctgtgcgactgagtgagacctgtgtctaaaaaaataaaatataatgaatgtgatttatgtagataaattgataatatagtaaataggtaaatgccttaaaaagcatttttaagatttgtaaattctaaaacaataaaaatttggtatacatcaaaaa

SEQ ID NO: 1061 - DNA, 242 bp, Homo sapiens
tgacagcatacctcaaaaggcccctagctaataaacctgtaagcccagcattttgagagaaggtagggtgtgtatatataacaggttgtgtacaactccacgaggtgaaaaatattcagtaacttgttttacatagcatttgtgtaaagactatgatctcatcccaataaaatgatatattacaccttcagattaatgactggctacagagtaacaaaaaataaagaattaatgcacagtaa

SEQ ID NO: 1062 - DNA, 174 bp, Homo sapiens
ccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttaaaaaa

SEQ ID NO: 1063 - DNA, 233 bp, Homo sapiens
ccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccagtactttccaatctcagtcactctagggctctgcactgaatggctgcctgacctgatgtcattaatccaccctct

SEQ ID NO: 1064 - DNA, 275 bp, Homo sapiens
ggctcatgcctgtggtcccagcactttgggaggccaaggcggatggattgcctgaggtcaggagttcgaaaccagcctgatcaatatggtgaaaccccatctctactaaaaaatacaaaaaattagcttggtgtggtggcgcaccctgtggtcctagctactcgggaggctgaggcgggagaactgctttaacccaggaggcggaggttgcagttagccaagattgttgcacttcacttccagcctgggtgacaaagtacactcggtctcaaaaa

SEQ ID NO: 1065 - DNA, 252 bp, Homo sapiens
gataagaaagggctacatctcccgaaatgatttctttacgtcatgtattggtttccttcttcaccttgaacttttgttgaactgtatgtactttaccccaaacctgttaatattttgagcgcttctatgtgaaagcaaagaaataattttaatactctggcattcataaattttattgatgagattatttattttaaaggtttggggaacatctcttggtgtccaaagaggaaataaatatggttcttaaaa

SEQ ID NO: 1066 - DNA, 289 bp, Homo sapiens
cggcacgagagcaggacacgcatgacagcccatgacagagttagtgtttggggaaaatggaatgcaccttgggccaggaaaaaaaaatttaagtacacctttaaatgtatatgtgggggctgttgtggttagagtcatcatagtctaggccaggggttgacagactttctgtaaggtcagagagtaaatatcttaggcttatgagccatgcagttcctgcggcaactactcaattctgctgttgtaggcgggaagcaccctggccaatatgtaagtcaccaagctggct

SEQ ID NO: 1067 - DNA, 295 bp, Homo sapiens
ctgctgtgtcgtttgttttccacaagttgggatggattcatgtcgatacatccccatgcccttgacctcttctggcattctcctgtgctctgacaaactgagccagccttttagatctacatgaataaacaaactattttaccaagaaaaatctcagcttgcttactgcttaattaaaacctacaatttacacacctccctggccttcaagactgtgagctttggatagccctgcttaaatgtttgtcaacaacaagggtcggtaatgtgtcaggtccaatctgggctcctttgg

SEQ ID NO: 1068 - DNA, 256 bp, Homo sapiens
ggctgctggagctggcaaggtcaccaagtctgcccagaaagctcagaaggctaaatgaatattatccctaatacctgccaccccactcttaatcagtggtggaagaacggtcttagaactgtttgtttcaattggccatttaagtttagtagtaaaagactggttaatgataacaatgcatcgtaaaaccttcagaagggaaggagaatgttttgttgaccactttggttttcttttttgcgtgtgtgcacgtttt

SEQ ID NO: 1069 - DNA, 253 bp, Homo sapiens
cactgatgtgtggaagcagcctctccttgccttctgtgctcctcctgtggctgcaggagtttggctctgggtgtctgtgtgtggtggacggtaaattcgctgcccagtcaggtcccacaaggccacggggctcagtcacagccagtgggagaaccatggtgagccatgcaggttgagaacaggaccagttcattttcgagaaaaaaaaggaagggagaaaagcctattgaaaaagtatgccttgcttaatttt

SEQ ID NO: 1070 - DNA, 207 bp, Homo sapiens
gcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcaaccttcctggcaaattaattcccgtttctattccaaaggggcattgaaaaggttttcagttgaaaa

SEQ ID NO: 1071 - DNA, 205 bp, Homo sapiens
tctttccgcgccgccacaatggtgcgcatgaatgtcctggcagatgctctcaagagtatcaacaatgccgaaaagagaggcaaacgccaggtgcttatttagggccgtgctccaaagtcatcgtccggtttctcactgtgatgatgagcatggttacattggcgaatttgaatcattgatgaccccagagcttgggaaattgttg

SEQ ID NO: 1072 - DNA, 215 bp, Homo sapiens
gtcgtttgtttttgttctgagctccataagaactgtgctgacttggaaggtgccctgtgctatgtcgtgcctgcagggacacgtcggatcccgtgggcctcacatgccaggtcaccaggtcaccgtctccttccaaccctgcagtgtgctgttgtgccaggtcaaggacggtgttctctatgcccactggccttcttcctttcctggcccagcag

SEQ ID NO: 1073 - DNA, 362 bp, Homo sapiens
gtgaagtgtgagacaatggtctatcaccccaacattgacctcgagggcaacgtctgcctcaacatcctcaggtgaggacactggccctctaatgccctcctcagcgctgcctgccaggcctccctcatggtcttgtgggcactacatcagactctgtcccttcccacccctttgttgtctgtggtacgagatttcccagtcatcttcctcatgggctgaccttggttttctccttggcctgtcctgctcacaccctccttccaggcctttcacatgctcactctcctatgccctgggtctgacctgcccaacaccagagggggcctgtggaggtttccacttaccaaggcctgacccttatg

SEQ ID NO: 1074 - DNA, 135 bp, Homo sapiens
cgtcagtacgcgaaggatatcggtttcattaagttggactaaatgctcttccttcagaggattatccggggcatctactcaatgaaaaaccatgataattctttgtatataaaataaacatttgaaaaaaccaaa

SEQ ID NO: 1075 - DNA, 80 bp, Homo sapiens
gttttatgattttacctcaaatcagaaaacaaaatgatgtgctttggtcagttaataaaaatggttttacccactaaaaa

SEQ ID NO: 1076 - DNA, 340 bp, Homo sapiens
gtcgtgctcctggcaggcgcgcccctggaggatgaggccactctgggccagtgcggggtagaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtcaaaaa

SEQ ID NO: 1077 - DNA, 189 bp, Homo sapiens
gtcttgccagcactccaaaatctctgtgtgtcccctcttgacactcactgtttcccccagagctaactatcctgacgtatggtaattctccctctgtccttttaagaattattttaccagttatgtgtataacaatatggtttacattttgctcacttttgacttatataaaatagaataatactaaaa

SEQ ID NO: 1078 - DNA, 270 bp, Homo sapiens
cctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctgaaattccccacctgcctttggatgaaagactccgttgggaataaatggccaaagcttataggaaaaaaaa

SEQ ID NO: 1079 - DNA, 385 bp, Homo sapiens
aagccgaccacgttccgcgggctacggccccgagaggttcaggatcctgccccagcccaggtacaagcacagtgaagagttgcaccaccaactgcagccccaggctttggactgttactccggtaaaggtggttcttcccctttgggattccaagcccaggcaaatggaacccatcaatgggcaagttgacagaggttctgcttgggataatgaagagctgcctgtttctttccagtgcctgcttctgggggcagtgaccttgtgaaccactcatttttatgcaagtggcatccctaaaacctgagatgaggaagacttcaagggttttacaaggcccttgttttttaaatccaaattgataataatgatctcaaaacacagtta

SEQ ID NO: 1080 - DNA, 45 bp, Homo sapiens
aagtttttctaagactagtgaagaactgaaggagtcctgcatctt

SEQ ID NO: 1081 - DNA, 381 bp, Homo sapiens
gttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgtggatagttaggggtactctgaatcgtgtagtttatgagagcaagtgtgcaagt

SEQ ID NO: 1082 - DNA, 377 bp, Homo sapiens
ttcaaaacaaaatgccaaagaagagagaaacaaaatagcaataacaaaagaagctttgtccttatcctagaaaaggtgattttaatactactccttgaagagtgtaagctgttgtaactaagctgacaacagcaagatctgattgttcaaatgaatactctcaaagcacctttggactacaagataagaacattgaatattttagttattttgttgtgtaaaaaaagcagaaggcaagaattagccaaagttgtacagaacatatttcagtacacagtattcactatgtatgaatgaatgcatatagtggtactatggtcttttgaagctggagatagggaaatttgatacagcaccggggggcctctagtgtcaaa

SEQ ID NO: 1083 - DNA, 170 bp, Homo sapiens
tctgaacgcccccagaaaatttgtgccaaaagagtttagaaaattaaatatacaataaaagtaaacacatacacacaaaacagcaacttcaggtaactattttggattgcaaacaggataaattaaatgttcaaacaatctgataaaataaccatttggagactgaaaaa

SEQ ID NO: 1084 - DNA, 158 bp, Homo sapiens
ggtttatgtttatgcagttcataattttgcagtttagtttgtgtgggttagtggccctactgttcaactggatggcaaatctgtgctaggaggataccatatgcacaagtattttcttaaataatgttggcgtttgcactggtgttaggggaaaaaaa

SEQ ID NO: 1085 - DNA, 208 bp, Homo sapiens
tgttgagcctttttggcctggcttgttttgcaaaggccctggcaacggtcaacattgggagcctcatcttcaatgtaggggccggtggaccttgctccagcagcttggtgctcgaccacaggaggtcctccccctccacttcttcttctccacttgaggagaagaaagttgagcaaagaaagaagattcgaggagtctttatgatgac

SEQ ID NO: 1086 - DNA, 219 bp, Homo sapiens
ggagcctcatctgcaatgtaggggccggtggacctgctccagcagctggtgctgcaccagcaggaggtcctgccccctccactgctgctgctccagctgaggagaagaaagtggaagcaaagaaacgaagaatccgaggagtcttatgatgacatgggctttggtctttttgactaaacctcttttataacatgttcaataaaaagctgactttaaaaa

SEQ ID NO: 1087 - DNA, 228 bp, Homo sapiens
gcagagagggaattgcatgtttgtgttgtatatttagtatgaacttttttcagaatataatatttcttagttatcaaagtagttggaaaacatttggcaagactatgaacatagaattgactgacttttatattttaactacagattggtgaatttcactgaccttatattatttatttctgaaacaaaagaggcatttttcaataaaactactgaaatttgaaaaaa

SEQ ID NO: 1088 - DNA, 192 bp, Homo sapiens
gtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctacctcccacccaaccaactttcc

SEQ ID NO: 1089 - DNA, 258 bp, Homo sapiens
gctgagtcacgtgcatatccagtccatgctgcgtcgctggttcgtggagacggagggggctgtcaaggcctacttgtgggacaacaaccaggtggttgtgcagtggctggaacagacctggcaggcaggggatggcccgcgctccaccatccgtgagaacatcacgtagccttaagcacgactctgtcctcaagaccatccgaggcctgtttgaagaaaccccgaggtcgccgtggactgtgtgatataccttaggca

SEQ ID NO: 1090 - DNA, 168 bp, Homo sapiens
ctcctgagcgcaagtactccgtgtggatcggcggctccatcctggcctcgctgtccaccttccagcagatgtggatcagcaagcaggagtatgacgagtccggcccctccatcgtccaccgcaaattgcttcttaggcggactatgacttagttgcgttacacccttt

SEQ ID NO: 1091 - DNA, 228 bp, Homo sapiens
caggtcgacactagtggatccaaagaattcggcacgaggcagattacatgcgctacttaatggaagaagatgaagatgcttacaagaaacagttctctcaatacataaagamcagcgtaactccagacatgatggaggagatgtataagaaagctcatgctgctatacgagagaatccagtctatgaaaagaagcccaagaaagaagttaaaaggaggaggtggcacc

SEQ ID NO: 1092 - DNA, 274 bp, Homo sapiens
gtcgaagcgaaggacgtggtggggtcctcttggtgcgaaattccggatttcctttgggtctctccggtagagctgtaatcaattgtgctgacacacagagccaaaaacctgtatatcatctccgtaaggggatcaaggggcggctgaacagacttcccgctgctggtgtgggtcacatggtgatgccacagtcaagaagggcacccagacctcagaaaaaggtccatccgacagtggtcattcgacaccaaagtatccgtagaaaagttggcgt

SEQ ID NO: 1093 - DNA, 298 bp, Homo sapiens
ctagatgaacggcgcaaaaggaggcaagaagaatcggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaccttccttgatgaggtttctcgacagcaggatctattataaaggcaccgagagaaggaggactcaaagcactcgagggatacagaaatacctcaag

SEQ ID NO: 1094 - DNA, 261 bp, Homo sapiens
aatggagtgcctactgcatgccagcaacagggcttggcctgggggaattgggaggaaccaagccctcttcatctgttcatgtgcccagcatttattaagcacctgctgtatgcaaggttcccatgttacggcagtgaatgaggcataattgttccctccatcagcgattgattcagtcatcaggcaggttactgatcagattaagaatcaggcactaggtgatacacattcatttttaaaattcattcaggggtttataaa

SEQ ID NO: 1095 - DNA, 292 bp, Homo sapiens
gcaactttgtcctccctacatgtttgcacatacatatcattctctgtcatgggaattcaagtctgtgtaccttcccatctacactcaaatttgaggttgtcaaagatggaagaatgtatatgtaccagttctaaaaattctgtctcagccataaccatttgatgttctttttccagagataagctttgccaaggcatacatatgataatttgtgagagtatataattcagcatatttggagatgaggaaatgagacttaggataaataactttaagtgcaccagctaagagg

SEQ ID NO: 1096 - DNA, 281 bp, Homo sapiens
ctgagacggggtgggaaggatggatccccaaagcctgggttcttggcctcagtgattccagtggacaggcgtccaggagctccaaacctgtagaggacccaggagggcttcgggcagattccacctataattctgtcttgctggtgtggatagaaaccaggcaggacagtagatccctatggttggatctcagctggaagttctgtttggagcccatttctgtaagaccctctatttcaaatttgcagctgaaaggtgcttctacctctgatttcacccca

SEQ ID NO: 1097 - DNA, 291 bp, Homo sapiens
ctcgagtttttatcatattttgtgtccatgcaccatttttcttaaaatggcttacaaaaaagaatgtaaacaatttgtgatctggccagttgtacttttagctcccagaggggagttggtggtattatgagttgagtaaaaaccatccaggggaacttgagggagcagtctgttgccagtaatgttcctcgtgtgccattaaaccacctccagatgagtggaggaacatcactttttaattttttaattgtatttggattgttgccgtgtactaagaccttgactaaataa

SEQ ID NO: 1098 - DNA, 231 bp, Homo sapiens
taacactcttatcctaccttggccgtggatttaaacgtcatccattagcctaatacaacgttgctgaaagccaaatttttctacactatatgcttcaaacccaagaaagtactggagctgactaataagggagtcattagcagtacacagctgctacaaagagcctgaacaaagtaacacaaaattatcaggagaaatgttttacacagaacagatgtagcagagtttaga

SEQ ID NO: 1099 - DNA, 288 bp, Homo sapiens
attggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtgggctgaatgttctgacattaacagttttccatgaaacgttttattgggttt

SEQ ID NO: 1100 - DNA, 357 bp, Homo sapiens
ctcgtgccgaattcggcacgagttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgacccagctggctaacaggcttgtctgcctggttttcc

SEQ ID NO: 1101 - DNA, 360 bp, Homo sapiens
gtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttccctttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaaga

SEQ ID NO: 1102 - DNA, 195 bp, Homo sapiens
caaaaattaaagtgattgaaggcagtcttcagcctattatcaaaactgaaggacccacactaacaaaagtcaaaattgaaggtgaacctgaattcagactgattaaagaaggtgaaacaataactgaagtgataccatggagagccaattattaaaaaatacaccaaaatcattgatggagtgtctctcgagaaa

SEQ ID NO: 1103 - DNA, 355 bp, Homo sapiens
cacctgtgctcaggatgcagccctgggatccagcacccatggaagcttctgctgggatggtgtcacctatgggttttgaaccagtgtggtatggtccttgggagctctgctctgagcttgccacactgctgagagcacccactgtcctgaccagagtctcagtggtccctgacccccaatgtgggcaggggctgggcaggagggtggggtctgctgttggttcagaggactccacctcctggctggtttacctgctgctgcccattttctctgggtactgctggcagaggactttagcctacccctgaagagctgtcatgtaattttcctactgcatagatacctaaggccaggg

SEQ ID NO: 1104 - DNA, 340 bp, Homo sapiens
gaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgccttcctttcccatctgtctatctatctggctggcagggaaggaaagaacttgcatgttggtgaaggaagaagttgggttgaagaagttgggttggacgacagttaaatctagagttaaaccaagcttgcccaaggtgtcctgcaggctgtaatgcagttttaatcagagtgccattt

SEQ ID NO: 1105 - DNA, 321 bp, Homo sapiens
cggcacgaggtggcgaatgatcacagcaatgaacaccatccgaagcggggcaggcgtctgcgtcctgcacaactgtatctatgctgctgggggctatgatggtcaggaccagctgaacagcgttgagcgctacgatgttgaaacagagacgttgactttcgtagcccccatgaagcacccgcgaagtgtcccttgggatcactgttccaccaggggagaatctacgtccttcgaggctattatgggtcacacagctccttgacacatgtgtgagtgttaccgaccccgatacagacacctgcgcagcgcggtgacccgcat

SEQ ID NO: 1106 - DNA, 266 bp, Homo sapiens
gttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaacttgagtttctttctctttaggcctttcacaactaggactgagaatgtatgtaaaagttctgtgacagtacagaaggaaaacaacttttttatgtatagcttctaaaaggggaaa

SEQ ID NO: 1107 - DNA, 280 bp, Homo sapiens
ccccgggccaccgccgagtgacgccaaagccctggttgactctgacagccccgtgggtgtgtgggaggccgggcgctctggggtctgtctgtcagtgcaatcgtttagtgttttttcagtcgggcggggcgggaagcgggttggacccggcagccagttctcaaaggctgttgggccgactggaggccacagcccctcacccctagacgttgccaaccagaactgacgtgtgactcctgggtgttgatgccattaaaaccaacgttggtgcccggtaaaa

SEQ ID NO: 1108 - DNA, 337 bp, Homo sapiens
ccgaagtcatatatagggctagtaagtggtgggattccaattcagttttgactcactgcagttaaactcaattacccaacctgatgataaacaatgggtctaatacttgtaaatacatttggtagaatattaattgactttacttatttatttatgtgagacactctctctctattgcccaggctggagtgcagtcgcgcagtctcagttcattgcagcctccaccgcctggattcaagcgattctgcctcaacctcctaagtagctgggattgcacgcatgcaccaccacgcccagttaatttttgtatttttagtagagacagggtttcgccatg

SEQ ID NO: 1109 - DNA, 325 bp, Homo sapiens
attttctggtacccgtgtttcatttaattactttgttgctttctctccctccctgagttcaattaagttgagaaaagtgttcattgttattactgatggattagactttatttgctcttcattgaatgtttcagttaatttacagactagtaaattatctgagtcatcaaggttatgtacgtgtattgtgggtatctatatacataacgtatagatacgttaatgcaggaggctgaatacttgcaagtcgctttaggatgatttgttatatccctgtggttcctgcttcccaagaaatgttttctgtaattacatcaagtgtctc

SEQ ID NO: 1110 - DNA, 349 bp, Homo sapiens
gaaaccccttggccaagtaagctgtgggcaggcaagcccttcggtcacctgttggctacacagacccctcccctcgtgtcagctcaggcagctcgaggcccccgaccaacacttgcaggggtccctgctagttagcgccccaccgccgttgagttcgtaccgcttccttagaacttctacagaggccaagctccctgggagcccttttggacagcttaggctttacagttcggttaattggccccaagttaattgttttccctcgccataactcccaccaaggtgtctagagacatgatgagcttcgtgtcatcctccggggctcgccacacgattagactcctctgtt

SEQ ID NO: 1111 - DNA, 276 bp, Homo sapiens
taaaaagacaaatgaatggggaaagacaatcattgaatacaaaccaaataagccatcacgcctgcccttccttgatattgcacctttggacatcggtggtgctgaccaggaattctttgtgtgacattggcccagtctgtttcaaataaatgacctcaatctaaattaaaaaagggagggattttgaaaaacctttctcttttgccattcttcttccttcttaattaaccttaaagctgggtccctccatttcttctagcacacttcttcacttaa

SEQ ID NO: 1112 - DNA, 142 bp, Homo sapiens
gtgtgcgctcactgcttgggaagtgcagggggtcctgggcacattgccagctgggtgctgagcattgagtcactgatctcttgtgatggggccaatgagtcaattgaattcatgggccaaacaggtcccatcctcttcaaaa

SEQ ID NO: 1113 - DNA, 310 bp, Homo sapiens
tccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagttccgcaaggtgtattgcatcgagcaaccgggaccaagtggtcacaggccttccggttggagaaggcccttcaaaggctctctgtggcactgacgcgtgtc

SEQ ID NO: 1114 - DNA, 300 bp, Homo sapiens
ttaaaggacactttttttctgaatatatgaacactcatctacaagtatactttacctcatagtgacaggttatctgcaaggtgataaaagatagaaccaagatctttagtggaataactgttctccctgagaagttcttatttacattttgtcaatgaaaaaataacagcaaataaaggtaaaatgtctactattctaatgggtcttacttgaaaaggataggtataggtttattctctattgcttgaaaatgaatatgtgaatatattatagacatccagcatctcatgtccaattact

SEQ ID NO: 1115 - DNA, 302 bp, Homo sapiens
ctcgtgccgaattcggcacgagattgtctggagtagtgcaggccctgcgaggccgcctgttgcccagcctggggcccccaggatcaacccggagcccccctggaccccacacagcagtcctggccctggaagatgaggacgatgtgctactggtgccactggctgagccgggggtgttggtagctgaggcagaagatgagccacttcttaccttagagggaccttggggctcttacttagagcctctttcccttggggctcttactcatatgtgtgcacaaccctttagagagtgggtaact

SEQ ID NO: 1116 - DNA, 291 bp, Homo sapiens
actgtgtgtaggggggtttcagggctgaatcccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctctcccacttggtctgggtttggcaggcactggcctgctacttgagggccaaggatgctcccccaggggaggaaacggtatagtgtggggtatgtccaaggctgcatcc

SEQ ID NO: 1117 - DNA, 295 bp, Homo sapiens
gttcaaaggtgattagattaataatttaatagaggatgagtgacctctgataaattactgctagaatgaacttgtcaatgatggatggtaaattttcatggaagttataaagtgataataaaacccttgcttttacccctgtcagtagccctcctcctaccactgaacccaattgcccctacccctccttctaactttattgctgtattctcttcactctatatttctctctatttgctaatattgcattgctgttacactaaaaattcataaagatttagtggtaaggtgccaa

SEQ ID NO: 1118 - DNA, 221 bp, Homo sapiens
gctggaagatggccctaaattcttgaagtctggtgatgctgccattgttgatatggttcctggcaagcccatgtgtgttgagagcttctcagactatccacctttgggtcgctttgctgttcgtgatattgagacagacagttgcggtgggtgtcatcaaagcaggttgacaagaaggcttgcttgagcttgcaaggtcaccaagtcttgcccagaaagct

SEQ ID NO: 1119 - DNA, 376 bp, Homo sapiens
ctggtttgtgttttgctgctgcatttatcccaagaaaaacagctttaatctccagaaggaaaccaaaataccatgggatttatgctgtattgacaacttgcgacctaaacgtacaacatcatagtaatttgtcatgggcaacatgacccaagagagaaggtttttgtccaattggaatttaaatacacattggcacacggctaacctgtgtggggtaaaatttaaacactgtgtttaatcctgcgcgagaaattctctctcacaatataccctgtcgcatatactctggaatagtcgcatacccttttgtgcacactccctttctctcagtgtatatattaaaaagtgttgcgctgcatttgcgcaatgtgtcaaa

SEQ ID NO: 1120 - DNA, 249 bp, Homo sapiens
gttgacctttatttattaaacttcagcaaccctacagtatataagcttttttctcaataaaatcagtgtgcttgccttccctcagggctctttccatactgttaaaactttgtttttgtgatccgcgctctcagagagtcactctgtaaaatctgtgtacacacagatattttgacatatcagatatatgttgcacaggccatagtacatgtttgtgtttagatgaaactctgttgaaaaatcacaaaa

SEQ ID NO: 1121 - DNA, 256 bp, Homo sapiens
cccaaacccacgtccacccgtacgtaccagacaaccttagccaaaccatttacccaaatgaaagtatgaggcgatagaaattgaaacctggcgcaatagatatagtaccgcaagggaaagatgaaaaattgatgacccagcataatatagccaggactctaaccctataaactctctcgcactatatagaatttgaactctagagaatatactcytttgcgacaggagagagcacaagctgctagagcccccgaga

SEQ ID NO: 1122 - DNA, 324 bp, Homo sapiens
cgcatcccaacataggttaagagcaagttgaaaacaaaggccatggcattctgccactgcatccttcagacagttatatcctccttttaaaccattgttgttgagtgtaagatgtccctcatggtttcttattaaggttccagggttaggaatggtaacccttcttaggtatatacagagatcaagtgtgcctttggctcttcacacgatcacatccatacattgtgacactctgtctgtctcgatcacacagacaccaggcatctgtctcaaatggatccttattgtgatgatttgtctgatggctatcagcatctctaatgt

SEQ ID NO: 1123 - DNA, 210 bp, Homo sapiens
  misc_feature 210: n = A,T,C or G
gaaatggcccgcaaggtgattgagcactgcagtaactttaaagaggagaacatggacacgtctagatagaggcctccgtccccatggccgccaccgctctggaccacaggcggggaggaagcatgctcaagcagcccagccggcgggcccctttccgagggagccttccacggagttaagagacatatggggaccttttgcacacacccn

SEQ ID NO: 1124 - DNA, 400 bp, Homo sapiens
tatgagtgcagtgactgtgggaagtctttcactaaaaaatcacagctccaagtgcatcagcgaattcacactggagagaagccttacgtgtgtgctgagtgtgggaaggcctttactgacaggtccaatttgaataaacatcagacaacacacactggagacaaaccctacaagtgtggcatctgttggaaaggcttcgttcagaaatcagtgttcagcgtccatcagagcagccacgcttgagagaaacagtgtgagaaaaccccactgagggttgggtctgattgtacactgttgcatgcatgcagcagaaaaatatgtatattattgtaaatagaatgacccatcagagtgtcacacatggctgttcttgagagggcctctgagaaggcaccttatt

SEQ ID NO: 1125 - DNA, 403 bp, Homo sapiens
tgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatat

SEQ ID NO: 1126 - DNA, 403 bp, Homo sapiens
gtcacttgcagccttcattcccactccaatcaagggcttttgtcacaatggatacctgagctaaccattataaaagatatataactagtaaagtcctggcccctgccctcattgtgcctatcccaaggtttggcattcaataagtattcaatctatatttgattaattgatcttccccttgctcaccaggtacaggggatatattccctgaaggcatctttcttccctttactaagcctcactgattatctttaagtttcagcctcacattttgactgtggtctcaacattactgaccaggtccttctccatagtctcctcccacctctgaggatcaaactaaaagcaaggtactcacacttggcccagagagaccatcagcgaaactcctcattcctaaata

SEQ ID NO: 1127 - DNA, 305 bp, Homo sapiens
gtgatcaccattatgcagaatccacgccagtacaagatcccagactggttcttgaacagacagaaggatgtaaaggatggaaaatacagccaggtcctagccaatggtctggacaacaagctccgtgaagaccttgagcgacttaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccaaaaa

SEQ ID NO: 1128 - DNA, 378 bp, Homo sapiens
ctcgtgccgaattcggcacgagcaaaaaattagccgggcatggtgggtgggcacctgtagtctcagctacttgggaggctgatgcaggagaattgcgttaacccgggaggcggagcttcagttagctgagatcacgccacttcacttccgccttggcaacagagcgagacttcatctcaaacaaacaaacaaaaaaagaatttcagtgagattcaaaagaacacagatagataactaaaaagtttcataatactatatttgaacaaaatgagacttttaatagagaaatagaaaccattaaaagacccaaacagaaatcttggcactaaagtgaacaatgggagagcttaaaaaatgtaacacgttttacacggactc

SEQ ID NO: 1129 - DNA, 396 bp, Homo sapiens
gtgaaacctcgtctactaaaaatacaaaaaattggctgggcgtggtggcgggcgcctgtagtcccagctactcaggaggctgaggcaggagaatggcatgaacccgggaagcaggctttcagttagccgagactgttccacttcacttcagccttggtgacaaagcgagacttcatctcaaaaaaacaaaacaaaacaacaaaacccacaattcttctacaacagagcctacgtattcaccacggtcaagtaaattaccccttaaccccacaccaagtgtagcaaattccaacagtttaaagagagtagggagagaacaccttaattatctctgtactgccagtgacgcacaggtgttaagcctgttaggggatcaagctgcaggggcacatagac

SEQ ID NO: 1130 - DNA, 210 bp, Homo sapiens
gttcgaaagcatcttgagaggaacagaaaggataaggatgctaaattccgtctgattctaatagagagccggattcaccgtttggctcgatattataagaccaagcgagttcttcctcccaattggaaatatgaatcatctacagcctctgccctggtcgcataaatttgtctgtgtactcaagcaataaaatgattgtttaacttaaaa

SEQ ID NO: 1131 - DNA, 378 bp, Homo sapiens
agaaaataaagaggaaaatgcatccttgggctaggctctttccgatctttctctcaacattctttcgatggcagcagctcagagacaatgaggacctatcaatctgcctttctccaattctcctaccccagtcacctaatgttacctaaacccaaaaagggaatatataccacttcaaactcttctcttaacactaattctctcctggcggagctttcaacaaggatgccctccacctctctaagggcacaccacccactctaatctctctgtgcccgagagacctatatgtggcgagaggagaatatagcgctgaggtgtactcttataccatgtgacacgagcacagtgtaatctgtgacacatttaccctataat

SEQ ID NO: 1132 - DNA, 269 bp, Homo sapiens
gcggactatgacttagttgcgttacaccctttcttgacaaaacctaacttgcgcagaaaacaagatgagattggcatggctttatttgttttttttgttttgttttgggttttttttttttttttggcttgactcaggatttaaaaactgggaccgtgtaaggttcaacaattggtttgagccagcattccccaaagttcacaatttgggcccgggctttttttttcacacattttttttttttaaaaggcactccacaattgggattt

SEQ ID NO: 1133 - DNA, 165 bp, Homo sapiens
ttgaaagtctaacttttttttacttatatatttgatacatataattctcttggctttgaaacttgcaactttgagaacaaaacagtcctttaaattttgcactgctcaattctgtttttcgtttgcattgtctttaatataataagagttattaccttacataaa

SEQ ID NO: 1134 - DNA, 150 bp, Homo sapiens
cgcgctgtgggtagtgtgtgaccgtggctgtactgtatagtggaacatagttggcatatctttgttttgaagtttgttggtgactccaccaaactggtgtgaaaaaggaaaaaggctcaaaaaatccacaaaaggacaacacacacaaaa

SEQ ID NO: 1135 - DNA, 224 bp, Homo sapiens
ctcgtcaccttctctgcaagaggagtattgaaaactggtggactgtcagctttatttagctcacctagtgttttcaagaaattgagccaccctctaagaaatcaagaggtttcacattaaaattagatttctggcctctctcgattggtcagattgtgtgcgcaattctgatctgcattttcagaggaggacaatcattgaaactaagtagggggttcttcttt

SEQ ID NO: 1136 - DNA, 232 bp, Homo sapiens
tgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggagtcaccattgcagatgcttaagtcacctattttaataaattgatgaccagttgttaaaaa

SEQ ID NO: 1137 - DNA, 263 bp, Homo sapiens
ctgactggaagagtggagagtactggattgaccccaaccaaggctgcaacctggatgccatcaaagtcttctgcaacatggagactggtgagacctgcgtgtaccccactcagcccagtgtggcccagaagaactggtacatcagcaagaacccaaggacaagaggcatgtcttggttcggcgagacatgaccgctggattccagttcgagtatggcggccagggctcccgccctgccgatgtcgccatccagctgaccttcc

SEQ ID NO: 1138 - DNA, 294 bp, Homo sapiens
gtgaggaggacggtctgcatactcgctgcccgccggctccctcccccgcgtccctgcgaccgccgcggcgaagatggcctcaggagtgcaagtagctgatgaagtatgtcgcattttttatgacatgaaagttcgtaaatgctccacaccagaagagatcaagaaaagaaagagggctgtcattttttgtctcagtacagacaaaaagtgcatcattttagaggagggcaaagagatcttggttggagatgttggtcgtcacctaactcatcctttcaagcattttgtgggtat

SEQ ID NO: 1139 - DNA, 289 bp, Homo sapiens
ccgtgatgtggcccctcaggctcctgtgcacttcctggtcattcctaagaagcccattcctcggattagccaggctgaagaagaagaccagcagcttctaggacacctactccttgtggccaagcagacagcaaaggctgagggcctcggagatggataccgacttgctcaatttcagtgatcaacgatgggaagctgggtcacaatctgtgtatcatcttcacattcatgtacttggggccggcagctccagttgcctccaggtggacctgccactgattaaggacac

SEQ ID NO: 1140 - DNA, 152 bp, Homo sapiens
ccggaacggcggttgtccggggcaggggcaggggcttggggccttggccttaaggagccttaggcttaggggcacttccgagagcccctttttggtgataattgtttgcactttttcgtacagggtggcggggccgggagggcctagcgccc

SEQ ID NO: 1141 - DNA, 211 bp, Homo sapiens
ttttaaaagacaaaaacccaactctttgtggattttttatcaactcttttactcagagccactctccaattgcaggtcacactccaattatgatggaagatattttttatacttaattgcagtagggacttattcccagacaaagcaatagtcacgtcttcatggacccactcaatggattgtttttgaagactggcaataaagctgccat

SEQ ID NO: 1142 - DNA, 362 bp, Homo sapiens
gagcttaggtataacatcatcaagtgtgttcacacgcggggtcggtttaatggagtgtccacgcggagataactgcgatattggcacacctgtagagagagattgttctatagggctggaatattacagagttacattctgggaggttctgtttttactcgcatcaaacacccctctgttgttctccatcatctttaatagcaactggagaccactttggtcattggtaagggggtgcattctcctcacaaaggggttttatggacttcctcaggcggagagcttcttaacacacaggcaggatggaaaagactactagccacttttgcttcccacccccttaatgcatccttcattgtctt

SEQ ID NO: 1143 - DNA, 150 bp, Homo sapiens
atgctgtcccttctaactgaacacattctttccatcctggttgggcttctgtactcctattattatgaacctgagttgcttgagtgtttgggctaataatgggtgaagtataggtagacgtacacctacactaacactaaccttggatct

SEQ ID NO: 1144 - DNA, 280 bp, Homo sapiens
gtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaagtgatggcatctatatcataaatctcaagaggacctgggagaagcttcttctggcagcttcgttcaatttttccattaaaaccctcctgatgtagtttaa

SEQ ID NO: 1145 - DNA, 219 bp, Homo sapiens
gcaggttggagccgctgccgtcgccatgacccgcggtaaccagcgtgagtcggcccgccagaggaatatggaaaagcagagcgacttcggttaagggaaagcgccgagattgacgggctttcctggctgccgcccgcaagcagagggactcggagatcatgcagcagagcagaaaaaggcaaacgagaagaggaggacccaagtagctttgtgcttcgt

SEQ ID NO: 1146 - DNA, 253 bp, Homo sapiens
gtttttttagggtttattcttgaccacagatcttaagaaatggacaaaacccctcttcaatcttaagattagtatggttttggtgttctaacagtatcccctagaagttggatgtctaaaactcaagtaaatggaggtgggaggcaatttagataagtgtaaagccttgtaactcaggatgattttttttagaaagtgtatagaaactattttaatgccaagatagttacagtgctgtggggtttaaagactt

SEQ ID NO: 1147 - DNA, 300 bp, Homo sapiens
tcttggatttttgtaccagagatgtgctaaactgatgaaatacatttgagaagtttccatcttattctctttatatgggactgatgatgtgtgttggggtagactgctcctgcagagtttggaagaagtcaccagcaaagccggcctaaccaagaaaagtcaaggcccttcatgacctttctgggcacagaaaacaccctcgtggagtacactaatttgactggactggtctcagtgtgagcacttggcacactttactaaacacatatccaccccaccgtgagtcaactttaaggtaac

SEQ ID NO: 1148 - DNA, 198 bp, Homo sapiens
tcctggtcctcctggggaacctggccctgcaggtcaagatggtgttggtggtgacaagggtgaagatggagatcctggtcaaccggtcctcctggcccatcttgttaaggttggcccaccaggtcctcctggaaaacgaggtcctccttggagctccaggtccagagggaagacaagtgaaaaaggtctaagggggag

SEQ ID NO: 1149 - DNA, 260 bp, Homo sapiens
agcggcgctgcgaccccatccgcatctccatgtgccagaacctcggctacaacgtgaccaagatgcccaacctggttggcaacgagctgcagacggacgccgagctgcagctgacaactttcacaccgctcatccagtacggctgctccagccagctgcaggctggagttcagtcgcatgatcatggcttactgtggcctcaaccttccaggctcaaggtatcctccagttaagctcctattaaggtgaccagtggcctc

SEQ ID NO: 1150 - DNA, 281 bp, Homo sapiens
cgctacataacaaaccacctcaaaacttagtagcataaacaacaaccattttttgggccactgtcaaggagtcagaagggcaattctctgctctacgacggctaggatgactggattgactcgaggtgactcgaataactgggagttggacagctggggctgaagggtcacttgtaagatggttgttcacttggcaaagagagctggaggctggctcagttgggacttttgaccagagagactcacatgatgtctccagcaccatggcctggtcattggac

SEQ ID NO: 1151 - DNA, 290 bp, Homo sapiens
cggcacgagccatcactctcatcctgtatttttataagacaacacaagagtgcataccagaaattgaatataccatatgggattggagaaagacaaatgtggaaggaaatcatagagctggagactacttttgtgctttacaaaactgttaaggattgtggtcacctggaacaggtctccaatctatgttagcactatgtggctcagcctctgttaccccttggattatatatcaacctgtaaacatgtgcctgtaacttactccaaaacaaaatcatacttattagaga

SEQ ID NO: 1152 - DNA, 176 bp, Homo sapiens
cggcacgagagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctttaaaaa

SEQ ID NO: 1153 - DNA, 250 bp, Homo sapiens
ctgaggtccttgttttgttttgttcataatacaacggtgctaattaatagtatttcagatacttgaagaatgttgatggtgctagaagaatttgagaagaaatactcctgtattgagttgtatcgtgtggtgtatttttaaaaaatttgatttagcattcatatttcccatcttattcccaattaaaagtatgcagattatttcccaaatcttctacagattcagcatttgttcttcgccagcctcattt

SEQ ID NO: 1154 - DNA, 288 bp, Homo sapiens
atttagaagattataacagctgtatttcatatttgcctccttatatatatcaaagaccaaggtatttccttctgcttcaaaagaacaaaattgggaaagaaaactcacttgagtcttgatcaaacaagtgtcttttacttaagaagaaacttggtaatcattgtggcacccacagcaagcagttccttaccagtaaaaagggtgcactgaggtaacatctaaaacagagatgtggttcttaatgtttaacagaacagttcttaatcctgccacgtgttatcattatag

SEQ ID NO: 1155 - DNA, 284 bp, Homo sapiens
tgggcacatgccttttaaaagttctttaagcaacacagagctgagtcctctttgtcatacctttggatttagtgtttcatcagctgtttttagttataaacatttttgttaaaatagatattggtttaaatgatacagtattttaggtatgatttaagactatgatttcacctatacattatatatattttatagagatactaaaccagcatacccttactctccagagtagtgagctaataaacacggttggtttctgaattaaattgaactaaatccaactt

SEQ ID NO: 1156 - DNA, 180 bp, Homo sapiens
aatatgtaccttattctaccactagaaagaagattcaggagtggatcccaccttcaacaccttacaagtaaagacaattaagaacagttgaaacatgcaaaatatggagcttttcatgtaattactcttttactgtttaccattcactataattcacaattaaaattgtgtgactaaaaa

SEQ ID NO: 1157 - DNA, 266 bp, Homo sapiens
cacaactgttgcatgataaattagtctttgtccaagtgaaagcaagtttcctgattaagacaaagcctagccattgccagaagctgcttgaactaactcagctcctaaattgcatttacatccaagagcttgggggttctttctggctgtccaaaattgaaatgttgtcagtgcaaggacacaccatccatcaatttcttctcagaggttcctctctaccttctaggactttgctatggcatttgttggctctcatgctggcctca

SEQ ID NO: 1158 - DNA, 327 bp, Homo sapiens
ataagattacttcagttttgtcactggcacatctcgggtgcctatgaatggatttgctgaactatacggttcaaatggaccacagtcatttacagttgaacagtggggtactcctgaaaagctgccaagagctcatacctgttttaatcgcctggacttgccaccttatgaatcatttgaagaattatgggataaacttcagatggcaattgaaacacccagggctttgatggagttgattagattacaaattaacaatctgtagtgtttttactgccatagttttataaccaaaatcttgacttaaattttccggggactactaaa

SEQ ID NO: 1159 - DNA, 359 bp, Homo sapiens
agatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaggaggaaatccaggagctgcaggctcagattcaggaacagcatgtccaaatcgatgtggatgtttccaagcctgcacctcacggctgccctgcgtgacgtacgtagcaatatgaaagtgtggctgccaagaacctgcaggaggcagaagatggtacaaatccaagtttgctgccctctctgagctgccaccggaccaataccgccctgcccaggaaa

SEQ ID NO: 1160 - DNA, 245 bp, Homo sapiens
ggccgctactccgccctgttcctcggtgtggcctacggagccacgcgctacaattacctaaaacctcgggcagaagaggagaggaggatagcagcagaagagaagaagaagcaggatgacctggaaacggattgccagagaattggcagaagatgacagcatattaaagtgagtgaccctccgacccactctttggaccagcagcggatgaataaagcttcctgtgttgtgtgataaaaaaaaaa

SEQ ID NO: 1161 - DNA, 181 bp, Homo sapiens
cttgcagagggtgggggtctcagggtcttaggtgatacgggagagaaagaacgtgccaggcaggaggcccctgaagtctgtgtactccgaggtggatctccatccccatccacctgtacggacatcttttccgttgcggtttgagaatgttcctataataaacccctctgctttgtaaaaa

SEQ ID NO: 1162 - DNA, 294 bp, Homo sapiens
aagtaacaaatgaagacttcaaaaaatctaaagaaaatgttctttataagaaacaggaaggcacccctgagggctgtatctctaatgaaccatggctgtcatcaggaaaatggttgggagatttctcaatccctgaaagattgaggttgggggagttcccagacgaatccctgttcccactgatttttattagcaaacatcctgtgtctttggagtacgatgtgtaagttcccattggtggcctgttggtcactgtcagcagtctgcttccaataaagcgtgctctttaaaaaa

SEQ ID NO: 1163 - DNA, 264 bp, Homo sapiens
ctttctcgattccgtgggtggtggtgcatggccgttcttagttggtggagcgatttgtctggttaattccgataacgaacgagactctggcatgctaactagttacgcgacccccgagcggtcggcgtcccccaacttcttagagggacaagtggcgttcagcacccgagattgagcaataacaggtctgtgatgcccttagatgtccggggctgcacgcgcgctacactgactggctcagcgtgtgcctaccctacggccggc

SEQ ID NO: 1164 - DNA, 289 bp, Homo sapiens
ggcgcagacggggaagcggagccaacatgccagttgccccggagctgggtttgtcgcaaaacttatgtgaccccgcggagacccttcgagaaatctcgtctcgaccaagagctgaagctgatcggcgagtatgggctccggaacaaacgtgaggtcttggagggtcaaatttaccctggccaagatccgcaagcccgcccgggaatcttctgacgtttatgagaaggacccacggcgtcttttcgaggcacgccttctgcgcggctggtcccattgggttctgatgagg

SEQ ID NO: 1165 - DNA, 281 bp, Homo sapiens
caggactcaaaatggcgtcagttgtaccagtgaaggacaagaaacttctggaggtcaaactgggggagctgccaagctggatcttgatgcgggacttcagtcctagtggcattttcggagcgtttcaaagaggttactaccggtactacaacaagtacatcaatgtgaagaaggggagcatctcggggattaccatggtgctggcatgctacgtgctctttagctactccttttcctacaagcatctaagcacgacggctcccaaataccacttaaggagg

SEQ ID NO: 1166 - DNA, 289 bp, Homo sapiens
ctcttccatctctactaacccctgactacaaacagcctccacctatttcacctgacattgtactttatgaaagcagcagttctcagatggggctattttgccccctgggacattagggagtatctggagacacttagggttgtgtctacttggggggagttgtgttactgcatccagtgagtccagggatccagggatgccgctcaacatctgaaatgcacagggcacccccacacatagaacagagaattgctgagccaaatgtcagcggtgtcacagctgacacctg

SEQ ID NO: 1167 - DNA, 185 bp, Homo sapiens
caaaatttttttaatcttcgccttaatacttttttattttgttttattttgaatgatgagccttcgtgcccccccttcccccttttttgtccccaacttagagatgtatgaaggctttggtctccctgggagtgggtggaggcagcagggttacctgtacattgattgagaccagttgataaatg

SEQ ID NO: 1168 - DNA, 167 bp, Homo sapiens
gagcctaaaatttataggaacaataaacgtaaaggccatttatattggagatataaatttaaaactggtaagatttcatttctacatgattaatcatgtagagttgcccttttatcaaaggacttttttgacaatagagacaagttttgtttaaaagcagattttta

SEQ ID NO: 1169 - DNA, 208 bp, Homo sapiens
aaaaatcacattctctgttcagctgttaatgctgggatccatatttagttttataagcttttccctgtttttagttttgttttgggttttttggctcatgaattttatttctgtttgtcgataagaaatgtaagagtggattgttaataaatttcagttttagttctgtaatgtcaagattttaagatttaaaaacgggttggttaaa

SEQ ID NO: 1170 - DNA, 200 bp, Homo sapiens
gagaaactgaacaaaaggctagaggcatgggccaggtaaaaattgggcctagagtgaagactgttctgtcgttaagagctttcgaggaaggagtacttactccccaatgatgatgaatggaaaagtacttttcagggagaattgaaggggttaaagtgttaaatatgttgcctagacaagggttctttaaagaagacagc

SEQ ID NO: 1171 - DNA, 235 bp, Homo sapiens
gcacgtgtggaccatctaatgaaagtgggaaagaataacttcagaccaccgcccaaggtggaatccagtgttgtaaggatagaacctaagaatccaccaccacccatcaattttcaggaaatgggactggtctagtaaggataacctctgttaggaaaaccaagacactctctgctgcatttaaatcaagtgcagtgcaacaactcttggaaaaaagctacagaattcactgttc

SEQ ID NO: 1172 - DNA, 173 bp, Homo sapiens
  misc_feature 157: n = A,T,C or G
cctccctctgtcccgagcctggatcgcagttccaagtccaaggctcggcgggaaagtcctcagcctaggacgccctggagccccccagcccagctgcagcgaaatactggcgcgccccgccccaccatggacggggccggtgatttcgagctgccantattgagcattttttt

SEQ ID NO: 1173 - DNA, 500 bp, Homo sapiens
cctccctctgtcccgagcctggatcgcagttccaagtccaaggctcggcgggaaagtcctcagcctaggacgccctggagccccccagcccagctgcagcgaaatgctggcgcgccccgccccaccatggacggggccggtgatttcgagctgcctttattgagcatttctttgaccctccctcacccaccaaccaccaaatcactgtgacatcttggctattatacacttcctgatctagaatgagctcgaaaggagaggctaacccccgcccccagtacagtacttggcaaatagtatgttgatccttaaaacttcttgcccttttatctctcgtaacagacctagggctagacccctgaccccatctgttattcagggcactgacattttctacaagcccactaacctttggaggatgtgtccagagggagcctaactctggcttttttaaaaataacgctaataagaaagcctttctaatcctttggactactttc

SEQ ID NO: 1174 - DNA, 115 bp, Homo sapiens
ttcgttatcgtggaggcccctggcacggggattctacaaggaatcatgtctcgaaggtagctgctacagccaacttttgctcggctataagcggggtcccggaaccaaagggagc

SEQ ID NO: 1175 - DNA, 114 bp, Homo sapiens
cagaactccgttttattccggcattttgcagaacgttacagcttggactagtaactaggaatcggaggggctcaaccaggaaagccatcaaatcaaaagacgccaagcccaatt

SEQ ID NO: 1176 - DNA, 559 bp, Homo sapiens
cagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccggcacacaaggccgtgtcatccacacaactcactgtctgcagctgctgtctggtgtcgtccttggtgtcagaactttgggggccggg

SEQ ID NO: 1177 - DNA, 106 bp, Homo sapiens
cgaagtctctgcgggtaccggagcagcagattttgccgcctttcggccaccttcctgtttcagaaccttagttccatctcttcgcgacgagcccactggtagacgt

SEQ ID NO: 1178 - DNA, 510 bp, Homo sapiens
ggacagtatctgtgggtacccggagcacggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaaagggggtcccctg

SEQ ID NO: 1179 - DNA, 114 bp, Homo sapiens
cactgcagcctcaacttcccaggctcaagtgatcctctcatctcagcctctccagtagctgggactacaggcatgtgccgtcacgtccaactaatttattttaatttaatttaa

SEQ ID NO: 1180 - DNA, 279 bp, Homo sapiens
caaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggtttccatgtgattcccctttcatatgatcttctaagttga

SEQ ID NO: 1181 - DNA, 292 bp, Homo sapiens
ctcgtccaatatcggcacgggggttaagttggggaccgccgttcagtcgccaatatgcagctctttgtccgcgcccaggaaaaacacaccttcgaggaaaccggccaggaaacggtcgcccagatcaaggctcatgtagcctcactggagggcattcccccggaagatcaagtcgtgctcctggcaggcgcgcccctggaggatgaggccactctggccagtccggggtggaggccctcactaccctggaagtagcaggccgcattcttggaggtaaagtccatggttccct

SEQ ID NO: 1182 - DNA, 211 bp, Homo sapiens
aagcggctccccattttataccaaaggtgctacatctatgtgatgggtggggtggggagggaatcactggtgctatagaaattgagatgcccccccaggccaccaaatgttcctttttgttcaaagtctatttttattccttgatatttttctatattttttttttttggggagggggccttgtgaattttcctaaagggtctattaaaca

SEQ ID NO: 1183 - DNA, 215 bp, Homo sapiens
gttatttcttgccttctgttagcttttgaatttgtttgctcttgcttctctagttcttttaattgtgatgttagggtgtcaattttagatctttcctgcattctcttgtgggcatttagtgctataaatttccctctacacactgctttaaatatgtcccagagattctggtatgttgtgtctttgttcttgttgggatccaaagaacatctata

SEQ ID NO: 1184 - DNA, 246 bp, Homo sapiens
tacagattttgctttctgtggaattgaaaattcacacaaattcacagcttaaatttcccatcagtgactggaggaatttttttcaggagcttcctatattaccatccctcatgcatattaactctttagaatattaggttaagtgatgtctatagaagtagcctggaaaaccatgagttttggagttcagtgaccccctgcttcctctgctcctccttccaaggcattgaggctgaatgtgccact

SEQ ID NO: 1185 - DNA, 190 bp, Homo sapiens
cttttgtttgccacaaaaatcttcatttgtaaaatgaggatatttggataagccacatttcagggcaataaaaagtgtgtgtgtgtgttttatatgcatatacgatgtatataccaatattatacacacatacatatttatgtgcatgtaagtattattttatatagagatatacagatacatagataaa

SEQ ID NO: 1186 - DNA, 103 bp, Homo sapiens
ttgttgggcgtcgctctaagcagagatgtgcccaagagacgaaaagtcgctgagtcgatcactctaggcttcaatctgagtattaaaagttgaagtacgtcct

SEQ ID NO: 1187 - DNA, 101 bp, Homo sapiens
gatagattgttgacgttgcctttctttataacaactttctaatccacaaaaattactcatatttctctgtcatctgtcaccgtcagtacacaaatcagcta

SEQ ID NO: 1188 - DNA, 369 bp, Homo sapiens
gatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaaaaaaaaaaaaaaaaaaaaaaaaaaaaaaaaaaaaaaaaaa

SEQ ID NO: 1189 - DNA, 101 bp, Homo sapiens
ctccatctacacagatgtcttagagtttgacgatggcaacccagctaccatgtgccagatagccaaggatgtgtgcaccttcctgcgctgggcattgctga

SEQ ID NO: 1190 - DNA, 316 bp, Homo sapiens
ctcactttccaccctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccccctaggggtgggaggaagcaaaagactctgtacctattttgtatgtgtataataatttgagatgtttttaattattttgattgctggaataaagcatgtggaaatgacccaaacataaaaaaaaaaaaaaaaaaa

SEQ ID NO: 1191 - DNA, 103 bp, Homo sapiens
ctattcacctttcactcttgctttagcttctctcgactctctctctgaacctctcacagatgcagcatctacgctcttctagtctgtctgcgtctctgtcccg

SEQ ID NO: 1192 - DNA, 100 bp, Homo sapiens
gatgggcatctctcgggacaactggcacaagcgccgcaaaaccgggggcaagagaaagccctaccacaagaagcgggaagtatgagtttggggcgccgct

SEQ ID NO: 1193 - DNA, 109 bp, Homo sapiens
atttagagataatccctggagaaatgtcatgggatcaacagagatcttgtttaatatgtactgtacgactgatatcatatacatgaggatcatgttctgtatcaatctg

SEQ ID NO: 1194 - DNA, 325 bp, Homo sapiens
atttttggagaataaatccccttggaggaaaatggtccatggggtatacaaaaagagtatctttgttttcactcatgtacttgtacctgtctggattattcattattacatgaagtatcatgtttctggtgatacaattctggagactggagaagtaattccaccaatgaaagaatttcctgatcaacatcattaaagattatgtaaaaagttaaaaggcttatgagcctaagtttgttcctatattaccatatttactgaattttctggaaaagtaactttaataaagtttaatctcagaaattgtcaaaaaaaaaaaaaaaaa

SEQ ID NO: 1195 - DNA, 118 bp, Homo sapiens
gaggaacgggagtaaccgagagcgtagtaaccatcatgagcctcctcaacaagcccaagagtgagtatgaccccagaagagctgccagaagcgaggaggaggagggattttaacaacc

SEQ ID NO: 1196 - DNA, 323 bp, Homo sapiens
gccaagtattaagtactgttacatctaaaatacagaatgtcaaatggttgcatagcttgtttcccacaacaaggaggaaaagaacaggaatacaaactctgtaatatgctgataaagaagccttagaactgccaactggcttgatggttcaattagtaagctaatttctcccacaccccctccttggtttttagactaattttcccaaagcaaggtttagtcacacaaacttgaaagtacatttaaaatgttctgagttgtcatcctacttttattgcctatggattatgctaatttctaaaaaaaatacgggggaggcacaa

SEQ ID NO: 1197 - DNA, 367 bp, Homo sapiens
gccaagtattaagtactgttacatctaaaatacagaatgtcaaatggttgcatagcttgtttcccacaacaaggaggaaaagaacaggaatacaaactctgtaatatgctgataaagaagccttagaactgccaactggcttgatggttcaattagtaagctaatttctcccacacccgctccttggtttttagactaattttcccaaagcaaggtttagtcacacaaacttgaaagtacatttaaaatgttcttagttgtcatcctacttttattgcctatggaatatgctaatttctaaaaaaaatacgggagaggcaccaaacccctaaattctagtgcaataatttaaaaaaaaaaaaaaaaa

SEQ ID NO: 1198 - DNA, 307 bp, Homo sapiens
gtgtgtaaggatggtagagtgatatatagtgttagctggtaccttagtccaatgtgtgccattaatgagggaccccactggggttggggtcaatctctcctagccaagcagttacattgttataggctgggaggggggtgtcgtatcagtaacagggcagaggaaggcagatctaacagatgagcccaatagagtttagcaggtacgttttgcaggcaagaacagagcataaaattgatcaataccctatgtgagatgcaatgtacaacagagagcatggcaagggacaaatatctggggtgaatgg

SEQ ID NO: 1199 - DNA, 208 bp, Homo sapiens
cggagcggaaggcttgggtgcggttcaagattcagcttcacccgtaacccaccgccatggccgaggaaggcattcctgcttggaggtgtaatggacgttaatactgctttacaagaggttctgaagactgccctcatccacgatggcctagcacgtggaattcgcgaagtgcccaaaggcttagaacaagcgccaagcccatctttgt

SEQ ID NO: 1200 - DNA, 101 bp, Homo sapiens
tagtagctaccctttcagctcatttgcagcaagttttacaaggccgttattgaatatacgcacatttaacccccaggccaaagcttgcaacacaacacatg

SEQ ID NO: 1201 - DNA, 129 bp, Homo sapiens
cacccttcaggggatgagaagttttcaaggggtattactcaggcactaaccccaggaaagatgacagcacattgccataaagttttggttgttttctaaaaaaaaaaaaaaaaaaaaaaaaaaaaaaaa

SEQ ID NO: 1202 - DNA, 102 bp, Homo sapiens
gtagcgtattagctgttcaaattacgcaaggatgttgccaatgattgcgtttgcggcaaagaagcagaaaagagcatggcttcataagcgcggctctgcaac

SEQ ID NO: 1203 - DNA, 578 bp, Homo sapiens
ggaagaagaaaaggattataaaggccctaatccaagagagcttttggagccactatttaaacaaagcagttgttcctacagaattgagtcttattggacttacgaagtatgtcatggaaaacacattcggcagtaccatgaagagaaagaaactggtcagaaaataaatattcacgagtactaccttgggaatatgttggccaagaaccttctatttgaaaaagaacgagaagcagaagaaaaggaaaaatcaaatgagattcccactaaaaatatcgaaggtcagatgacaccatactatcctgtgggaatgggaaatggtacaccttgtagtttgaaacagaaccggcccagatcaagtactgtgatgtacatatgtcatcctgaatctaagcatgaaattctttcagtagctgaagttacaacttgtgaatatgaagttgtcattttgacaccactcctgtgcagtcatcctaaatataggttcagagcatctcctggtgaatgacatattttgtcaatcactgccagggtctccatttaaggcccctcaaccctgaggcaactgggagcaagca

SEQ ID NO: 1204 - DNA, 139 bp, Homo sapiens
gagctcgaagccatggccagatgccacctacggcactggttctgcatcacgggcctcagcagtttctgagctgagtcctcgggagcgaagccagcctctcaaaagcccccctacagtctgtggttgtgaggcggcgtca

SEQ ID NO: 1205 - DNA, 129 bp, Homo sapiens
cttcggcacgaggtccatttaaactcattatcttaaactgtgcttgtcaacttattgacttattcatcagacaaatatcctcttgagtaactactgtactgtcactgttctagacatggaaaggataat

SEQ ID NO: 1206 - DNA, 468 bp, Homo sapiens
gagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataagggacagaaacaaacaaataccgataaaaaaaaaaaaaaaaa

SEQ ID NO: 1207 - DNA, 145 bp, Homo sapiens
gtccatttaaactcattatcttaaactgtgcttgtcaattattgatttattcatcaaacaaatatttcttgagtaactactgtatgtcactgtgctagacatggaaagtataatatttgtgagaagaactaaattcaataaggat

SEQ ID NO: 1208 - DNA, 499 bp, Homo sapiens
gtccatttaaactcattatcttaaactgtgcttgtcaattattgatttattcatcaaacaaatatttcttgagtaactactgtatgtcactgtgctagacatggaaagtataatatttggagaaaaactaaattcaataaggatttttttttagttcagccgtggaaaatatgcaaaaagtgttttttatgagcgaattttacataaaagcaacccattgtcataatgtgccttttacatcttcttcctcagacatcagtgaaatttttaggcaaaaaatagagcttgtcttcacttggtcatgtttttttcacaagacagtttcttttgaaagaaaaaatgaaagataatagagataagagcaaaaatgcttgtcttaaaattgctgtccatcaggctctcttttatgacctggagaatggaacttttaatactatagtactaagagttgaccagtggcaataagaacagtgttatgcattgtacaatatactaggta

SEQ ID NO: 1209 - DNA, 103 bp, Homo sapiens
ctcgtgcagatgcgggcagcttgggccacgcatgacgatgacactcgcacgcgtacaccacagcaggtctgacagcgagagggtcattggctcgcctagtaga

SEQ ID NO: 1210 - DNA, 140 bp, Homo sapiens
gaccatttctgtgcctcaagaataaaagcgttgcagctgtggaaggagatagaaactcgacatcctggattggctgatgttagaaatcagataatatttgctgttcgtcaaggatatgtcgagcttggagatcagctcct

SEQ ID NO: 1211 - DNA, 161 bp, Homo sapiens
ctgtcaaattggcaggaaaacagagagaattcatggtgctgaagctggtgttcttgcttctttttcttgagcaatataaccagtttttacttagtttgatttatattctgggcaaggaagcgttgctactttatttgcacaatcccttgttctgtcggtag

SEQ ID NO: 1212 - DNA, 149 bp, Homo sapiens
cacatcctagcaccgagctgcagacagaatttccacctcatacataaggcatcagtcttcaagtccgaggctcgttaaggaacagtttccttgagacaattctacttgtaccttaccaattagggtatccagtatctccgtgattacct

SEQ ID NO: 1213 - DNA, 120 bp, Homo sapiens
ctcaccaggaggagtcgtgcacatgacacgaccagctgcttggttacatgctcatgctgattcgggcacgttcctgtacacgtcacgatgacgcttcggctcatttttgctaccggcaac

SEQ ID NO: 1214 - DNA, 520 bp, Homo sapiens
gtggtgctcaaccagggaagggagatcgtgcagacaatgaacagcgacccaggcctggctgtgggttacactgccttcaatggcgtggacttcgagggcacgttccatgtgaacacggtcacggatgacgactatgcgggcttcatctttggctaccaggacagctccagcttctacgtggtcatgtggaagcagatggagcaaacgtattggcaggcgaaccccttccgtgctgtggccgagcctggcatccaactcaaggctgtgaagtcttccacaggccccggggaacagctgcggaacgctctgtggcatacaggagacacagagtcccaggtgcggctgctgtggaaggacccgcgaaacgtgggttggaaggacaagaagtcctatcgttggttcctgcagcaccgggcccaagtgggctacatcagggtgcgattctatgaggggcctgagctggtggccgacagcaacgtggtccttggacacaaacaatgcggggtgggccgcctggggg

SEQ ID NO: 1215 - DNA, 180 bp, Homo sapiens
caaggatgtcctgagtgtggccttctcctcttgacaacccggcagattgtctctggatctcgagataaaaccatcaagctatgggaataccctgggtgtgtgcaaatacactgtccaggatgagagccactcagagttggtgtcttgtgtcccgtttttggccaacagcagcaacctatt

SEQ ID NO: 1216 - DNA, 100 bp, Homo sapiens
gaggccatagaccgtctgacgacgcagcacagcaggacacgaccgcgcgaactaaaaacaccgcccgggtcaagtcggccgacacaactacgtccgatcg

SEQ ID NO: 1217 - DNA, 534 bp, Homo sapiens
gtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttgggaaaaaaaaaaaaaaa

SEQ ID NO: 1218 - DNA, 116 bp, Homo sapiens
aagtctggtggatctgagctgagaggcactcatgctgtatggaaagacaaggagcaagggcttgccttaaacctgatcttccagagcaaaaggctcttccagagcaaaaagggggg

SEQ ID NO: 1219 - DNA, 202 bp, Homo sapiens
gagccgttgagggcactttccagtccccgaggcggatccggtgttgcatccttggagagagctgagagctcgagtacagaacctctaaggccatcaaaccttttgatcggaagtcagtccatcagatttgctcttggccggtggtacttagtctaagcacttcgggttaagagatagtagggaacagtcttggattctgtgc

SEQ ID NO: 1220 - DNA, 210 bp, Homo sapiens
cacagaatgtgaaggagacatccagaagaattacgagtgtgccaacttcggcgatcagggcatcaccatgggctgctgggacatgtaccgccatgacatcgactgccagtggggtgacatcacttacgtgcccccctggagactacctgtttccaggtggttccttcagcgagagacgggaaaaaaggtttagcacttaagcgggctctt

SEQ ID NO: 1221 - DNA, 125 bp, Homo sapiens
cagcaatggccaagatcaaggctcgagatcttcgcgggaagaagaaggaggagctgctgaaacaacctggacgacctcaaggtggagctgtcccagctgcggtcgccaaagttacaaggcggttc

SEQ ID NO: 1222 - DNA, 130 bp, Homo sapiens
ctcgtccaaattcggcagggggtcgccatggccgccgccccgcccgttgttaccggtattgtaagaacaagccgtacccaaagtctcgcttctgccgaggtgtccctgatgccaagattcgcatttttga

SEQ ID NO: 1223 - DNA, 290 bp, Homo sapiens
cttatagaaaaaagtaaccaacaggtaaataaaaatctccaagcacacattaaaaaaaaagccagatagagaagactagaataaataaataatgcaaacactttcaatgcaaagactagatgtacattcacaagatacaatgcaaacagagaaccatgacctccttaaactgacaaaactagagacagtaactgaccctcacaagatggcaatatgttattagctccctgatgaggagttcaaaataccagttttaagggactcagtgaccttgaggtacacagagagca

SEQ ID NO: 1224 - DNA, 305 bp, Homo sapiens
tttttttttagtgctgaataatattccattttctaggtttaccacagttgatttatccattcacctactgaaggatatcttgggtttcttccaagttttggcaattatgaaaaaagctggtataaacgtgtgtgtccaggtttttgtgtggatataatttttcaactatggggaaaaaccaaggtgcatgattgctggattgtatggtaaactatgtttagttgtagaggaactgccaaactgtcttccaatgtgattgtgttgatttgtattctacagcaatgaatgagagtcttgtgactcac

SEQ ID NO: 1225 - DNA, 235 bp, Homo sapiens
cgcaggctgaagcgcaaaagaagaaagatgaggcagaggtccaagtaaacccctagcttgttgcaccctggaggccacaggagcagaaacatggaatgccagacgctggggatgctggtacaagatgtgggactgcatgctactgtctagagcttgtctcaatggatctagaacttcaatcgccctctgatcgccgatcacctctgagacccaccttgctcataaacaaaatgcc

SEQ ID NO: 1226 - DNA, 320 bp, Homo sapiens
gaggatttttggtccgcacgctcctgctcctgactcaccgctgttcgctctcgccgaggaacaagtcggtcaggaagcccgcgcgcaacagccatggcttttaaggataccggaaaaacacccgtggagccggagtggcaattcaccgaattcgaatcaccctaacaagccgcaacgtaaaatccttggaaagggtgtgtgctgacttgataagaggcgcaaaagaaaagaatctcaaagtgaaaggaccagttcgaatgcctaccaaggcctttgaggaatcactacaagaaaaactcctttgtggtgaagggtctaag

SEQ ID NO: 1227 - DNA, 343 bp, Homo sapiens
aacaccccagcagatcgctgtgatgacctcagaggagatggccagtgatgagctgaaggagatccgtaagccatgaccaaggaggccatccgagagcaccagatggcccgcactggcgcacgaggacagacctagttcacctgcggcaagtgcaggaaaaagaactgcacctacacacaggtgcagacccgcagctctgatgagcccatgaccacctttgttgtctgcaacgagtgtggaaaccgctggaagttctgctgacccctcgtgtagatgtgctgcagccttgggccctccccggccaacgtcctccgttgacacaacttctctggagacctagagg

SEQ ID NO: 1228 - DNA, 110 bp, Homo sapiens
ccatgcagatcgctgtgatgacctcagtggagatgagccagtagtgagctgacggacgatccgtaagccaatcgaccaacgacgccatcccagagcaccatataggcccg

SEQ ID NO: 1229 - DNA, 484 bp, Homo sapiens
gggtgggcctggctcagggaagggcacccagtgtgagaagatcgtgcagaagtatggctacacccacctctccaccggggacctcctgcggtccgaggtcagctcaggctcggccaggggcaagaagctgtcggaaatcatggagaaggggcagctggttccactggagacagtgttggacatgctccgggatgccatggtggccaaagtcaatacttccaaaggcttcctgattgatggctacccgcgggaggtgcagcaaggagaagagtttgagccacggattggacaacccacactgctgctgtattggacgcagggcctgagaccatgacccagcggctcttgaaacgtggagagacagcgggcgtgtggacgacaattagggagacatcaaaaagcggctggagacctattacagggcacaaaaacccgtcatcgccttctatgagaaacgtggcatgtgcgcaagggtcaacgctga

SEQ ID NO: 1230 - DNA, 330 bp, Homo sapiens
ggacattcagactgagcgtgcctaccaaaagcagccgaccatctttcaaaacaagaagagggtcctgctgggagaaactggcaaggagaagctcccgccggtactacaagaacatcggtctgggcttcaagacacccaaggaggctattgagggcactacattgacagaaatgcccttcactggtaatgtgtccattcgagggcggatctctctggcgtggtgaccaagatgaagatgcagaggaccattgtcatccgccgagactatctccactacatccgcaagtacaaccgcttcgagaggcgccacaagaacatgtctttacacct

SEQ ID NO: 1231 - DNA, 325 bp, Homo sapiens
cttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaaggacaacacagtcactcctggcggcaaaccaaacaaaaccagagtcatctggggaaaagaactcgggccatgaacagtgcatggtcgtgcaaatccgagcatctcctgctaggcat

SEQ ID NO: 1232 - DNA, 191 bp, Homo sapiens
gctaaaataaaaatacagactggctgataagcctaaagagatctttgactttattagtaatcaaagaattgcaaataaaattataatagtatttcctttccccactgataagatttgtcaaaattatggaaattgttaaaacacagttttagcaaatatgtggtaaacacacctgtgtactttcggtagga

SEQ ID NO: 1233 - DNA, 131 bp, Homo sapiens
atgcctggccccgaatgaccccagatttgactccaacaacgtggtcctcattgaggacaaccgggaaccctgttggggacaaggaatttaaggcaaccattccccaaccagccttcgcaacgggggaaggc

SEQ ID NO: 1234 - DNA, 139 bp, Homo sapiens
ctcacgcaagcatggttaacgtccctaaaacccgccggactttctgtaagaagtgttggcaagcacccaacccattaaagtgacacagtacaagaagggcaaggattctctgttacggcccagggaaagcgggcttatg

SEQ ID NO: 1235 - DNA, 131 bp, Homo sapiens
cggcacgaggaggccacaggagcagaaacatggaatgccagacgcttgggatgctggtacaagtttgttgggactgcatgctactgttctagagcttggctcaattggatcttggacttcatcggcctttg

SEQ ID NO: 1236 - DNA, 137 bp, Homo sapiens
ctggtgttatcaccgtgggctccctgactcggagttgatcgcctttcccaagtgctacaacctttttcagctggatgaggaatttgaggtctctgattcctcttcaaagcgttccctgactctaatctgtaaggggc

SEQ ID NO: 1237 - DNA, 124 bp, Homo sapiens
ccaaacagcccccgaaaacgctacgtgagctgggccctgggcaagggcagaaaacggacggaagaaaaggtcttggcccgagatgggtctcactctgtcacccagacttgagttcagttagttg

SEQ ID NO: 1238 - DNA, 148 bp, Homo sapiens
gcaagtgaaagtgtcttcacccaatcttctgaacgtaaaaggaaatagctgaaatgaaattctaaaatatttgagaagagccaattttataggccttttggaggtcaaagatgaaaggacccatgtattcaggatttcccgattatta

SEQ ID NO: 1239 - DNA, 444 bp, Homo sapiens
gttaaaccctgtggcggttactgcaatgtggtcatgcaaggctgtatggcaggtgtggtggagattgacaagtactggagagattacattctgtcccttgaagaacttgtgaatggcatgtacagaatctatgacatggagaacgtactgcttggtctcttttcaacaatccatgattctatccagtatgtccagaagaatgcaggaaagctgaccaccactattggcaagttatgtgcccattctcaacaacgccaatatagatctgcttattatcctgaagatctctttattgacaagaaagtattaaaagttgctcatgtagaacatgaagagaccttatccagccgaagaaggggactaattcagaagttgaagtctttcatcagcttctatagtgctttgcctcgctacatctgcagccatagccctctgcggaaacgg

SEQ ID NO: 1240 - DNA, 404 bp, Homo sapiens
aggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcaggcctgctacgcgggcaagcgtgctgcctctcttctgtgtcgttttgttgccaaggcagaatgaaaagtccttaaccgtggactcttcctttatcccctcctttaccccacatatgcaatgactcttaattttcactcttgtagtgtaatcctctgtattacaacatgagatatagttgcatatatggacaccgacttgggaggacaggtcctgaatgtcctytctcagtgta

SEQ ID NO: 1241 - DNA, 106 bp, Homo sapiens
ggcacgagagtacttctagagcggccgcgggcccatcgattttccacccgggtggggtaccaggtaagtgtacccaattcgccctatagtgagtcgtattacaatt

SEQ ID NO: 1242 - DNA, 229 bp, Homo sapiens
atgagcctggttaaccaagtaccgaaaatagttcccgatgactttgagaccatgctcaacagcaacatcaatgaccttttgatggtgacctacctggccaacctcacacagtcacagattgcactcaatgaaaaacttgttaacctgtgaattgagcccaagcagtacacttgcttgtctaggtattaaccccaggactcagaagtgaaggagagatatgggtttttgt

SEQ ID NO: 1243 - DNA, 203 bp, Homo sapiens
gagaagccctttgccatcgccaaggagtagggcacagggacatctttctttgagtgaccctctgtgcaggccctgtagtccgccacagggctctgagctgcactgtgccccggtgctgggcatctgtgtggagcggacccactcccctcacaatccacaaggcccatggactcacttttgtaacaaactcctaaccacactga

SEQ ID NO: 1244 - DNA, 209 bp, Homo sapiens
ctcctccttttttctttcttgcccatctcattatctgataagtaatttgtgtttttaagtttttttctccctagataatagaaagggaaagaaggtagaacataaataaggattacttaataatttttcattcagttatttagctgtgtttcccactggcaaaaatatttctctactatctttgtatatattgaataatacattatttt

SEQ ID NO: 1245 - DNA, 334 bp, Homo sapiens
ctcctccttttttctttcttgcccatctcattatcttataagtaatttgtgtttttaagtttttttctccctagataatagaaagggaaagaaggtagaacataaataaggattacttaataatttttcattcagttatttagctgtgtttcccactggcaaaaatatttctctactatctttgtatatattgaataatacattatttttaaactatatatatcagttactcttatcagtccaaaagcttatagaattactcgtgccgaattcggcacgaggttttgttaaactgtatcacattttataccttgcagaaattaatttcattggt

SEQ ID NO: 1246 - DNA, 325 bp, Homo sapiens
ctcgtgccgaattcggcacgagtatcaatcacctgagctcaccatagtctaatagaaaacaaccgaaaccaaataattcaagcactgattattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaacttatatttcactttacatccacacacacttttgcgtttgagcggccgcctaatacttggc

SEQ ID NO: 1247 - DNA, 267 bp, Homo sapiens
cctcgtgccsaatttcggcacgagcctcgtccccctcttcttcattgccaataaaaaggagacacctaaagaagaaaagcaccaaccaactttgattgattgtgttctgccactggccaaaccatggcactttgaaggccacgccgtattgaggacgccgggattccttggttccaggccatccagagccagttccttggcaggcctgcagttatgcgagagccgttaaaagcaaggctccagctttaccagccagagcgaggccat

SEQ ID NO: 1248 - DNA, 239 bp, Homo sapiens
aaaatataaaaaattagtcgggcatggtggcgggcgctgtagtccaactactcgggagactgaggcagaagaatggcgtgaactcaggaggcggactttgcagttaggccaagggcgacagaagcaagactctgtctcaaaaaattaaaaaataggtgcacttgtccttcgaggaaagttttctacatctggtaatttgtaccttgaaggtgggtgtccctgtgggtgtcttttttgca

SEQ ID NO: 1249 - DNA, 246 bp, Homo sapiens
cagttatctcgttatgtgaccatacaaccaaagtgttgtaatggagtacaatttctgttttatttctgaggaagtggaagctgaagaagattaagagacttagattaagcagagccagattgaaaacgtaggtcttttgactccaaatctacaatcttccttattatgacccagcctgttgagctcttagtatacactttggagatttcaaaagcagatataagcctcagagattttatagctcct

SEQ ID NO: 1250 - DNA, 450 bp, Homo sapiens
cagttatctcgttatgtgaccatacaaccaaagtgttgtaatggagtacaatttctgttttatttctgaggaagtggaagctgaagaagattaagagacttagattaagcagagccagaatgaaaacgtaggtcttttgactccaaatcctacactcttcctttattatgacccagcctgtggagctctagtaatacctttggtatttcaaaagcagtataagcctcagatttttagctcctgacctgatttttcagagtaatcaagaacctgttggctacacagtttgggatattgtctgtgaagaatgtgggaattgcttagtgtcccgtcctgcacatggctttcactgccataatggccagccctgagccctcatttaaagcctgagaagtactcatgtttggatatggaaacatttgtttcccttaacttttaatttacagcttg

SEQ ID NO: 1251 - DNA, 315 bp, Homo sapiens
gaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccattgcaacaggctttaaaaaaagacccttaaaaagacactgtctcaactgttgtgttagcaccacgccagctctctgtacatttgctagcgtgtaggtttctcagactatgttaactctttatttgtagggagtagagagtcg

SEQ ID NO: 1252 - DNA, 197 bp, Homo sapiens
aataattctgtggtttcatttttctgtaaacaactaaaagaataattagatcatattctagtatgttctgaaatatctttaagactgatcttaaaaactaacttctaagatgatttcagcttctcatagtatagagtttactttgtacacgtttgacgaaccaactacctgtagaagagtgagggatctattgtaat

SEQ ID NO: 1253 - DNA, 253 bp, Homo sapiens
aaaaagctgtggttctcaaaggggcaaatgacttagatatcaaagcagagggaaatattagattccggtatatcgttcttcaagacacttgctctaagcggaatggaaatgtgggcaagactgtctttgaatatagaacacagaatgtggcacgcttgcccatcatagatcttgctcctcttggatgtttggcggcacaaaccacggaattcggcgttgaaattgggccagtttgttttgtgtaaagtaggca

SEQ ID NO: 1254 - DNA, 238 bp, Homo sapiens
gaatggcataaatttgtgaggtgaactgtttaaaacaaagatgggcagactcctctcagaaaatgaggccatgttcctagaggtccaactctatgtaatggtcttaggggttgatgaagcactgtagtcctgcttctcactcatacctcccctccagaaaggataaaattataaatgtcccaattagggtctttattagtctcttcccatgtaggatttatcaatagtttgacaggtt

SEQ ID NO: 1255 - DNA, 191 bp, Homo sapiens
atgaaatcagattgcatggaagaatataaagacactcactcggatgaaaactataacggttttcaaactattttgatggtcattgtacgagctattgtatggattactgtggagtgctgtttaccacatgatgtgtgcaatacatcatgcaatgttatttagcaatgcgtaataaaagtgtttaaaagaga

SEQ ID NO: 1256 - DNA, 270 bp, Homo sapiens
ctcgtgcgcacggattccctcattaaaatagatcatttagttaagccccgaagacaagctgtgtcagaggcttctgctcgcatacctgagcagcttgatgtgactgctcgtggagtttatgccccagaggatgtgtacaagtttcctgccgactagtgtggggggaatcacggacacttaaagtcaatctgcgaaataattcttttattacacactaactgaagttttgagtccagagagcattctatgtcaaacattccaagtactttt

SEQ ID NO: 1257 - DNA, 203 bp, Homo sapiens
cagacagttgcggtgggtgtcatcaaagcagtggacaagaaggctgctggagctggcaaggtcaccaaggtctgcccagaaagctcaggagggctaaatgaatattatccctaatacctgccaccccactcttaatcagtgggtggaggaccggtctcagaactgtttgtttccaattggccatttaagtttagtagtaaaag

SEQ ID NO: 1258 - DNA, 215 bp, Homo sapiens
gtcccggagagcaagaacggcggcagccgggcgctcaacaacaaccccgaggaggagcggcacaaagcggggtgctgctcatctgcctcgacctcttctgcctcttcatggcgggcctccccttcctcatcatcgagacaagcaccatcaagccttaccaccgagggttttacctgcaatgatgagagccttcaagtacccactgaaaaactggt

SEQ ID NO: 1259 - DNA, 190 bp, Homo sapiens
gctggaggccctttatccttagcagaccaacacagaaagagaaaacccaaatactgcatgttctcacttataagtgaggagttaaatgatgagaacatatggacacatagaggggaacaacacacactggggcccttttggaggatagagggtttaaggagggagaggatcaagaaaacaactaatgggt

SEQ ID NO: 1260 - DNA, 157 bp, Homo sapiens
tggttaatgaaagtagcctgaatggagataaactttccgaacacagaaggctgtctttttatcattagaacagtgggtcgacaattttccctggacacttactggcatgggattttgtcaaagagaactggaataagcttgtacagagttccctctg

SEQ ID NO: 1261 - DNA, 179 bp, Homo sapiens
ggaaattgaaagtgaaaacgctgaaacattgaggactaaaattccaaagagggagtttaagggtgtaccatcgcaaatttattggcttgtgttgggagattcttaatcttcctgttggtttgagtcatcctaaaaaatggttcatttaatcattcattcccttctgccctttgctaggt

SEQ ID NO: 1262 - DNA, 440 bp, Homo sapiens
ggaaattgaaagtgaaaacgctgaaacaatgaggactaaaattccaaagaggagtttaaggtgtaccatcgcaaattattggcttgtgtgggagattctaattttctgttggtttgagtcatcctaaaaaatggttcatttaatcattcattccttctgcctttgctagtttgcccgaagttattaagattatctttgtgttttcatcctcaaacacaaatgtgtattgcgcatagccagtgtgttttaaaagatcaagacttttcttaaaatgatgtcgataacttccaaaggcaactgtgaggtttttttgttttgtttgtttgtttgtcgttttcctttggtttggtccttgggaggttataaagatagtctgtcctaacgtatgacaacaatatcatccatgtttccaaaaaagacatgattccgactgcagcatt

SEQ ID NO: 1263 - DNA, 152 bp, Homo sapiens
ggcatttgattggctgaagaacagaaacctgatgtaatggagcaaaatcctcagtacttaacagttaaggcaaggtcttgtgtctacctagggtgtgaattgtaacctgtttaaacttgcaggcaggcaatggggcaagcttgggaaattct

SEQ ID NO: 1264 - DNA, 500 bp, Homo sapiens
ggcatttgattggttgaagaacagaaacctgatgtaatggagcaaaatcctcagtacttaacagtgaaggcaaggtcttgtgtctacctaggtgtgattgtaactgttaaaaattgcaggcaggcatggggcagttgggaaatgctcaggtttttttttactgtagttcaatgaatttaagcaagccacttgaattttctgcattaatttactgagcaccatcctgtatcttatttatgcttgtctttataaacaacacgtaatgcacattttgattcgtttttcaaggcttactgtgttggttcatatcctagttccaagaaaagcacgtttggcagaaataaaagtttttactccaaattatttgataagaaatttggattcaattttagcatctttttgtgtccttattgtttctctctgtcttaaggattatagtggcatggtaagtgcttaagatgcagtcatgaatgtatttttatacaattaggaactataga

SEQ ID NO: 1265 - DNA, 150 bp, Homo sapiens
cgaagatggcggaggtacaggtcctggtgcttgatggtcgaggccatctctgggccgcctggccccattcggtggctaaacaggtacttcttggccggaaggtggttgtcgtaccgcttgtaaggcatcaaccatttcttggcaatttct

SEQ ID NO: 1266 - DNA, 168 bp, Homo sapiens
ctgtattttgctgatcggctgtatgactccatgagggcaaggggacgcgagataaggtcctgatcagaatcatgggtctcccgcagtgaaggttggacatgttgaaaattagggtctgaattcaagagaaagtacggcaagtccctgttacttattatatccagcaag

SEQ ID NO: 1267 - DNA, 182 bp, Homo sapiens
ggtgaggaaggtcaaggtctaggactctaactccttgccactcaagaaatgtcctcctttcagaatatgccttccgcatgtctcgtctcagttcccggctatttggtgaagtcaccaggcctactaattccaagtctattaaagtgggtaaacttgttagtgaactgccttgccaagaagag

SEQ ID NO: 1268 - DNA, 184 bp, Homo sapiens
gtttgcgtgagagtcatacaagaacattttgctgagatggctgccagtcttaagcgtccagactcaggtgccactgggcttcctggaaggcctggccctcctggtccccccggccctcctggaggagaatggtttcccaaggccagatggggattcgtggcctttccgggcattaaggggcccc

SEQ ID NO: 1269 - DNA, 272 bp, Homo sapiens
ctcgtgccgaattcggcacgagcagaagcgagatgacgaagggaacgtcatcgtttggaaagcgtcgcaataagacgcacacgttgtaccgccgctgtggctctaaggcctaccaccttcagaagtcgacctatggcaaatgtagctaccctgccaagcgcaagagaaagtataactggagtggccaaggctaaaagaccggaataccaccggaccttgtcgaataaggcacctaaaaattgtataccccagattcaggcatggattccgtb

SEQ ID NO: 1270 - DNA, 243 bp, Homo sapiens
ctgcaacgccggagcttgccaggagggtctcagggaagtttcactttctgaattaaatatgcaaatactagaaataattagcttcaaagtactttacttagtacagttactccttaaggccttctttaaaacctttagctaaaggctgagaaccattctctaaagaaagcaaaccgcatggctagaaaggacctccagaagtagagatgcaacgtgcccgtgaaccccagttcccttccagag

SEQ ID NO: 1271 - DNA, 460 bp, Homo sapiens
ctgcaacgccggagcttgccaggagggtctcagggaagtttcactttctgaattaaatatgcaaatactagaaataattagcttcaaagtactttacttagtacagttactccttaaggccttctttaaaacctttagctaaaggctgagaaccattctctaaagaaagcaaaccgcatggctagaaaggaccctgagaagtagaatgcaacgtccagtaaccccagttccctgcagaagaaaggggagagagattattttttgaaagaaaagcagctctttttaggacagaaatacactgagtgatcatgtcccagagtgaattgtatcttagaatggctagtatgggccattgttattctggcaggttcctcttatccattctccgagtggcttcccgaattcacagaggttcaggcgctgtggagacccaccgggggtacagatccacaccaccacc

SEQ ID NO: 1272 - DNA, 257 bp, Homo sapiens
accagctcccctcaaaaagaagacactgtctcatgggcctgtgctgtcacgagaggaacagctgcccctcctgggccgcttggtgagaggtttggtttgatacctctgcctccctcctgccagcatggattctgggtggacacagaccttgttgaaggtccagtaccaccaagagctgcccattcacttccaccccacactgtatcaaatgtatcacatattctcatgttgaacactcttagccytaattgagaatg

SEQ ID NO: 1273 - DNA, 242 bp, Homo sapiens
ttagaagccatcagaggtgcaagggcttagaaaagaccctggccagacctgactccactcttaaacctgggtcttctccttggcggtgctgtcagcgcacagacccatgcgcatccccacccacaaccctttaccctgatgatctgtattatattttaatgtatatgtgaatatattggaaataatttggtttgtcctcggttttggtttggtttcggtttgcttttaggccctcacattct

SEQ ID NO: 1274 - DNA, 240 bp, Homo sapiens
ctgaggcagcactgctctcgtcagctgtgttgcctttaccaagtgtcttcagagggttatgagttagagtagctggcctggggagagggtgcctccctggggtttgatctttagggtctgactttctgcagagaagatgttttacagatgtgtcaaagctgatgtaatgtgggttgggggagggaatccaagaccaaagtgtttgtcagctgggtgtacaactgcctatgtgatcccctg

SEQ ID NO: 1275 - DNA, 117 bp, Homo sapiens
caggagcagaaacatggaatgccagacgctggggatcgctggtacaagttgtgggactgcatgctactcgtctagagcttgtctcaatggatcctacgaactccatccgccctcctg

SEQ ID NO: 1276 - DNA, 135 bp, Homo sapiens
agatggtggccgcaaagaagacgaaaaagtcgctggagtcgatcaactctaggctccaactcgttatgaaaagtgggaagtacgtcctggggtacaagcagactctcaaagatgatcagaccaaggccaaagcgg

SEQ ID NO: 1277 - DNA, 201 bp, Homo sapiens
cctcactccaaaataggtgctgatccttcctattcctattctttgccaccttttgggtgtggtgtcaccagcctgtttagccaagtagctttgggcaataggctgcccaatctgagcaaacaccagtgaggctctattgagccaaagaccaaggtcctcaaaagcacctgaaccactgtggccttctcagcctacagcagt

SEQ ID NO: 1278 - DNA, 208 bp, Homo sapiens
caaccgactacttcagaggaaacaaatggtcattgatgtccttcaccccgggaaggcgacagtgcctaagacagaaattcgggaaaaactagccaaaatgtacaagaccacaaccggatgtcatctttgtatttggattcagaactcattttggtggtggcaggacaactggctttggcatgatttatgattccctggattatgcaag

SEQ ID NO: 1279 - DNA, 209 bp, Homo sapiens
cttccaaggaaatggctacccaacttgccttcatgcgcctgctggccaactatgcctctcagaacatcacctaccactgcaagaacagcattgcatacatgggtgagaggactggcaacctgaaaaaggctgtcattctacaaggctctaatgatgttgaacttgttgctgagggcaacagcagggtcacttacactgttcttgtagag

SEQ ID NO: 1280 - DNA, 211 bp, Homo sapiens
gtggcttctccttggctgagagatggaaggcgtggtgggatttgctcctgggttccctaggccctagtgagggcagaagagaaaccatcctctcccttcttacaccgtgagccaagatcccctcagaaggcaggagtgctgccctttccaatggtgcccgtgcctctgtgctgtgtatgtgaaccaccatgtgagggaataaacctggact

SEQ ID NO: 1281 - DNA, 193 bp, Homo sapiens
ctcgtgccgaattcggcacgagggatgcgccgccggacctacagagctcatggtcggattaacccatacatgagctctccctgccacattgagatgatccttacggaaaggaacagattgttcctaaaccaggagaggaggttgcccagaagaaaagatattcccagaaggaacttaagggacacaaacttat

SEQ ID NO: 1282 - DNA, 232 bp, Homo sapiens
catgcacccaacaagcgcatcactgactgctatcgctgggtcatccatgctgggagcaagagcccaacagaacccatgccccccaagggcagcccttacaggggtgcagacctgcagaaccacgcgttgtgatgggggtgcagaccccccttatggagtattggggcgcttggacacatggccgcggctgcaccaagggacccatgggggcttgcccagcttgacagatggc

SEQ ID NO: 1283 - DNA, 199 bp, Homo sapiens
gagaaatgaaaagattgctgtccactgcacagttcgaggggccaaggcagaagaaatcttggagaagggtctaaaggtgccggagtatgagttaagaaaaaacaacttctcagatacttgaaactttgtgttttgggatccacggaacacatcgatctgggtattcaaatattgacccaggcatttgtatctacgggct

SEQ ID NO: 1284 - DNA, 197 bp, Homo sapiens
ctcgtgccaattcggcacgagttgctgttcgtgatattagacagacagttgcggtgggtgtcatcaaagcagttgacaattcagtgggggaagaaccggtctcagaactgtttgtttcaattggccatttaagtttagtagtaaaagacttggtaatgataacaatgcattcgtaaaaccttcagagaggaaggaga

SEQ ID NO: 1285 - DNA, 222 bp, Homo sapiens
gtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactcccaaaaggagacattgggagaagaaccaagcttgggtctatataggaattgcgacatgagattggcacacatattta

SEQ ID NO: 1286 - DNA, 215 bp, Homo sapiens
caaacccacttccaccctactaccagacaaccttagccaaaccatttacccaaataaagtataggcgatagaaattgaaacctggcgcaatagatatagtaccgcaaggaaagatgaaaaattataaccaagcataatatagcaaggactaacccctatacctctgcataattgaattaactagagataactttgcaaggagagccaaagctaag

SEQ ID NO: 1287 - DNA, 192 bp, Homo sapiens
cagacccgcgtgtggcgcaggcaaggaccctcaaaataaacagcctctaccttgcgagccgtcttccccaggcctgcgtccgagtcttcgcgttgcgggcccgttccgacgcggaagatcttgacttcagccatgagcagcaattagttcttaagttttgacgattttgcactggcccggaatttgcatctg

SEQ ID NO: 1288 - DNA, 123 bp, Homo sapiens
gccctctggaggtgaggagaagccacccaggggagctcccccccacccccagcacacccagtgtcttccttatctctttcctgccagtgtcactagatggacactggattcactagatgatct

SEQ ID NO: 1289 - DNA, 569 bp, Homo sapiens
gccctctggaggtgaggagaagccacccaggggagctcccccccacccccagcacacccagtgtcttccttatctctttcctgccagtgtcactagatggacactggattcactagatgatctctgtgatcacttctagttttaagattctatgatcctgttaatgataataagaacttctagagcccttaccatgtgtcagactcaatgccatgtgtcttagtctgtttggactgctattttacagagtaccataaattgagtgtctcataaaaaacagaaaggtgttgcttacatttctggaggctgagaagtccacggtgccagcacgttcagcatctggtgagggtctgcttcccggttcatagacagcatcttactgcatcatcatgccatagaaggggcaagagaaccctctgaagtcttttttataaggtcactaatcccattcacgaaggcttcaagttcatgacctaattatctcccaaagtcctcagctccagataccatcacactgcagattagatttcaacatatacattttgggagggcacacacattttagtctc

SEQ ID NO: 1290 - DNA, 145 bp, Homo sapiens
ggaaaatggtgccaaatagacttgcctgatgccaggctgctacaaaccttcaatttaaaaaaaaaacacagtattcacaaggcatagtaggatgaggtatgcctgtattgctctttcctgaaggtgggtgtgatattaaccatct

SEQ ID NO: 1291 - DNA, 187 bp, Homo sapiens
  misc_feature 1: n = A,T,C or G
ncgcactagtgatcaagattcggcacgaggtttaagaaaatcagtttttgttcttaaaaatgcatttaagttgtaacgtctttttaagcctttgaagkscctctgattctatgtaacttgttgcagactggtgttaatgrgtatatgtaacagtttaaaaaaaaggttggtatttttaaaggccaag

SEQ ID NO: 1292 - DNA, 170 bp, Homo sapiens
agacaactcacattgttcaactcccttctcggggtgggacagacgagacaacagcacacaggcagccagccgtggccagaggttcgaggggctcaagggctcaagcaccgttcccacaagaaggcccccttggttggccttggccttctttctacgcaatgttattccaa

SEQ ID NO: 1293 - DNA, 183 bp, Homo sapiens
gtggcctgcacctataatcccagctacttggaaggctgagacgggaggatcatttgaacctgggaggcagaggttgcagttagctgagatcacataactttacttctgtatcagtgtactgctgctcttgcaagaccctgtctcaaaaaaggaaggtaaattaaaaattcaagtatatattac

SEQ ID NO: 1294 - DNA, 177 bp, Homo sapiens
caccccatcatccccccacatcaggccttggccacggtctcaggtcaatggggaccgagataacttgatagggacacccccaacccagagcccaacccggggacaattgggagactcacaaggagtaggttccggaccccgtaaagctctgttggtcccacggctggaaatgcatgg

SEQ ID NO: 1295 - DNA, 187 bp, Homo sapiens
caacaactcaccgttgcgcatgtaggctgccggtggctttctataatcaaatcaatattgttctggggcatcacaaagaggaagggggtcccccggggttatgcaatgtggctgctttgactgtactggacataaaaataaggaaaatgttcttcattttacttaaaatgtgtcttttaaataaaat

SEQ ID NO: 1296 - DNA, 195 bp, Homo sapiens
ctcatgcctgtaatcccaacactttggggaggctgaggtgggtggatcacctgaggtcaggagtttgagaccagcctggccaacatggtgaaacctcatctctactaaaaatacaaaaatgtgttgggtttgggtggtgcatgcctgtaatcctagctactagggaggctgaggtaagagaattcgcttgaacct

SEQ ID NO: 1297 - DNA, 164 bp, Homo sapiens
gcctttgtaaccttctctaaacgtcaggcctggacttaaaagattttttaaaacctccataagtagtccaggggcggtggctcacggctgtaattccagcactttgggaggccgaggcaggcggatcacaaggtcaacgagatcgagaccatcctggccaacat

SEQ ID NO: 1298 - DNA, 168 bp, Homo sapiens
aggagcccaccaccacatccggctacctttgtgtattttttagtagagacgggggttttgccaagttggaggggcttggtcttgaactcttgacctcagatgatccacccggctaggctcccaaaggtctgggatttacaggcattaagcaccgtcccgaccttttct

SEQ ID NO: 1299 - DNA, 263 bp, Homo sapiens
gccgggtggtgctggccctggagggaggccatgacttgaccgccatctgtgatgcctctgaggcttgtgtctcggctctgctcagtgtagagctgcagcccttggatgaggcagtcttgcagcaaaagcccaacatcaacgcagtgcccacgctagagaaagtcatcgagatccagagcaaacactggagctgtgtgcagagttcgccgtggtctgggccggtccctgcgagaggcccaggcaggtggaccgaggaggccgag

SEQ ID NO: 1300 - DNA, 253 bp, Homo sapiens
cacagggctgaggccagcccctagcagctggatgtggcagaggcaggccagaggacctaagttttatggaccagagtcacttctcctcctcctttctccagccagccctgacccctcatgctctctggctgggccagtgggcagccctcgcttcccttggatggagctgccctgctggtgcctggtcagagaagaggcctctgtgcccagcctgattctctgctcccaggagccagtacatgaggtcagaggc

SEQ ID NO: 1301 - DNA, 204 bp, Homo sapiens
ctgtttctcaggcacttgaggctttcagtgatatctttctcattaccagtgactaattttgccacagggtactaaaagaaactatgatgtggagaaaggactaacatctcctccaataaaccccaaatgggttaatccaactgtcagatctggatcggtatctactgactatattttccctattactgcttgcagtaattcaac

SEQ ID NO: 1302 - DNA, 226 bp, Homo sapiens
atcgccatcatgaacgacaccgtaactatccgcactagaagttcatgaccaaccgactacttcagaggaaacaaatggtcattgatgtccttcaccccgggaaggcgacagttccttaggcagaaattcggggaaaagctagccaaaatgtacaaggccacaaccggatgtcatctttgtatttgggttcagacctattttggggggggcgagggaacctggcttg

SEQ ID NO: 1303 - DNA, 201 bp, Homo sapiens
ggatcacattttataatgaagattaccagtgtagtaattctgatattgcaaatgattgagggacaaacaaaggaacttaatagaggaaggtaggtcttagagggaattcccattaattgtaggatttttttggctttgaaatatactctctctatatgagagagattccatttaaaaaaaaaaacacacccttttgtctct

SEQ ID NO: 1304 - DNA, 248 bp, Homo sapiens
ctctccaagaggctgaagaaagtgtggaagccacagctgtttgagcgagagttctacagtgagatcttggacaagaagttcacagtgactgtgaccatgcggaccctggacctcatcgatgaggcttacgggctcgacttttacatcctcaaggcaagcggggtggggcgagtcagttccacacagggtctgggatgggccagtcagatcacgggagcccaaggtcagctcacaccgggcacacgctg

SEQ ID NO: 1305 - DNA, 354 bp, Homo sapiens
ccgccgcagtcttcgccaccatgccgccctacaccgtggtctattttccagttcgagggccgctgcgggcccttgcgcatgctgctggcagatcaagggccaagagcctggaagggaggaggtggtaaccgtggagaccgtggacaggaggcttacatctcaaagcctcctgcctatacgggacagctccccaagttccagggacggagacctcaccctgtaccagtccaataccatcctgcgtcacctggcccgcaccttgggtctctatgggaaggaccagcaggaggcagccctggtggacatggtgaatgacggcgtggagcacctccgctgcaaatacgtctcctcatc

SEQ ID NO: 1306 - DNA, 155 bp, Homo sapiens
gtgacatcgcatataaacactgcgtggcaactccttcgacgcacctgccgtgactgcccaggtcaagacaggtcgaccctaggaagtccaactaccttcccttcaaggtcaatccaacctatttggaatgagtatcccaagatgaccaatctggc

SEQ ID NO: 1307 - DNA, 140 bp, Homo sapiens
ctgaggcctccctggaggaaggagggttaggggtacctatcctcaaggtattggaagagcagaatttgagggagagacctttcttccttgttgagggtaaaaattaaataagattccatgtccaaaaaaaaaaaaaaaaa

SEQ ID NO: 1308 - DNA, 200 bp, Homo sapiens
aattggaatgagtccactttaaatcctttaacgaggatccattggagggccaaggtctggtgccagcagccgcggtaatttccagctccaattaggcgtatattaaaggttgctgccagttcaaaaagcttcgtggttgggatcttggggacgcggccggccgtcccgccgcgaggagcccaaaccgcccgtccccgccc

SEQ ID NO: 1309 - DNA, 326 bp, Homo sapiens
ccgcagtgaagtggacatgttgaaaattaggtctgaattcaagagaaagtacggcaagtccctgtactattatatccagcaagacactaagggcgactaccaaaaagcgctgctgtacctgtgttggtgaggtgacctaaggcccgcaaggccttaggcttccagaattggtctcacaccatggcttccacgctaacaggtctagaaacccagctcgcgatatacacagtcccgtgtggccatccctgtgaggcacgcgtgagcatcacccccaccctcattttgagtcgcctaagcatcgcttcgcctccctgtctagtctctct

SEQ ID NO: 1310 - DNA, 240 bp, Homo sapiens
tggcagtggagtgattgcatgaatttttctgtaacacattaactttggtattattattaagggagcttgagaaagctttgcttataattgtcaaggcaaggagggtaaaaacttgggagcccaaggaaattcccttggggccaggatttatttatatataggaaaatttgaatttccctgaggccagttggtctcccaccccttttccagtatgttgagtcctgcaaatagcatctctct

SEQ ID NO: 1311 - DNA, 253 bp, Homo sapiens
ttttgagtctgacattctaataaaataatttgtagaaaccatttgtctttgtagtgattccaaattaaaaggtttctttcttccacctgagggcacggcccaaaaggtcttggtaattttttaggcaaggacggtccttttaattagagatatgtctgggagaccagacctctctcatagagggtgtccttgtcccctgagagccctcgtgagtcaccccaagaggagggacacatgcgacttctggcctgcc

SEQ ID NO: 1312 - DNA, 190 bp, Homo sapiens
ctctatattgctggtaattgccatgccctgagcactgagtatgtcatgccaccctgtccctcccctgggcacccctcactttccctgatcctgcaattaaagggttaatgtgtggcatatggaagggactccaggaccctgtgcccagcttccatgctgactgatggttaaataatgtgattgtctcctc

SEQ ID NO: 1313 - DNA, 130 bp, Homo sapiens
agctaattcagagactgcttcaatcagcagatgaagaagccattgctgactttgatgaacaccttaaatcagcaaaataaatactaacttattattattaatgattatataaatgaaatggacctatatc

SEQ ID NO: 1314 - DNA, 187 bp, Homo sapiens
aagcgcccttaattgagtatgaagctattggaggtccttcaggagagaatgaccttatctgttttatgttttaaaatactcactctgacctagtattagggttctccccaaaacagaaacaatgggagctgtttaggtaggtaaggagagagatttattgtggaattggctcacaggataatagagc

SEQ ID NO: 1315 - DNA, 230 bp, Homo sapiens
aaaatttaacacccatagtaggcctaaaagcagccaccaattaagaagcgttcagctcaacacccactacctaaaaaatcccaaacatataactgaactcctcacaccaattggaccaatctatcaccctttagaggacctattgtaggattaagtacaatgaaacaattctcctccgacatagcctcggtgagtttaaacactctactctgcacattacacagccctat

SEQ ID NO: 1316 - DNA, 221 bp, Homo sapiens
ttccgacggcatctacggctcaacattttttgtagccacaggcttcacggacttcacgtcattattggctcaactttcctcactatctgcttcatccgccaacctattatttcactttaccatccaacatcactttggctcggaggccgccgcctgtaactggcattttgaggatatggtgtagtctatatctatatgtctacatctatgaatgagggtct

SEQ ID NO: 1317 - DNA, 238 bp, Homo sapiens
ggaagaggaagaggacagtgatgaggaagaagttgagctgtgcccatccttctgccaaaaaggcagggggggcaggccctagccctcctaggtcagctccatgtgccatgaaccgccatgcaccctgttccctgaaggtttcaccattggtatatatttctccttgagggggagagttgggtggggtttgggtgggaggctctgggtcttgggctataggagagctctctctcacaca

SEQ ID NO: 1318 - DNA, 213 bp, Homo sapiens
ccactgtcccggaggaaagctgtagacatgcggctgcggatggagttggtgctccagaagagatggggcaggtgccccacttgactctcgcccagctccccggccctctacttcaccacgatgccagcctggtcaaaaatctccagaccctctggagcagtagcagctcaaagtcaagcctggcccactctatgtgggcatacatgtgtacac

SEQ ID NO: 1319 - DNA, 229 bp, Homo sapiens
gttggtgcatgtgctttggactagcatttatgcttgcaggtgtattctaggaggagcatacttgtacaaatattttgcacttcaaccagatgacgtgtactactgtggaataaagtacatcaaagatgagtgtcatctaaaatgagccctcgcagttgccccagctgctctctaccagacattgcgggagaatataaactctttagagaggagaggtgatatttatcgt

SEQ ID NO: 1320 - DNA, 206 bp, Homo sapiens
ggggatcaagggacggctgacaagacttcccgcttgctggtgtgggtgacatggtgatggccacagtcaagaaaggcaaaccagagctcagaaaaaaggtacatccagcagtggtcattcgacaacgaaagtcataccctagaaaagatggcgtgtttctttattttgaagataatgcaagggtacatggtgaaccataaagggcg

SEQ ID NO: 1321 - DNA, 190 bp, Homo sapiens
agaaaacaaaatcagataaagataagagatttatatataaatttatgataatgaacaattctccccccattaataaagggaaatcattccttttgtaaataaatttgggatggacaaaatattaaggaaaaaatcccgaaaatgtgccccccaaaaacaattgggggggtgttgcctctctaaaacgggg

SEQ ID NO: 1322 - DNA, 239 bp, Homo sapiens
agggtgtggggctggcctcgctcgtggcacctctgctgatctcacaggccatgggactggccctctatgtcctgccagtggctggggccaacacgttgccacccagcactttccagtggcagaggctgaggcttggtgctgacacttgctggcgatttatgcagctgggcctcgccctgccccacaatacccaccgggtggtaagcacacaggccccagacaggggctggatggcactc

SEQ ID NO: 1323 - DNA, 350 bp, Homo sapiens
cttccatgtatcctcaatgcccggggattaaccagcgttatcaaccagaagctaaaggatgatgaggttgctcagctcaagaaaagtgcagataccctgtgggacatccagaaggacctaaaagacctgtgactagtgagctctaggctgtagaaatttaaaaactacaatgtgattaactcgaggcctttaggtttcatacattgtacatagatcacagtttgctttgatcttcttcaatatgtgagtttggggtcacagagtcaaagtgtatgctttgtgtaatgctcgcactctgagctctcgagcacatatattcatctctcgtagtgtgggaaaaaaaaaaaaaa

SEQ ID NO: 1324 - DNA, 250 bp, Homo sapiens
cccggccacctgcggtgctatctccccagccccgatcctctgtacagagcccacgcccccacttggtgacatgtcttttcttgcatgaggctagtgtggtgtttcctggcactgcttccagtgaggctctgcccttgggtaggcattgtgggaaaggggagataagggtatctggttgactttcctctttgggtctaacctgtgtctgaagtctgaaggcttgggtctgaatcccaggtccccctaaagg

SEQ ID NO: 1325 - DNA, 202 bp, Homo sapiens
caagaagtatgatgcgtttttggcctcagagtctctgatcaagcagattccacgaatcctcggcccaggtttaaataaggcaggaaagttcccttccctgctcacacacaaccggaaacatggtggccaaagttgatgaggtgaagtccacaatcaagttccaaatgtgaggaggtgtttatgtctttgctgtagctttttg

SEQ ID NO: 1326 - DNA, 263 bp, Homo sapiens
attctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcatatgcatacatgggtcagagcccatggggaatgtaaaagaaggccctcacagcttataggggtcacatagaaggtgatttcacaggtct

SEQ ID NO: 1327 - DNA, 278 bp, Homo sapiens
aggtggcatgcaaggaaagctaacaaattcagaaactcgattctgtgggagcaggattctttggtactaatcacgatagtgggtccagctttggagttaaccatttgatttgtgatggtttttcttttctcctccccaccccaggatgaagtgtcctctcgctagcaccaataaaagatttctaattaacacaattaaaaacacaattgccctctcatatagagcaagaccatgaacaaaaagagggcgataaggaccagcgcagagccaggcccaca

SEQ ID NO: 1328 - DNA, 207 bp, Homo sapiens
caaagacctgtacgccaacacagtgctgtctggcggcaccaccatgtaccctggcattgccgacaggatgcagaaggagatcactgccctggcacccagcacaatgaagatcaagatcattgctcctcctgagcgcaagtacttcgtgtggatcggcggcttcacttcttggcttgcttttcacccttcagcagattttgggtagca

SEQ ID NO: 1329 - DNA, 359 bp, Homo sapiens
ttgcagccatctccttctcggcatcatggccgcctcagacccttgtgaagcccaagatcgtcaaaaagagaaccaagaagttcatccggcaccagtcagaccgatatgtcaaaattaagcgtaactggcggaaacccagaggcattgacacagggttcgtagagattcaagggcccagatctggatgccaacattggttatggagcacacaaaccacgcacatgctgccagtgcttccggagttctggtcacacgtcaggagctggagtgctgctgatgtgcacaaatcttactgtgccgagattgctcaaatgtttctcaagaaccgcaagccatcgtggaagagctgccaactggcg

SEQ ID NO: 1330 - DNA, 332 bp, Homo sapiens
cttggtttgaggggacctaaaggtgacttgggagaaaagggggagcgtggccctccaggaagaggtcccaacggtttgcctggagctataggtctcccaggtgacccaggccctgccagctatggcagaaatggccgagacggtaagcgaggccccccaggggtggcaggaattcctggagtgcctggacccccgggacctcctgggccttcccggtttctgtaagcagcctcctgcaccatgcagcctggtcagcgagcattcaacagagggcctcaccttagaaaggcttactgctgcatggctgtctgcatgaaccacgcctggtgagg

SEQ ID NO: 1331 - DNA, 309 bp, Homo sapiens
agccaccgtgcccaacctcacttgcttcttatccttacactcccagccccagagaaactgccacatacaccacaaaaaccaaacatcccccaatgaccttagccccattgctccattcactcccaggtgagatttcaggcaaacgtccacaaggttcacaggcagcgtacatacggtttctgttataccccatatataacccctccatgtcctaagagaggacattttctctgagagattgtcatttgagtgtatctctaaaaaaaactctcgtgtcactcgcctccatctctttctgggtgaggacac

SEQ ID NO: 1332 - DNA, 381 bp, Homo sapiens
  misc_feature 349: n = A,T,C or G
tctgagctttcctgtctttcctttttttctgagagattcaaagcctccacgactcttgtttccccccgttcccttctgaattttaaatttgcactaggttcattggcaactggtttggagttgtggagagcggccttaagctctcggtcgcgagtttccgtagagtttgagccacctcggacaggtgcctcgcgcagggcccggcccgccctcacatctggcccggggtgactggggcgccgtctgtgtgcccgaggtctcaccgttctctcgcctagtctggacgctccgaccgacatcgcggagcagccttacaggcattccattacgcccatctcgctctgtgccncctcccaccaggtctacagcaggagccctgga

SEQ ID NO: 1333 - DNA, 324 bp, Homo sapiens
cagaaggctaaatgaatattatccctaatacctgccacccactcttaatcagtgggtgggaggaccggtctcagacctttttgtttcaatgggccatttaagtttagtagtaaaggactggttattgataccattgcatcgtaaaccctccagagggaaagggagattgttttgtggcccactttggtttctctttttccgcgtgtggcagtttataagatatgagtttataaactcagtactctaaatggacacatctagaccaaatatttgtcacagattctgagacctattaaaagtgttaattgagaaaaaaaaaaaaaa

SEQ ID NO: 1334 - DNA, 137 bp, Homo sapiens
gctgccgatgtggtgcttagtgattgcggtttcggtcgctctcccgtgtttcccgggctgggtatttgcctcgcaccatggcgcccaagggcaaagtgggcacgagagggaagaagcagatatttgaagagaacaga

SEQ ID NO: 1335 - DNA, 222 bp, Homo sapiens
gctgccgatgtggtgcttagtgattgcggtttcggtcgctctccgtgtttcccgggcctgggtatttgcctcgcaccatggcgcccaagggcaaagtgggcacgagagggaagaggcagatatttgaggagaccagagagactctaaggttctacctccggatcatactgggggccattgccatttactgccttgtgacgtgggtctactttcactcatcts

SEQ ID NO: 1336 - DNA, 210 bp, Homo sapiens
cggcacgagatggcggaggtgcaggtcctggtgcttgatggtcgaggcatctctcggccgcctggcgcaattcgtggctaacaaggtactgctgggccggaaggtggtggtcgtacgttgtgaaggcatcaccatttctggcaatttctccagaaccaagttgaagtacctggctttcctccacaagcggatgaccaccaacccttcccg

SEQ ID NO: 1337 - DNA, 387 bp, Homo sapiens
cggcacgagatggcggaggtgcaggtcctggtgcttgatggtcgaggccatctcctggggccgcctggcgccaattcgttggctaaacaggtactgctgggccggaaggtggtggtcgtacgctgtgaaggcatcaccatttctggcattttctacagagacagttgaggtacctggcttcctccgcaagcggatgcacaccaacccttcccagaggcccttaccacttccgggcccaaagccgtatcttctggcgcaccgtgcgatgtatgctgccccacaacaaccaggcgaggccaggccgctctggaccgtctcaggtgtttcgacgccatcccaccgccctacgacagaaaaagcggatggtggctcctcctgccctcaagg

SEQ ID NO: 1338 - DNA, 210 bp, Homo sapiens
aaccctgggaaggctcctggttgtctacccatggacccagaggttcttgacagctttgcaacctgtcctctgcctctgccatcatgggcaaccccaaagtcaaggcacatggcaagaaggtgtctgacttccttgggagatgccataaagcacctggatgatctcaagggcacctttgcccagctgagtgaactgtactctgaaaagctc

SEQ ID NO: 1339 - DNA, 377 bp, Homo sapiens
  misc_feature 305: n = A,T,C or G
accctgggaaggctcctggttgtctacccatggacccagaggttctttgacagcttttggcaacctgtcctctgcctctgccatcatgggcaaccccaaaggtcaaggcacatggcaggagggtcctgacttccttgggagatgccataaggcactggatgatctcaggggcacctttgcccagctgagtgacctgcactgtggacaggctgcatgtggatcctggagaactacacgctcctggatatgtcctggtgaccgtttgggcaatccatttcggcagagatacaccctgaggtgcaggncttcctggcagagatggtgactgagtcgccagtccctctctcagatacactaagctcactgcccatgatgca

SEQ ID NO: 1340 - DNA, 150 bp, Homo sapiens
ggatactcatatggtcctggtgctctttgagactgaatgtagagagtgatggattatggtgttaatgacttatcttctgctattacttggctgtgctgggcatgcattttctgcgatagctgaaaaaaaaagccaggggttaaggggaag

SEQ ID NO: 1341 - DNA, 516 bp, Homo sapiens
aggatactcatatggtcctggtgctctttgagactgaatgtagagagtgatggattatggtgttaatgacttatcttctgctattacttggctgtgctgggcatgcattttctgcgatagctgaaaaaaaaaagccaggggttaaggggaagtggaataaagctgatttcaactcaaacatcatcagaacaataaaagcttgacccactttgtgcaacacataggccttctctaaaaacaaactcagctttctcccactcctaggaccaccaccaaactcctgtgttgaaaacaccaattacttcttgacagttccattgctcctgaagttgttacaccaaaagaacctttctatcataggcttattcctgcctaagagccaggcatcatgttaaaacctaattcttattggctcagctactttttcttacatgggaagtcaaagtttggtaatatgtataaaagtatttctctgttcacatgataataatcagcacacatttacattggattatt

SEQ ID NO: 1342 - DNA, 291 bp, Homo sapiens
aggatactcatatggtcctggtgctctttgagactgatgtagagagtgatggattattggtgttaattgaccttatcttccttcctattaaccttgggcttgtccttgggccatgcattttcctccggatacgtgaaaaaaaaaaaaggccagggggtttaaggggggagggtggaattaagggctaatttacaccctcacacatcattcagaccatttaaagggcttgccccacttgtgtacaacacataggcccttctctaaacacactctaatgctctctcctactcc

SEQ ID NO: 1343 - DNA, 230 bp, Homo sapiens
ctcgtgccggtcatttcaaagaagagatcttggaaggtaaaggataacacaagcagttttagggtaatgaatgtgaagaaatcactaggctaaggaaagaggttatattcaggatccccgaaaccttcactctccccttcctctgtgactttctgtgaaggcaaagttgaaggtccaccttaggattagggggaccaatattctcaggctaggggcactttttttaacct

SEQ ID NO: 1344 - DNA, 349 bp, Homo sapiens
ctcgtgccggtcatttcaaagaagagatcttggaaggtaaaggataacaaaagcagttttagggtaatgaatgtgaagaaatcactaggctaaggaaagaggttatattcaggatcccccgaaaccttcactctccccttcctctgtgactttctgtgaaggcaaagttgaagtccaccttaggattagagggaaccaataattctcaggctaggggcactttttttaactccgaagaatttaatatgtcattaataggatgaaatttttgtgccaatggcaaagtagcccctggtggccaacaactctccccccacaccaccacatccataaaaaaaaaaaaaaaaaa

SEQ ID NO: 1345 - DNA, 185 bp, Homo sapiens
cagattgtattctatgagtcccagaagatgaaaaaaattttatacgttgataaacttataaatttcattgattaatctcctggaagattggtttaaaaagaaaagtgtaatgcaagaatttaaagaaatatttttaaagccacaattattttaatattggatatcaactgcttgtaaaggtgctc

SEQ ID NO: 1346 - DNA, 162 bp, Homo sapiens
cagattgtattctatgagtcccagaagatgaaaaaaattttatacgttgataaaacttataaatttcattgattaatctcctgggaagattgggtttaaaaagaaaagtgttaattgcaagactttaaaggaatttatttttaaaggcacaattattttaat

SEQ ID NO: 1347 - DNA, 270 bp, Homo sapiens
ccctcatctggtgactcatgatgcccgcaccatccgctaccccgatccctcatcaaggtgaatgataccattcagattgatttggagactggcaagattactgatttcatcaagttcgacactggtaacctgtgtatggtgactggaggtgctaacctaggaagaattggtgtgatcaccaacagagagaggcaccctggatcttttgacggtgttcacggtaaagatgccaattggcacagctttgccactggactttccaacattttt

SEQ ID NO: 1348 - DNA, 180 bp, Homo sapiens
ccctcatctggtgactcatgatgcccgcaccatccgctaccccgatcccctcatcaaggtgaatgataccattcagattgatttggagactggcaagattactgatttcatcaagttcgacactggtaaccttgtttatggtgacctggaggtccttacctaggaaggatttgggtttat

SEQ ID NO: 1349 - DNA, 230 bp, Homo sapiens
actttttgtttttccttcctttttgtgaaatgtattaagttgtggttcttattgaaacagtattatataatgtttgcttaattatatcatgtgatgctcagttctattttgatttattcattagtattcacttttacctttaaagtttacttgtagcaaatatgtttacattataaagccgatatgttttgacaatgaaatttacatatcaggtactgcaaataaaggtg

SEQ ID NO: 1350 - DNA, 162 bp, Homo sapiens
tactttttgtttttccttcctttttgtgaaatgtattaagttgtggttcttattgaaacagtattatataatgttctgcttaattatatcatgtgatgctcagttctattttgatttattcattaggattcacttttacctttaaaggttacttgtaagcaa

SEQ ID NO: 1351 - DNA, 255 bp, Homo sapiens
cttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacaggaaattccaaaacttgtactattttttttcccatgtgaaggcaggaattctcctaggcttcctggacagca

SEQ ID NO: 1352 - DNA, 142 bp, Homo sapiens
cttgccttaaatctttctcaaccaaataagtattttattagtgcttgagagaatctgaatgtaggatgggttcaactgcacaaaaggaaaagatttttaccactttttttatataggatataaagtgaggcaaccgccttag

SEQ ID NO: 1353 - DNA, 190 bp, Homo sapiens
aagggccctgaggccaaatatcactcccaggattccattgttaagcccaattccaccattaaattccacttggatcacagatgctgcacatacacaaccatggccaagcctcttcaattttcattgtttattgaacatgcaggacagcagacatcattaaaaaggcgttctcagtcatgcccagttttcc

SEQ ID NO: 1354 - DNA, 177 bp, Homo sapiens
aagggccctgaggccaaatatcactcccaggattccattgttaagccccaattccaccattaaatttccacttggatcacagatgctgcacatacacacccatggccaagcctctcaattttaatggttattggaccatgcaggaccagcaggcaatcactaaaaagggcgttttca

SEQ ID NO: 1355 - DNA, 180 bp, Homo sapiens
ctgacggccgcgccatcttcagaatggaggatgagcagctgaaggtgtgggatgtgattggccgcagcctgattattgatgagggagaagatgaccttggcccggggaggccatcccttatccaagatcaccagggaactccggggagaaggttggccttttgccataattcaccgttcc

SEQ ID NO: 1356 - DNA, 265 bp, Homo sapiens
aatgcattctctgaaacactttccatcctagacattccagcctgggggcaaagataccctcttttagttggatttggttctgccaagttgaatgggggcccaaggcctaaccgaacagttgaggggcgagatgtggcaagagtggaaagcagaacacttaaaagtatgtttggtagacactgggctggacttggcttccacctgagattaaagttgacaattgggaggatgttttatacaatgtatgggttaagggcacaaatcc

SEQ ID NO: 1357 - DNA, 584 bp, Homo sapiens
gccaatgcattctctgaaacactttccatcctagacattccagcctgggggcaaagataccctcttttagttggattttggttctgccaagttgatggggcccaagggccctacgacagttgagggcgagatgtggcaagagtggaaaagcagaacactgaaaagtatgtttggtagacactgggctggacttggcttccactgagattaaagttgacaaatggggaggatgtattatacaatgtatgggttaagagcacaaatcctgcagctgaactgagtttgcaaatcttggcttaggtaaacatgagcaaaatatttgaacctcaattattttatcagtaaaatgtagataactatagtttctacctttgggattttgtggggattaaacgtgataatcaaggtaaagtgactctggctactaggtggagaatggattgcaggtaggcaagagtgggagtggagagatcagcatgtggcagttgtctggaaaggaaaccacagtggctgagactttagtggtggtaaggagagacgtcaagaaagcgggtaaccagagtcaggccatgtcatcacactgg

SEQ ID NO: 1358 - DNA, 202 bp, Homo sapiens
aacactttccatcctagacattccagcctgggggcaaagataccctcttttagttggattttggttctgccaagttgatggggcccaagggccttacgacaattgagggcgagatgttggcaagagttggaaaagcagaacactgaaaagtatgtttggtagacactggcctggacttggctttccactagagattaaaggt

SEQ ID NO: 1359 - DNA, 155 bp, Homo sapiens
cagcgtggcgagcaggcttgccgccgagtgcatcctgagcaagcggcatcgaaggcaagctgagtaccttggtcaagtggcgcggcttgtcctccaaggagggtgttttgcattcccggaaggccttctcttgcacaactgcttccgcggccccg

SEQ ID NO: 1360 - DNA, 187 bp, Homo sapiens
agcagcgtgggcgagcaggtcttcgccgccgagtgcatcctgagcaagcggctccgcaagggcaagctggagtacctggtcaagtggcgcggctggtccttcaaggagggtgtttggcattcccggaagggcctctctgcacagcttgcttccgcggccccgttcctccgtttccccggaccccgtt

SEQ ID NO: 1361 - DNA, 273 bp, Homo sapiens
ggcacgaggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggcccgccgattcgggaactgactgctgtagttcagaagaggtttgctttccagagggcagtgtagagctttat

SEQ ID NO: 1362 - DNA, 156 bp, Homo sapiens
cggcacgaggcaagatggcagtgcaaatatccaagaagaggaagtttgtcgctgatggcatcttcaaagctgaactgaatgagtttcttactcgggagcttgctgaagatggctactctggagttgaggttcgagttacaaccacccaggacaaga

SEQ ID NO: 1363 - DNA, 353 bp, Homo sapiens
atttttcttaactggagtgtgtgctgcctttcaggtacaatttttgtgtaataaaagccagtgcattaagtttatatagactactttctatgcaagactgagatatggaatagataggaagagatatgtactgctgggtacatggacagtaagtgtgttttcagatggagtaccagcaccgaaaatgggttgagggaggatggttgtatgtatgtttctgccactaattttgagcagccatattatgaattaaatcgtcacagccaggtaataccccaggatggtatgagtttcatgtgtaatagctcaaatggaataggcatgaatgctggagtggaccatatctcaaatat

SEQ ID NO: 1364 - DNA, 115 bp, Homo sapiens
gaactctctgtgctagtaaccacgttgctcctcattcaatatcactctccgccttacaggagtcaacatactagttacagcccctatactccctctacatatttaccacaccaca

SEQ ID NO: 1365 - DNA, 203 bp, Homo sapiens
gaactctctgtgctagtaaccacgttctcctgatcaaatatcactctcctacttacaggactcaacatactagtcacagccctatactccctctacatatttaccacaacacaatggggctcactcacccaccacattaacaccataaaaccctcattcacacgagaaaacacctcatgttcatacacctattccccatctct

SEQ ID NO: 1366 - DNA, 155 bp, Homo sapiens
gagggagagagagactgataagtggatgcatggatgacggaccatgagccagtgcctcagttgacccagaagcctagtcaggtcggctgggcccaaggttggggggagcaaaactaggtcatctcacacccctgtactcctctgaaggccctatc

SEQ ID NO: 1367 - DNA, 300 bp, Homo sapiens
gagggagagagagactgataagtggatgcatggatgacggaccatgagccagtgactcagttgaaccagaagcctagtcaggtcggctgggaccagggttgggggagcaaaactaggtcatcttacagcccctgtacttctcttgagggtcctttctctttccaccattctcccttttctgtcccagggaccgggatgtagagaagtgtcccatctccaccaggcctggcagcaggaacaaagggtgactttttccctggcctatgatggagctcttcagcggcaccacgggcaggatca

SEQ ID NO: 1368 - DNA, 225 bp, Homo sapiens
cggcacgagaaatccaaggttgaaaagaaaaagaaggagaaggttctcgcaactgttacaaaaccagttggtggtgacaagaacggcggtacccgggtggttaaacttcgcaaaatgtctagatattatcctactgaagatgtgtctcgaaagctgttgagccacggcaaaaaaccctctcagtcagcacgctgagaaaactgcgagccaacatttacccccggg

SEQ ID NO: 1369 - DNA, 199 bp, Homo sapiens
cggcacgagaaatccaaggttgaaaagaaaaagaaggagaaggttctcgcaactgttacaaaaccagttggtggtgacaagaccgccggtacccgggtggttaaattcggaaattgcctaggatattatcctcctgaggatgtgcctggaaagctgtgtgagcaacgcaaaaaaccctcaagtaagacgcgtgagaaac

SEQ ID NO: 1370 - DNA, 266 bp, Homo sapiens
ggagacccagtttcttaaaacaaacaaacaaactcaaaataagagcaaatgtttatatagtatcatgtaccaggtacaggtactgctctgaatgctttacatatattaactcactttaaattattttaatagggttttaatatataactatagagggaagggcataagtcagacacaaaagcctaactcataaattctttctcatctgtaaagggggtagctaatattatcccttctaaaactgtcaggaactttctggttaggct

SEQ ID NO: 1371 - DNA, 148 bp, Homo sapiens
cttgagtggcatgtttattctaactgaatgaagaatgactattgaattaggtatattccccatgccaaataattttaactgtgatgtaatcctagccgctttcttatttttactccgaataaatttaaaatatttaggattggccagg

SEQ ID NO: 1372 - DNA, 269 bp, Homo sapiens
gaaaaagctgcctgccaaaaatcagtgaagtcttaaaactaaatagttttttaaattagaaaaatattaacatgaattgttgaagagatttgagtccaatgggggatcaagtgtatgtgaaattgcattttttaaagttgttcttttccagtagaccataacaaaaacttacatgaaaccacaagagagggtgtctccctgccttccccaaatttgggctcattttttaacaaagcagataaaacagttgaactaaattagatgttgaa

SEQ ID NO: 1373 - DNA, 566 bp, Homo sapiens
gaaaaagctgcctgccaaaaatcagtgaagtcttaaaactaaatagttttttaaattagaaaaatattaacatgaattgttgaagagatttgagtccaatgggggatcaagtgtatgtgaaattgcattttttaaagttgttcttttccagtagaccataacaaaaaattacatgaaaccacaagagagggtgtctccctgccttccccaaatttgggctcattttttaacaaaacagaataaaaacagttgaactaaattagaatgttgaaatggtgagagtgggtggaaagatgaaaggcacttcacttcaaacagactctaacggggaaatcaaaaactgataataagaccacccagctgacctgactcacctattcaggatccttctgaaagcctctcatcccttgtattgtacgtcctttaggctagtaataatatcattgaagtacagaaataaaatgtctcaaacgtgttacaggaacatccagaaaaatgaacagcatattttccaattaaatccttcagtacttccctttccagtttttcctccggatcaattgaca

SEQ ID NO: 1374 - DNA, 180 bp, Homo sapiens
gaaaaagctgcctgccaaaaatcagtgaagtcttaaaactaaatagtttttaaattagaaaatattaacatgaattgttgaagagatttgagtccaatgggggatcaagtgtatgtgaaattgcattttttaaaggtggttcttttccagtagccataacaaaaaattacatgaacccca

SEQ ID NO: 1375 - DNA, 161 bp, Homo sapiens
cgggctgcgcgtcgccatggagcccgacggacttacgagccgggcttcgtggggtattcgcttctgccaggaatgtaacaacatgctgtacccaaggaggacaaggagacccgcaattctgcctctacgcgtgccgaacctgtgataccacagggaggccg

SEQ ID NO: 1376 - DNA, 106 bp, Homo sapiens
ctcgattctttgaagggatgacaacaaattttgggttctactgttatgtgaggacattagggcccagcaacacggcattgttaaggaaaaataaaagtactgccgt

SEQ ID NO: 1377 - DNA, 286 bp, Homo sapiens
atgtcagtcgccgcagttgagcaaaaaacacttcttcctttgagtggctgttctggtgaaatctgtttctgacatatccacttttctctctcttttctctctctctgactgcgagccccacagggagaaggaattggatgtatcggatgttggtattagattttctttctccgttcgagtctctgactcgtgcatactttgcaaaggtgtgttcctcgcaattgcaagagttagaaaatgcaccttctctggtggccgttggggtgttgtttcacaggcagtggtg

SEQ ID NO: 1378 - DNA, 311 bp, Homo sapiens
tgtcagtcgccgcagttgagcaaaaaacacttcttcctttgagtggctgttctggtgaatctgtttctgacatatccacttttctctctcttttctctctctctgactgcgaagaccccacagggaggagggaattggatgtatcggatgttggtattagattttctttctccgcttcgagtctctgactggtgcatactttgcaaaggtgtgttccgggcaattgccaagagttagaaaatgcaccttctctcgtggccttggggtgttgtttcacaggcagtggtgacagggccccttggctgtggctg

SEQ ID NO: 1379 - DNA, 286 bp, Homo sapiens
gtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgtcttttgggtgaaaattgcaaacagccaagcaagtggctggatgccccagtctaagaattcaaaacaatcactgagt

SEQ ID NO: 1380 - DNA, 209 bp, Homo sapiens
gtacagttcagccttactctgtttttaagtagttgtgttgtcaatttcatgcttttaagtcctgatgatccttgggaggatggggagaaaaaaggataccaggggataatttaaatcccacaagccagttttcatcagtttccctcaatcccatccctgccaaaataaaaaatgtttaacaagggggcccaaacttatttcgttctggg

SEQ ID NO: 1381 - DNA, 287 bp, Homo sapiens
agaatccacactggagagaaaccttacaaatgtaatgagtgtggcaaggtcttcagtcacaagtcatccctagtaaatcactggagaattcatactggagagaaaccttacaaatgtaatgagtgtcgcaaggtcttcagtcacaagtcatccctagtaaatcactggagaatccacactggagagaaaccttacaaatgtaatgaatgtggcaaggtcttcagtcgcaattcataccttgcccacatctgataattcatgccggtgagaaccttataagtgtgatg

SEQ ID NO: 1382 - DNA, 161 bp, Homo sapiens
agaattcacactcggagagaaaccttacaaatgtaatgagtgtggcaaggtcttcagtcacaagtcatccctcaggttaaatccactgggaggaattccatacttgggaggaggaaaccccttaccaaaatgttaattgaggtgttgtggcaaagggtctt

SEQ ID NO: 1383 - DNA, 260 bp, Homo sapiens
attgtaaatctgtgttttaaatattttataacagagcactaatggaaacctaataaatacaaacaagataactattacccaagataacatggaaatacttctgtctttgaagttaacaacaccgtctgccctcaaagcacatttaggagtatcaaccaagaccagccagttgacatgtttttctgtgtggcaacctgcccttaaattgtcagatcttaactatcttgtggttgctgtcttgcagccataaggtttcctcc

SEQ ID NO: 1384 - DNA, 145 bp, Homo sapiens
attgtaaatctgtgttttaaatattttataacagagcactaatggaaacctaataaatacaaacaagataacctatttacccaagataacaatggaaataactttcttgttttttgaaggttaaacaaacaaccgtcttgcccct

SEQ ID NO: 1385 - DNA, 281 bp, Homo sapiens
cgtctcgcaggccgtagaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcactttgaaagactgacaagcttagtaaaagaagtctacccagagctagaaagaagggcactcacttc

SEQ ID NO: 1386 - DNA, 246 bp, Homo sapiens
cgtctcgcaggccgtaggaggaagatggcggtggagtcgcgcgttacccaggaggaaattaagaaggagcagagaaacctattcgaccgcgagaagacatgcccacttttttctacgggtttttcaccaccaataacggccgccaccaccctattggagcgagtttttcccggggaaaatttacccctccagcgagtttgcagatctacacatgggggggatggcaactttgaaagaactcacaag

SEQ ID NO: 1387 - DNA, 281 bp, Homo sapiens
gcaccttgcagagcaacttctgtgccagcagccttgtggtgactgcgacagtgaagtccatggttcgggagccaggggagggccttgccgtgactgtcagtcttattggtgcttataaaactggaggactggacctgccttctccacccactggtgcctccctgaaggtttacgtgccttgcaagaagtcccccccatgaagaaaggagtaagttatcttctgatgggccaagtagaagagaacagaggccccctccttcctccagagagctttgttggtt

SEQ ID NO: 1388 - DNA, 213 bp, Homo sapiens
gcaccttgcagagcaacttctgtgccagcagccttgtggtgactgcgacagtgaagtccatggttcgggagccaggggagggccttgccgtgactttcagtcttattggtgcttataaaactggagggctggaccgcccttctccacccactggtgcctccctgaaggttttacgtgccttgcaagcagtgccccccatgaaggaaggggtaa

SEQ ID NO: 1389 - DNA, 153 bp, Homo sapiens
ggaagttgaagatgattgtgggtaggaaagagtgaactggccgtgagccactctgcccggcttattttctttatgttttttgcttcgtaagaggttctttttgagcagtgattttgcaactctttgcttgacggttgcttgggggaagctttt

SEQ ID NO: 1390 - DNA, 278 bp, Homo sapiens
taagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggagtggcaattcaccgaattcgaatcaccttaacaagccgcaacgtaaaatccttggaaaaggtgtgttctgacttgataagaggcgcaaaagaaaagattctcaaagtgaaaggaccagttcgaatgcctaccaaga

SEQ ID NO: 1391 - DNA, 218 bp, Homo sapiens
taagggctgaggatttttggtccgcacgctcctgctcctgactcaccgctgttcgctctcgccgaggaacaagtcgggtcaaggaagccccgcgcggcaacaagccattgcttttaaggatacccggaaaaacaccccttggagcccggaggttggcaattcacccgaatttggaatcaccctaacaaggccgcaaacgtaaaattccttggaaaagg

SEQ ID NO: 1392 - DNA, 155 bp, Homo sapiens
ccatacggcgttgttctggattcccgtcgtaacttaaagggaaattttcacaatgtcggagcccttgatgttcctgccaaatgaaggaaggaagggaatgtccttaaggttccttgccagagagggaacccaattaaggggggcgaccaatcttt

SEQ ID NO: 1393 - DNA, 206 bp, Homo sapiens
attcaccatggcttcttctgatatccaggtgaaagaactggagaagcgtgcctcaggccaggcttttgagctgattctcagccctcggtcaaaagaatctgttccagaattccccctttcccctccaagaagaagggtctttcccctggaggaaattcaaaaggaaattagaagctgcagaaggaagacgcaagtcccatgaagct

SEQ ID NO: 1394 - DNA, 304 bp, Homo sapiens
gctaaaaggacctatttttctttcctctgctaggagccggtgaaacctgaggaaggcagagatatggcaaccaggattggcgcttttgggtacatggagttttcagcaaagaccaaagatggagttagaaaggtttttgaaatggctacgagagcttcttttcaagctagacgtgggaagaaaaaatcttgggtgccctgtcttgtgaaacccttgctgcaagacaagcccttatgcggttaattttgaaggtccgttattaatctagggtattattactggccttttcatttatccataattt

SEQ ID NO: 1395 - DNA, 327 bp, Homo sapiens
cggactccttggtagtctgttagtgggagatccttgttgccgtcccttcgcctccttcaccgccggagaccccttcaaggtctagtcatgcgttagttcatctctcatcccaaggttgccaagcttggttccagattggcaattcttcttggagctctctcttgccttggacaaggcatccagccccattggccaaattccaaggtacaaggccctttggggaggggattgattccttcaacaccctcttcaagtaaacgggtccttgcaagcattgtccccgggaagtttttatagctttggacccaaaagtaattgttgaggtcg

SEQ ID NO: 1396 - DNA, 238 bp, Homo sapiens
cgaaaagtggggggctttttgtcaacaaacccattaaccaaggtgaccctgacgagttttggatataccctttgccatggtttgctcccaaggatttggggcttgaggatacccattccatgggtaattcttcaggtttcccagagaacttaattctcttttcagggcaggcttcacattaggttggttcagacgggggcaacaggtggcaattacccattatgacttttgtaatgat

SEQ ID NO: 1397 - DNA, 316 bp, Homo sapiens
gtaaaagataacctttctttctgacatagtcaaatacgaaattagaaaagccctccctattttaactacctcaactggtcagaaacacagattgtattctatgagtcccagaggatgaaaaaaattttataccgtgataaaacctataaattcattgattaatctctggagattggttaaaagaaagtgtatgcaggatttaagaatattttaagcacattatttatatggatatcactcttgtaagctctctctttctctgtcatcgctgctcagattactaatattgggagccttaaagcgcatgatatggtct

SEQ ID NO: 1398 - DNA, 337 bp, Homo sapiens
ttggcctataccacagtgggtgtgaaaattgcaaggtaaaataaaacagatgagaccatttaaggttgaaatggaaggacagatcactggcaacagctatttactttcacaggcactaaaatagggggttttgttggtaaaactatcaatcaggggtattggtataccctgcttaaaggcccaattatgatgccattctgaactgtaaacggtttcatcacatggatatggggaacctttaaacatgacattacggtgcgactatattgtaggtcacatgggaaaacatttcagagtaagtataggagactataccatgcagtagaggcactgtatt

SEQ ID NO: 1399 - DNA, 334 bp, Homo sapiens
ggattccagttcgagtatggcggccagggctccgaccctgccgatgtggccatccagctgaccttcctgcgcctgatgtccaccgaggccttccagaacatcaacctaccactgcaagaacaagcgtggcctacatggaccagcagactggcaacctaaaggagggccctcttcctccagggttccaaccgggatcgagatccggcccgaggcaaacagccgttaaacctacagcgtaactgtgatggctcaacgatgtaacaccggagcctggccaagacagttattgatacaacaccacaaggactccgtctgcccatatggtgtgccgcgt

SEQ ID NO: 1400 - DNA, 323 bp, Homo sapiens
cgggagcgcgcttaagtaactagtccgtagttcgagggtgcgccgtgtccttttgcgttggtaccagccgcgacatgacggggtacaatccggatgagaaacttcggcttcaacaacttccaaaaacttaaaaagggcgattgcttaaggaccaagaaccttaaccctcgggagccggttcctgcccccaaaagaagatggggccctatggagaaattctggaataaatttttgggagaataaatcccttgggaggaaaatggtcccatgggttatacaaaaggagtatctttgattctcacctcaggtacttttcacactct

SEQ ID NO: 1401 - DNA, 270 bp, Homo sapiens
ccccgaccaacacttgcaggggtccctgctagttagcgccccaccgccgtgggagttcgtaccgctttcttagaccttcttcaagaggcaagcttccttggagccctttttgcaactttgcttttcaagcggtgtaatttgccaaggtcaatgttttttcccgcctaactttccaccaaggtgctaggggtcattgtaagcctcggtttcatctcccggggtggccacaagctaagtcccccggtgtgtttttttctcaaaattaataag

SEQ ID NO: 1402 - DNA, 280 bp, Homo sapiens
ctcgtgccgaattcggcacgagcttcaatgtggtgcagggaggggctgccacaggccagttttctgtgtcagcatccccgatgtggcggaaagtctcccttattttgggcccacgtataatgttaatttctcttggcgtattttcaaagacttgttccctggctgatccaaagtgcagtggtatttacaactaatttgatcacaccagtttgtagatttctctgttccttctcattccactgcttcacttgcctagtctgaggagaaagacacaaaaaaa

SEQ ID NO: 1403 - DNA, 250 bp, Homo sapiens
attctggccacattccttctcagaacatctctattctgcaagaccctctgccatgccagggcacggcccattcccagctaggagtcgtaggggctgggcacaggggaaatttttacagagctgagcctcacgactgcatcttaaggaatgcttagaaggttcccagacaccagagccagtttggccccaccaccggtcaagacctccttgaggtcacaagcacggtttcctcttagtttcacaccaggcc

SEQ ID NO: 1404 - DNA, 200 bp, Homo sapiens
gcaagaacagcattgcatacatggatgaggagactggcaactgaaaaggctgtcattctacagggctctaatgatgttgaaccttgttgctgagggcacagcaggttcacttacactgttcttgtggatggctgctctaaaaggacaaatgaatggggaaggacattcattgaattacaaaacattaggccatcaggctg

SEQ ID NO: 1405 - DNA, 160 bp, Homo sapiens
cagcaacatgctttaaccccattgtatgtttgtggaaagagcatagtttaacatcttgagaaatttgggacataaaggttttcatgggtagacagttcaatgcagtatatgaattgacataattggaaataatctgattttatttttacaactaacatcc

SEQ ID NO: 1406 - DNA, 340 bp, Homo sapiens
gttcccttaagcaaaattgaatttgctttgaacttttagttatgcacagactgataataaacctctaaacctgccccagcggaagtggtgttttttttttaaatttaaatacaggaaacaactgggcaaaaattgaacctaaggatttacttttttttcccataggctgggatataggcctgcagctatagttgacaaggcagtctttaaaaactgctgtgaaacacagggccatcaggaaacgagatgctgcactattaaatagaggtgtttgaaaatccacctctcatcctcggcagaggtgcctagttgtatagatgtaagttcagaagttcacctc

SEQ ID NO: 1407 - DNA, 258 bp, Homo sapiens
gtaccgccgcgtgccagacatcactgagtgcaaggaggaggacatcatgtgcatgtatgaagccgaaatgcagttgaagagggactacaaagtcgaccaagaaattatcaacattatgcaggatcggctcaaagcctttcagcagagggaaggacagaactaccagcagagctgtatcaaggaagtagagcagttcacccaggtggccaaggcctaccaggaccgctatcaggacctcgggggcctacagtctgccag

SEQ ID NO: 1408 - DNA, 180 bp, Homo sapiens
tatcagttggggtatcagtagtgccagcaatcatcatctttgccaggatagaagaaaataactcgcccatcacttggtcaaggaggtccattgccctcttgggctgtaattaacaagggcattcacaattgtggacaccacgcggttggctggcagattaggctgcaggcattcctattc

SEQ ID NO: 1409 - DNA, 180 bp, Homo sapiens
attctggccacattccttcctcagaacatctctattctgcagaccctctgcatgccagggcacgccattcccagctggagtcgtggggcttgggcacaaggggaatttttccaggacttgagcctaacggcttctcttaaggatgcttaagaaggttccccagcaaccagacccattggt

SEQ ID NO: 1410 - DNA, 230 bp, Homo sapiens
atttgccatcataggaggcttcattcactgatttccctattctcaggctacaccctagaccaaacctacgcaaaatccattaactatcatattcatcggcgtaaatctaactttcttccacaacactttctcggcctatccggaatgcccgacgttactcggactaccccgatgcatacaccacatgaacatcctatcatctgtaggctcattcatttctctaaaaggaa

SEQ ID NO: 1411 - DNA, 180 bp, Homo sapiens
cttgcccaaggccacagagttaataaatactaaaacaccacacatgtaaatttttgtattctggactcctaaatcccatattctttttttctacatagctgcctcttgtgggaaatgcatgtactttattttctgctatttatcatacaggacaggaggtttttaagcttatttaaaaaa

SEQ ID NO: 1412 - DNA, 325 bp, Homo sapiens
gagctgcagcatccaggggacaagatgccaactggcaagcagctagctgacattggctataagaccttctctacctccatgatgcttctcactgtgtatggggggtacctctgcagtgtccgagtctaccactatttccagtgcgcagggcccagcgccaggccgcagaaggacagaagactcaggatcatgtagactcgggggcttttctcctgagcagagaggccaaggcatgctgtggagagacttcacctgccaccatttccaggtcacaggactagagcgttgatggtttcaaacctgttggagaaagtgccatggttct

SEQ ID NO: 1413 - DNA, 190 bp, Homo sapiens
gctgcccgtgctggtgccattgccccatgtgaagtcactgtgcagcccagaacactggtctcgggcccgagaagacctcctttttccaggctttaggtatcaccactaaaatctccaggggcaccattgaaatcctgagttatgtccagctgatcaaggactggacaaagtgggagccagcaagccacgt

SEQ ID NO: 1414 - DNA, 185 bp, Homo sapiens
gccagatgccactttatccatggtgacacaagagcaggttgctaccctcggagcttatcagagacaagtggcaagactgaggaaggaaaggagggacccctctcctgtgtctgacgttcctggtgttactcagctgtcaaggagatgggagcctctgcactacaatttcaactacagtcgtgcct

SEQ ID NO: 1415 - DNA, 124 bp, Homo sapiens
ccatcatgggagtggacatcgccataacaaggaccgaaaggttcggcgcaaggagcccaagagccaggatatctacctgaggcttttggtcaagttatacaggtttctggccagagaaccactt

SEQ ID NO: 1416 - DNA, 137 bp, Homo sapiens
gtttgggagctcgtgtgtgtatgtgtgcgtgtgtgtatgtgtgcatgtgtgtgtgtgtgtgtgtgtgtacacgtgcgcctgagggggggcatgagtcttgccagaatgtgagtgtgagagttgataatgcaggggtg

SEQ ID NO: 1417 - DNA, 275 bp, Homo sapiens
aaaaaggatagtctcttttcttactctggcaaacctgtgagtgattccacaaagatacagtattacttagctatctgaattatgatagaaaaggtcctagttaggttcctatataaagcatttggaagatgaccttgttgcccttgaaacttgaaaatagggattctggggtgaggatacaaagacattgtcttgcatatcataagcaggtcttagagcattattcaaactctagctgtttcagtagttctatgaggattgcaggtcataggtgt

SEQ ID NO: 1418 - DNA, 190 bp, Homo sapiens
gcggctttggcggtggtagtggaagcaattttggaggtggtggaagctacaatgattttgggaattacaacaatcagtcttcaaattttgggacccatgaagggaggaaattttggaggcagaagctctggcccctatggcggttgaggccaatactttgacaaaaccacgaaaccaagggtgctattgc

SEQ ID NO: 1419 - DNA, 146 bp, Homo sapiens
actttattagctcacacctgtccactcacatgaaactcgtgttaggccctgggaggccgacggtaactctcaccgtgccctcagatgaagcacggagaggttgttacttgcccggccatccagtgggctggctgggtctttgtgtc

SEQ ID NO: 1420 - DNA, 121 bp, Homo sapiens
taagcctgcgtcagattaaaacactgaactgacaattaacagcccaatatctacaatcaaccaacaagtcattattaccctcactgtcaacccaacacaggcatgctcatagggaaggtta

SEQ ID NO: 1421 - DNA, 273 bp, Homo sapiens
ggagagcaaagctgctctctgacagccagccaagatgcccacacctcagtgccatgtgaagggacatcagccaggagacaggctttgcagctagcaggttgtgtgctggttaaggcaagagtagctgctgtaacagacaggccccctgggtctcagtgtctgcatgtcatagatgtttatttctcactcacgtaaaatcaaagcagcagggagggctctctccccaaaaaactagaagtgatcccaggttttccccctcaccctcctctatct

SEQ ID NO: 1422 - DNA, 172 bp, Homo sapiens
tttttaattagttgctgttcataagtttattatctatatctgaaaaaatcatagaaattgctgggtttagctctcagcagcccgctcctgagctctgaggaagcttgccttcttttgagctcccgatccttcttctgagcaagggccaatttggggcgggtccacctcttct

SEQ ID NO: 1423 - DNA, 134 bp, Homo sapiens
gcatgatcagcaagcagttccaccaccagctgcgcgtgggcgagcgacaccccctgctgggtccccctgagtccatgcgggaacatgtggtcgctgcctccaaggccatgaagatgggtgactggaagacctgt

SEQ ID NO: 1424 - DNA, 250 bp, Homo sapiens
tgaagcctaattatgctggactgttttgacctggtttaacccttctgataggtagttgtggatgctggggatgagaactgattattctttgcctggagtgacactacactctagaatttcacttttgagaatactcagttccaacttgtgattcctgatagacagactttacttttctagcccagcattgatctagaagcagaggatcccagcgccttttaaaagttgttatgtggtttcttttaaaagc

SEQ ID NO: 1425 - DNA, 280 bp, Homo sapiens
cttcagtcgccaatatgcagctctttgtccgcgcccaggagctacacaccttcgaggtgaccggccaggaaccggtcgcccagatcaagggtcatgtagccttactggagggcattgccccggaagatcaaagtcgtgctcctggcaggggcgcccctggaggatgaggccactcttggccagtccggggtggagcccttactcccctgtagtagtcagccccattccttttaggtaagcccatggtcccttgcccctgctgttaaatataagcaaaatc

SEQ ID NO: 1426 - DNA, 171 bp, Homo sapiens
ctagagagaagaaaaaccagctgatatgcaatctgtgcttaggtattaaagcttctcttagcacctgccccctcttccacttttccttttttttgatgaacaacacttaaataccactagcaatatgtccacggattaataagtcaattttctatgattaaaggaagcatt

SEQ ID NO: 1427 - DNA, 220 bp, Homo sapiens
acatgtgataaaatagcacaagtggctggtgataaaatttgaaattattggttaacctcagctgtgatcttatgtatgtcaagtgaaatttaaataggtaattatagggttgattacaaaatccctagtgtcattttattttagtcattattgacttttaccctttactctgttcttctcataggcttaatttctatatctcggggtgactgattttatt

SEQ ID NO: 1428 - DNA, 230 bp, Homo sapiens
aatcaacctatcaaagcttcaaaaactttggggaaagggttggattaagtacaagcacattttgcttacagtaaatgaacttatttttattaactgcttttgcccatataacatgctgatatttactggaaacctaggcagcttcacggttatgactaaaggaccagattataatgccaggatataatgtgcagggaatcgctgggtgtctctgacaaagggtgtctcac

SEQ ID NO: 1429 - DNA, 280 bp, Homo sapiens
cctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctbtagaacactggccataggaaatgctgtttttttgtattggactttaccctgaaata

SEQ ID NO: 1430 - DNA, 156 bp, Homo sapiens
gaaatatggcctcaatatgtgccgccagtgtttcgtcagtacgcgaaggatatcggtttcattaagttggactaaatgctcttccttcagaggattatccggggcatctactcaatgaaaaaccatgataattctttgtatataaaataaacattt

SEQ ID NO: 1431 - DNA, 190 bp, Homo sapiens
cttttcctgttggaccattccattcaggagcacagagcaccatgattccaatcttgtgtgtgtttactaacccttccctgaggtgtgtgtatgttggatattgtggggttttagatcactgagtgtacagaagagagaaattcaaacaaaatattgctgttcttcagttttgtttgtggggtttgaaatt

SEQ ID NO: 1432 - DNA, 196 bp, Homo sapiens
cccatgagtctccttccgttctcagcgggcagggcacacctctcgcttgtagaagggacggctcagttcgctgcaccgacggtccttggaaatctcacataggtaggcactgcagcgttgtgaacgtgagcctcggatttctggccctctactgtaaatgtgccttagcctaagcctcccatcctgtgttagcgtt

SEQ ID NO: 1433 - DNA, 120 bp, Homo sapiens
agagtgtgtgcgagcagtagagatccgctcagcacaagtgtgacagaagttgctgccagaacttggacacactggccagctgaagctccgatgctggagatctgtgacaacagcgtgtgc

SEQ ID NO: 1434 - DNA, 265 bp, Homo sapiens
tactcttctggcagcatagcttcgctggatgagctggctctcaagggtgaagctccctgttaagttctgcttttcctgacttctagaggacagaggggctaggcgggcagctcatgattaatttttatgttgaggacttgtcgaaatatattttggtatgttgggtaaataaatataaggtagctgtaaaaaaaaaaaaccctcgagagcctctagacggccggcccactgatttccccccggggggcccaggaaggtcccatcc

SEQ ID NO: 1435 - DNA, 245 bp, Homo sapiens
acagacataatttgattgggaggtgattgatcctaaacagggccacagccatgacaacaaaagagccggttaacaaaattttttgttggtggcctttctccagatacacctgaagagaaattaagggagtactttggtggttttggtgaggtggattccatagagctccctatggacaacaagaccattaagaggcgtgggtttctgcttttttacctttaagggaggaggaaccagtcgaggag

SEQ ID NO: 1436 - DNA, 105 bp, Homo sapiens
gagcaccttctgtggtgcattttgtgcctacgattaagcttgacaacttgttcaattatgattgcataaatattcaatatttatatatggtcctccaatcttggg

SEQ ID NO: 1437 - DNA, 100 bp, Homo sapiens
tctgcccacgcagaacaaacaagtcttttcattttcgagagactgagatcatatcactgttttcaatcacaattttataagactagaatcaatataggca

SEQ ID NO: 1438 - DNA, 312 bp, Homo sapiens
gtgtttttacagaggagaagcaatgggtcttagctctttctctattatgttatcatcctcccttttttgtacaatatgttgtttacctgaaaggaaggtttctattcgttggttgtggacctggacaaagtccaagtctgtggaacttaaaaccttgagggtctgtcataggactctggacaatctcacaccttagctattcccagggaccccaggggacaactgacattgctccagatgttctcctgatgtagcttgagatataaggaaaggccctccacaggtggctgtttcttgtctatatgccaagga

SEQ ID NO: 1439 - DNA, 155 bp, Homo sapiens
tctgccgtctgccagactatgagggtctctctggcactagcctcatgctctgcagcctgctgctgctgctccaggccctgtgcagccctggcctggccccccagtccagaggccatctctgccggacggggcccacagacctggtgttttttgcg

SEQ ID NO: 1440 - DNA, 110 bp, Homo sapiens
  misc_feature 36: n = A,T,C or G
ctcgtccaattcggcaaacgcgacacttgagtgacnttgtcttagtttacgttgcgtacattattaatgtacttatatggaattgtaaccggaaagagcaattcaagcaa

SEQ ID NO: 1441 - DNA, 235 bp, Homo sapiens
gctagctgccctgctccacagcccttcctttcactccttgatacacgggcctgagaactagagaaggaccggagccttggcagccgtccttcagctctacagctaatcagcattctcactcctacctggtaatttaagattccagagagtcgctcctcccggtgcccaagatagattctgactgtactcctccaggcgccccttcccctacaatccaacaacctcagagccaccc

SEQ ID NO: 1442 - DNA, 115 bp, Homo sapiens
attttgatgatatttggtggtaagatagagaggaaggagcacattggttgttttggctccggtacctactggttattaaggatttgcctagatatccctggtggttagattccca

SEQ ID NO: 1443 - DNA, 265 bp, Homo sapiens
ctcgccattttgggcgagggcccaaaattgtttggaaatgccagggtgactgagtttccctgccccagcttttcgggatctctgggcccccatccccttgtgtgtgttccctctgccccagcttcctgctgtaattagctccacgtgtaccccgttcactccttccaccagctctccagccagcctatgaaattatattttagaggtgttcccaggacttttgggacctactaaacactgatggtatttagatgtgatgattata

SEQ ID NO: 1444 - DNA, 195 bp, Homo sapiens
  misc_feature 138: n = A,T,C or G
tggavcgtgtttgagctgctggtgcggtggtcagcgcgatgcccaaggccaagggcaaaaccccgcaggcagaagtttggttacagtgtcaaccgaaagcgtcttaaccggagtkgtcsacggaaggcagcccccggnagtcgagttgtcccacatcccacatgccttggaccacggtaagtcggtacggcagaa

SEQ ID NO: 1445 - DNA, 265 bp, Homo sapiens
atttactttataaaccttatctgtacaatatacgatgtgatgaaatttgctttttatccaaatattttgtatcttgtaaatatggctaattataggcatgcctataatcaacttagattccttatatctaataagagttcaaagagttatgagttgaagtcttgaatgcagggaactatctgatagtgttctaaaatttggttacttgggtttggataccttagtgggatgatgtaaatagaggctagctacctaggcttgtcta

SEQ ID NO: 1446 - DNA, 115 bp, Homo sapiens
aaaaaaaaaaggaactagtgtcaagttatctgactgactatcctatgtggaatagtatgttttcaaactaaattatctcttttctttccaaaaaaaggtcaggtgtgaagttttg

SEQ ID NO: 1447 - DNA, 267 bp, Homo sapiens
ggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgctggacgtacaataccacttccgctgtcacggtaaagtccgccatcagaagactgaagg

SEQ ID NO: 1448 - DNA, 266 bp, Homo sapiens
cgagagtctcgcttgcctccctcccgcgggagtatttctactctatatgaaaataccgtctgtagggttttaagacatttatcgacatcagggtatttattccaccttggccaggcctcctcggagaagcttgtcccccgtatggagggacggagccggactggacatggtcactcagtaccgcctgcagtatcgccatgactgatcatggctcttgcatttataggtaaatggagacttccggatcctgtcagggtgtccccatg

SEQ ID NO: 1449 - DNA, 267 bp, Homo sapiens
ccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagact

SEQ ID NO: 1450 - DNA, 210 bp, Homo sapiens
cacagaagacctcacgcctccccatcattgacattgcacccatggacataggagggccgagcaggaattcggtgttggacataggggccggtctgcttcttgtaaaaaccttaacccagaaccaccacatccgttgcaaacccaaaggacccaggtactttccaattttaggtactttagggcttttcacttaattggcgtaccttaccg

SEQ ID NO: 1451 - DNA, 170 bp, Homo sapiens
taaaggtaagcaccacagttcttgaaaaacaaggattatttattttgcaccatcgctgacccagagatgagtccttagagagtaatccatcttgtaccgtttagatctctcaaagccattcctaatctggaccctctctggatggccctcaagcttttacttgccagtca

SEQ ID NO: 1452 - DNA, 215 bp, Homo sapiens
gaaaagtcaacagtgtagttctaaaccttatcccaaacagaaaatgtggttatgatgtcactttctgcctggtcatcattaggcttaaattaaatgctgaagctgtcatcaaagggtttacactaaaatcttcagggctttaaataaaaggttaaggtccagcttccaaccacaattttccacattggcagctccattcttcttaataaggctcg

SEQ ID NO: 1453 - DNA, 200 bp, Homo sapiens
ctcgtgcgaattcggcacgagaatttgttctcagttgctagtctgtagagtatgaacccttaggaatgcccacaactttcccacttctcatagtccagctcagctcaaccccataaagcactttttgttcctgggtcctgaatgcacttgtcttctagtagaggaacaaattcaaggtttcccttctggcatgagaattg

SEQ ID NO: 1454 - DNA, 220 bp, Homo sapiens
aggaagctgccgcctggcaaaggcttggcaaaaagcctgctcaacgcagcttctcgccacacgcatgaccgcgcttacggaggcccgggtttggccttgagctcggcctcggaggcgaactgcgccttgccatggaccttgatcttgggctcgaagggctttttttgtacccgcagttgcgtggcaggttgtcggcctctcccttggcagcttgcgcatg

SEQ ID NO: 1455 - DNA, 135 bp, Homo sapiens
cacaggctgagaactcgttcacctccaagcatttcatgaaaaagctgcttcttattaatcatacaactctcaccatgatgtgaaggggtttcacaaatctttcaaaataaaaaggtatgacttaggaacctgcca

SEQ ID NO: 1456 - DNA, 126 bp, Homo sapiens
ggaagccttgctcattcttgaggagcattaaggtatttcgaaactgccaagggtgctggtgcggatgacactaattcagccaccgatttggaggaattaatttgcttcatagtatttggagcgcac

SEQ ID NO: 1457 - DNA, 135 bp, Homo sapiens
tggcctaacaaggccacaaggtaccaagaacgtagcaagccagcacagcgacgcgcgggcttttaccaaacacaacaaggttggtcgggacaatgattgggagggtttgtgcctttccccgcacggaccgcgcgc

SEQ ID NO: 1458 - DNA, 179 bp, Homo sapiens
cttttatggcaaacccagccaggtttcatctcgtcagggaaaagggatagaagtgaagagattctccctagtacctaattttcattttcattggtttaggaaaggaaatacaatgcacctgttctcttcgagactccagaataaaagtccttgcagctagaccaccgtttttatacacc

SEQ ID NO: 1459 - DNA, 223 bp, Homo sapiens
ccaatctcctggatgggcaacccaaaggtcacattcagcagctgtggccatgacctctctaacctcagaggccgacaatctcttgccaggttcatatttttgccactttgtgattcagcacataaacctttcatggccattatattccagggctgcaatgtgacttctgcgggccctatgcacttttcttaacaataaattgaaatcatacttatgagtgtgt

SEQ ID NO: 1460 - DNA, 229 bp, Homo sapiens
cggaggtgcaggtcctggtgcttgatggtcgaggccatctcctgggccgctgcgcatcgtgctaacaggtacttctgggccggaaggtggtggtcgtacgctgtgaaggcatcaacatttctggcaatttctacaagaacaagttgaagtacctggctttctccgcaagcggatgaacaccaacccttcccgagggccctaccattccgggccccagccgatatttttk

SEQ ID NO: 1461 - DNA, 217 bp, Homo sapiens
agatggtgagatttttgcaagtattaaccagaaggacggtatggtcagtttccatgataacctgaaaatataataacccagccatgcttcataacattgatcaggagatgctgaagtgcattgagctggatgagccgctgaaagcatggaccaggagatcacagtgaacctcagtttgtacaaagagtattggctcacaagaagatgattcaaggac

SEQ ID NO: 1462 - DNA, 104 bp, Homo sapiens
ggagcagccttcaagcattccattacgccccatctcgctctgtgccccttccaccaggcttcagcaggagccctggactcatcatcaataaacactgttacagc

SEQ ID NO: 1463 - DNA, 221 bp, Homo sapiens
aagaaaagaggggaaagagaaaaggaaggaagaaagatttcttctctagttctcttgtgacttacattctacattaaacataatctcagagggacttgattcttgccttacaactaactcttgcagtaaataccactgtgtgtggtatttaactgtataccctaatctttcctagggatcaaccaccactaatttctccctcacaaggactcctcgacagt

SEQ ID NO: 1464 - DNA, 219 bp, Homo sapiens
ctcgtgcgaaattcggcacgagctttccttgttctagccaggctgttctctgacagatggctttgaaaaggtgatccaagcaggcccctttatctgtacatagtgcttagttgggggtcttgcaagttttgcagcttcctcttggcttagcacagctttacccctttgcccctttcaatacttgatcaatgaattaataaactttctagaatttctgag

SEQ ID NO: 1465 - DNA, 147 bp, Homo sapiens
cttgaacttcagtgccctcactgtagaatttaaaagccttactgttgattgcccatgcttggacttgatggagaaattaaatatctttcattatgctttacaaaatactgtatatgtttcagcaggtttggggaattgggagaggac

SEQ ID NO: 1466 - DNA, 282 bp, Homo sapiens
ctggacccagcccctggagacaccattcacttttactgctttgtagtgactcgtgctctccaacctgtcttcctgaaaaaccaaggcccccttcccccacctcttccatggggtgagacttgagcagaccaggggcttccccaagttgcccagaaagactgtctgggtgagaagccatgcccagagcttctcccaggcacaggtgttgcaccagggacttctgcttcaggttttgggataagacacctggatcagactccagggtctgcccctgagtctggg

SEQ ID NO: 1467 - DNA, 344 bp, Homo sapiens
atttttttggaaacctctgcgccatgagagccaagtggaggaagaagcgaattcgcaggctgaagcgcaaaagaagaaagatgaggcagaggtccaagtaaaccgctagcttgttgcaccgtggaggccacaggagcagaaacatggaatgccagacgctggggatgctggtacaagttgtgggacttcatgctactgtctagagcttgtctcaatggatctagaacttcatcgcctctgatcgcgatcacctctgagacccaccttgctcataaacaaatgcccatgttggtctctgccctggactgtgacattctggactatttctgtgtttatttgtggcg

SEQ ID NO: 1468 - DNA, 351 bp, Homo sapiens
ctcgtgccgaattcggcacgagcctcgctcagcaccttctctcagacccaaggactatgaagttgatgctactctgaagtctctcaccaaccagattgagacccttctgactcctgacggccctagaaagaacccagctcgcacatgccgtgacttgagactcagccacccagagtggagcagtggttactactggattgaccctaaccaaggtatgcactatggatgctatcagagtatactgtgatctctctactcgcgaaacctgtatccgggcccaacctgaaaacatcccagccaagacctggtataggagctcaaggacaagacacacgtcttgctaggagagac

SEQ ID NO: 1469 - DNA, 311 bp, Homo sapiens
ttgctgcttgctgtcctggtccgcgccagagcccagcgcgcctcgtcgccatgcctcggaaaattgaggaaatcaaggacttcctgctcacagcccgacgaaaggatgccaaatctgtcaagatcaagaaaataaggccaacgtgagtttaaagttcgatgcagcagtatacctttcacaccctggtcatcactcacagagagaggacagagacactcacgcagtccctcccccccggtttggcagtaaggaccctcaaatgacccagacacactgattggacctgtattatataagatactaaaactcca

SEQ ID NO: 1470 - DNA, 350 bp, Homo sapiens
ctgaatcgctgcaccccagaggtacgctttcgtatgggctgtaagggaaaagggaggggggatgccgccttctgaagacacatgttggtcagttcccctgaaaaaccctgggcattcttaattcccaaattaatcctactggaccactctttgatctcctttcatacagtaaaaatacaatagctggcccaaggggaggttttcaggacagctcattccatcaggacctcatggccttgaccaaggcttgccaggaggtggggaaaggcagtgctttccttgacatcacgctagcaagtctctctcgactcttatgcaggatggtcagaacatcgagtccaggaatactt

SEQ ID NO: 1471 - DNA, 345 bp, Homo sapiens
ctcgtgccgaattcggcacgaggtgatttggaagatgatgagacaccccagctttctgcccatgccttagcagctctccaggattgacatgctgagcaaaagcaacagcttgagccaggcgaggatgataaatataacattggataatagaggagatttggatcgcatgtgtaagtcccctagtgtttaccagacactcagagagctgtccagagaaacttttcgatatacatctttgaatatgacaaggatttgccatgtatggagaggagtttatcttctatgattacaatactccattggactcacccgagagattcctgcacatagttttgacatcgtaat

SEQ ID NO: 1472 - DNA, 279 bp, Homo sapiens
gctttgataaacaatgtcagattttaactatgaaaacgacattaccttgtgcatttttatattgattcctatttgcaggttaagattaaagtttaaatgttttccactagtcatttcacttctaacttggtataggaggcttagctctcttaccaataccctataatgtccctgtatcacagaggattcaggaaaattgcacttgggatcaaagaaatggacctcttttggaaagacaaggcaccatgtaactgtatcgacacatcctcattaacacct

SEQ ID NO: 1473 - DNA, 207 bp, Homo sapiens
gtcgtaagggcctgaggatttttggtccgcacgctcctgctcctgactcaccgctgttcgctctcgccgaggaacaagtcggtcaggaagcccgcgcgcaacaaccatggcttttaaggataccgggaaaaccacccgttgagccggagttgcaattacccgaattccgattaccctaacaggccgaacggaaaatccttggaaaag

SEQ ID NO: 1474 - DNA, 95 bp, Homo sapiens
cggcacgagagtacttctagagcggccgcgggccatcgattttccacccggtggtacagtagtgtacccaattcgccctatagtcagtcgtatta

SEQ ID NO: 1475 - DNA, 174 bp, Homo sapiens
tagagatctcaaaccagactttaaagagtgagcaatgttctgtagcctttgatatcggaaataatttacaaataaatgatattctgacaactccctttttactgaattttatatgtgcctctaagcatatcactttaattacgagaatatgtctcacacagaacaagcatagar

SEQ ID NO: 1476 - DNA, 199 bp, Homo sapiens
gtccaggcctaatactcctaaagtaagagttgggtcctttttttcttcaatacactgtgcctgtacccttgtaaaggtattttatcttgctgcttatttgtggaatgaaacctcaaacaaacccaaagggggagggtagggcaggtacaggcagattggaaatctgcctccagattctattaaatacacccttttgcca

SEQ ID NO: 1477 - DNA, 110 bp, Homo sapiens
aaactttggggaaaaacttcgttttgtttacatccatgaatcatttgagcacgaaaaataattctcagcgtgagaggtacaaaatattgaggggcccctggggkgtataa

SEQ ID NO: 1478 - DNA, 145 bp, Homo sapiens
ttaagaagggcccctattccacttggcagcagctttatttctcagtagccatgatgatgacgatgatatttaatccccttaaactttgcttttttaggggaggagctcccccccatctaacattttcctcctgttctttcagggg

SEQ ID NO: 1479 - DNA, 154 bp, Homo sapiens
gtcttacttgtcttatttattctccaacagcactccaggcagcccttgtacacgggctctccttgcatcagcccaagctttctttgaaaaggcctcgttctaacaactttggcttgttctttcctttccctcaacctccccaattttccccctt

SEQ ID NO: 1480 - DNA, 107 bp, Homo sapiens
gtagtcgtgtcagtacgtgtccctccagtcccccgtccagtgtggggaaacaaaaaacccgtgtaaaaccgtgggggagaaaccgtgtagggtcccccgtcgtcgtg

SEQ ID NO: 1481 - DNA, 191 bp, Homo sapiens
gtcactttacagaaacagtgtgtaccattccgacgttacaatggtggagttcgcaggtgttcgcagccaagcaattgggcttggacacaaggtcggttgccccaaaaagagttcttaatttttttcttccacattcttaaaaacggagagagtatattcttaacttaagggtttagatgtgagagttctct

SEQ ID NO: 1482 - DNA, 110 bp, Homo sapiens
gtcaaatctttttcaaatttaattgtatatgtgtatataacggtagtattcagtgaatacttgagaaatgtaccaaatcttttccacccacacccggtgccaaggagcct

SEQ ID NO: 1483 - DNA, 215 bp, Homo sapiens
cgatgtgctgtctctggagtgataagaaagggctacatctcccgaaatgatttctttacgtcatgtattggtttccttctacaccttgaactttttgttgaactgtatgtactttaccccaaacctgttaataatttgagcgcttctatgtaaaagcaaagaaataattttaatactctggcaatcataaattttattggagaggatatttattt

SEQ ID NO: 1484 - DNA, 190 bp, Homo sapiens
atcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtgtgtgcacactccgaaacttttaactactgttttgtaagcctc

SEQ ID NO: 1485 - DNA, 228 bp, Homo sapiens
cacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgagggaagcagacatttgacctcaccaagaggggcgggagaactcactctaggatgaggtgggaacgtgt

SEQ ID NO: 1486 - DNA, 158 bp, Homo sapiens
ggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatc

SEQ ID NO: 1487 - DNA, 209 bp, Homo sapiens
cccagcccagggtccgggcccctagggccccctcaccaaggactcagggaagcctcttcacatcaaaccacgtctgttaggaccccagggaccggcctgcacctaccttagaccctcattcttggggaagaaagaggctcttttcaccactctaccctacaggaggggcggcccgccaccagagctcacctgggggccacagggacact

SEQ ID NO: 1488 - DNA, 201 bp, Homo sapiens
gtaacatacaatttttaagagcttatatggcagcttcctttttaccttgttttcctttggggcatgatgttttaacctttgctttagaagcacaagctgtaaatctaaaaggcacttttttttagagggtataaagaaaaactagatgtaataaataaggtcatgggaggctttatgttaaaaaagttgaatgttatatgt

SEQ ID NO: 1489 - DNA, 213 bp, Homo sapiens
ctttattccagagtggtctgtaggcctcaggtggagccaaagaacgttcatttctagtaagttcctatgtgatgacgctgctactgttggtaagaacccttttgagcatctgttttcagatattgtgcctcaaaagaggctatcctgattgtgatttttgtggtgcctgtaggttgactgtcccagtacactgtagataggatagagacccts

SEQ ID NO: 1490 - DNA, 236 bp, Homo sapiens
cggcacgaggtacccacaggactccacgcctgagagtcaggtcttaacaccctcattccttttcccaggctcctcctgctgaaaatgtttgctttcagaggtgatgtgaggaccatttttctggaagttctcttttgtcatccaaattctggtggtggccttgtttctattttggaaccagttgccgagcaaacatgtacatatttacattgagagcatatatggctcaggtgkgg

SEQ ID NO: 1491 - DNA, 189 bp, Homo sapiens
ggactttcggaggtgtggactctgcctgcctacctggtctgggaagatgttctaccatatctccctagagcacgaaatcctgctgcacccgcgctacttcggccccaacttgctcaacacggtgaagcagaagctcttcaccgaggttggaggggaccgcaacagggagtattgctttgtaattccggt

SEQ ID NO: 1492 - DNA, 173 bp, Homo sapiens
gagaagctgacccaggaccaggatgtggacgtcaaatactttgcccaggaggctcttaactgttcttgtctctcgccctaatgctggaagagggggcaaacaacttggcctcttggtgtcaccccttcaacccccacaaaggtccctctttttggggaagcacttggggggcc

SEQ ID NO: 1493 - DNA, 178 bp, Homo sapiens
gtgcaatgcaggcagcttctcaagcaggtgttccatttggtktaaaaaatacttgggtctcagggccttaaatctactccagctccaggtagttcactttttttaacacatgtcagcagcagcaacagcagcgtgtccagtttacaccacaacacccgtagcgacccacaaccttttg

SEQ ID NO: 1494 - DNA, 280 bp, Homo sapiens
gaacatcttcgcctggtgtggtggaaagtccaacatcctggaacgcaacaaggcgaggggaccttgcccttggccatcccgggacagttagcgacagggccaaggccagggttgagattgtcacttatggggaggagcctgctgagatgatccagggtgctcgggccccaagccttgctctttaaggagggcaaccctctaggaggacctctacagctgacacggcacatgtccagggccgcagctctgtatatgggttctgatgccactcgacagatgw

SEQ ID NO: 1495 - DNA, 135 bp, Homo sapiens
caaccttgcaaggaccacacttccccatacccttcagtgcagtgttaccagggcaggagaccttgttgccgttaagcagttggaccattggtcaccttgcttgggtagagcctaggtttttcctttgggcccggy

SEQ ID NO: 1496 - DNA, 111 bp, Homo sapiens
cggcacgaggataatttcccttggaagaacaaaggaaaggtctggaaatcaggaaggtatgaatcctaacctcaatacaacagaagtgcaattccctgtaaggatatctct

SEQ ID NO: 1497 - DNA, 135 bp, Homo sapiens
ttataagaagactctgaaaggtggaaagaagtagcagtattggctaagaactgctgggcatggtggcacatgcctgtgatcccagctacttgggaggctgaggcaggagaatcgctttgaacctcgggaggcaga

SEQ ID NO: 1498 - DNA, 239 bp, Homo sapiens
gggaatgtcacccgagactgtcacaggcttgcatacctttggcctacacaccgggctctagggccataattttccaaccttgggagtcttcttttcacttaaattccaggtaggcttcagtattcggctttaaggttttacacttttaaaggaaagtgtggtttattttgtctaatgggattcctggggcccgctctctccctagagggggttgggagagtttgggagtgggtctctac

SEQ ID NO: 1499 - DNA, 239 bp, Homo sapiens
ctttagtacgtgtggcttggtcacttcgtcgctaaggtaagaacgtgcttgtgggaagacaagtcctgtggcttggtgagtctgtgtggccagcaagcctctgatctgtgcagggtattaacgtgtcagggctgagtgttctgggatttctctgagagcctggcaagaccagttgttttgtctcgcgggtctgtcaggttggaaagccaggccgtagaccgagtttcctttctgagcts

SEQ ID NO: 1500 - DNA, 138 bp, Homo sapiens
gcagctttgggcagctttgagaagcggtacaagagttctgtgcctgtgtgtccagccctgggagccaagccaagtgcaatttattttaaagctcttaagagccactccttggcccaaggattgcgtggaacccctgar

SEQ ID NO: 1501 - DNA, 154 bp, Homo sapiens
gccgccttacgacacagccctcatctatgactacgagggtgacggctcggtggccgggacgcttgagcttcattctgttcagccagggcgattgaggaccaggactacgacttaccttagagacttgggggcccgctttcgtcccggcttgcag

SEQ ID NO: 1502 - DNA, 150 bp, Homo sapiens
gccagctcccacccatctttttcttgaatctcttctgatttccttaggacgactgaaggtgtgggctgacggaattgccctaagtttgaaggtagtataaggtgctcaaggcccctaatccagacactttaacctttggttaaccccctt

SEQ ID NO: 1503 - DNA, 135 bp, Homo sapiens
ttcaaatattcctttattaattcctttattaattgataatattcctctatcaattacctctactcatcttattaatagggaaaataaacaatacttgtttaaggccttgaatgttataaacaatagggtaatatc

SEQ ID NO: 1504 - DNA, 160 bp, Homo sapiens
gaaaaactcaggcccatccattttctcagatctccttgaaaattgaggccttttcgatagtttcgggtcaagtaaaaattggcctcttgcgtaagttttcaaggtttttttgaagctttttgtaaattgtgatagggactcttgggccctgaactctacg

SEQ ID NO: 1505 - DNA, 163 bp, Homo sapiens
atttttggtccgcacgctcctgctcctgactcaccgctgttcgctctcgccgaggaacaagtcggtcaggaagcccgcgcgcaacaaccattgcttttaaggatacccgaaaaacacacccttgagagccgaaggttgcacattcacaccaatttcgcgatta

SEQ ID NO: 1506 - DNA, 196 bp, Homo sapiens
aaataacaaaaaagagaaacgccaacaaaaatcagcagatgttgaagacaggggtcttgggggttggcttcggcaaccacattcttggagttaagacttttcttagttacttttttttagggggggtttcaaggcttaaccccaacttcctttccaaccttcttccaacctaacctttggacaccactgtgtaaag

SEQ ID NO: 1507 - DNA, 178 bp, Homo sapiens
gtccattttaactggcacctcagggattaaaatcctactttttagtgtagttccactcattcatgaaatgaataggacctatttgtattatgggaggatggtttcagttaacctaggaaaatgttcaataaccctcaaagggatgaaggggtttttatttttaaataggtttataaaa

SEQ ID NO: 1508 - DNA, 289 bp, Homo sapiens
ctcgtgcgaattcggcacgagttaagttgtggtctgacacacactgctgtggttccctggattagtgaatgccgtatgcgggacccccaaaagtacaagggcatatttaacggattctcagttacacttaaaggaggatggtgttcgtggtttggctaaaggatgggctccgactttccttggctactccatgcagggactttgcaagtttggcttttatgaagtctttaaaggtcttgtatagcatatgctggagagagatacttatctctgcgacatcactatattg

SEQ ID NO: 1509 - DNA, 216 bp, Homo sapiens
ctttcccccactttcagggctcaccaggcactggcagggagggtaagggctggctcagataccctccccacagattcctagcaatgaaaatctaatatattccttcctgttgccccttggggtttggagagtcagtgccttcagtcaagtgccttccagcctcggctcagcacatccttgccacaaatcagtgtcttggggcttggccacccttcc

SEQ ID NO: 1510 - DNA, 115 bp, Homo sapiens
cctggtgaagaattgcatcgtgctcatcgacagcacaccgtaccgacagtggtacgagtccactatgcgcttgccccttgggcccgcaaagaaggggagccaaagcttgacttcc

SEQ ID NO: 1511 - DNA, 172 bp, Homo sapiens
ggtgagcctggatcccccggccctgctggctttgctggcccccctggtgctgacgcacctcgtgctaaggcgaaccttggtgatgcttggtgctaaaggcgattctgggtcccctggcccttccggacccgctggaccccctggccccattggtaattttgggtctcctggg

SEQ ID NO: 1512 - DNA, 160 bp, Homo sapiens
ctcgtgcgaattcggcacgagaagaaacaaaaagaaaaagaagcagaagaagctgaaagcaattattcattggtacctccagtgtcaatttgagaatttctttaaattagggaaagccaaggttttattgccaggaaccttttgggaaattaaaaaggaa

SEQ ID NO: 1513 - DNA, 223 bp, Homo sapiens
accaggtataggccagaaaggaggtggccagtcagtaccttgctcacgtcagctaagggggacagtgatgtcatgtgggtgactcttcttcatttgaccaaggccagcctcctgttcttacctttgcccattcatttctggctattgggaaactaccacctgttgagttagccaattaggccagggagatcagaggggcttgggttccggccattgggcacat

SEQ ID NO: 1514 - DNA, 216 bp, Homo sapiens
gcagtgggacccaagtttaaggttgtgtgagggacaactccctccagtcagacgagtgaaagttactgcacatataatctcacttgggggatgatgtcaaatgtccatgtctgcgacctgtctaaactaggaggctgggctaaaaggctccttgccctcttcttccagcttcccccaaccacttgcaacaattaggaccggttggtaggtcacaca

SEQ ID NO: 1515 - DNA, 236 bp, Homo sapiens
ccatctttgcattgttcctcatccgcctccttgctcgccgcagccgcctccgccgcgcgccttcctccgccgccgcggactccggcagctttatcgccagagtccctgaactctcgctttctttttaatcccctgcatcggatcaacggcgtgccccaccatgtcagacggagccgtagacaaccagctccggaatcaccaccaagggcttaaaggaggaggaggaaggttttgga

SEQ ID NO: 1516 - DNA, 294 bp, Homo sapiens
cttcccttgttgctccagctctgaataaaccgaagaaacctctcacttctagcagtgcagctccccagaggcccatctcaacacagagaaccgctgcggctcctaaggctggccctggtgtggtgcgaaagaaccctggtgtgggcaacggagacgacgaggcagctgagttgatgcagcaggtcaacgtattgaaacttactgttgaagactttgagaaagagaagggatttctacttcggaaagctacgggacaattgaattgatttgccaagggaacgcgaggggaaaacg

SEQ ID NO: 1517 - DNA, 265 bp, Homo sapiens
ggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttcagcagaagtatgatgggatcatccttcctggcaaataaattcccgtttctatccaaaagagcaataaaaagttttcagtgta

SEQ ID NO: 1518 - DNA, 334 bp, Homo sapiens
gccacagcagggtttcaggttccaatcagaactgttggcaaggtgacatttccatgcataaatgcgatccacagaaggtcctggtggtatttgtaactttttgcaaggcatttttttatatatatttttgtgcacatttttttttacgtttctttagaaaacaaatgtatttcaaaatatatttatatgtcgaacaattcatatatttgaagtggagccatatgaatgtcagtagttttatacttctctattatctcaaactactggcaatttgtaaaggatatatatgatatataaatgtgattgcagcttttcaatgttagccacagtgtat

SEQ ID NO: 1519 - DNA, 388 bp, Homo sapiens
cctccttccgcaacacgggcgagatcaaagcactggccggctgtgacttcctcaccatctcacccaagctcctgggagagctgctgcaggacaacgccaagctggtgcctgtgctctcagccaaggcggcccaagccagttacctggaaaaaatccacctggatgagaagtctttccgttggttgcacaacgaggaccagatggctgtggagaagctctctgacgggatccgcaagtttgccgctgatgcagttaagctggagcggatgctgacagaacgaatgttcaatgcagagaatggaaagtagcgcatccctaggctggactccagatctgcaccgccggccagctgggaatctaacttcacgtggcttctgatgaatcttgc

SEQ ID NO: 1520 - DNA, 290 bp, Homo sapiens
ctttgactgagtaggcgttttgtcattattgtgtatatgagatgtacttgtatcgttcataatatattttttttattatgtgtagaaagattttaaaaaactaacgtgcagcaatttccagtgaacctgtacttggacatcaggtagtgagtctatttgtggtcactagcactgtctcctaaacttgtaagaggtctgaagctattctttgatttttgctagtgctattaacttatgtagagcccgttaaaaagcagagcaacacaattatagttatcctactgtagcca

SEQ ID NO: 1521 - DNA, 232 bp, Homo sapiens
gaggagaatgtttcttaggggaattcgctaggtttaacgatttgtttctcctgctcctcttctatcagacctgaccccacacaaacctgttccctcggttgtgttgaagtccctggacagtgggcaggggttggcagaggacacgagcagccacttcccgtaccccctcttctctctgtaagcccattccctgtctttccagggacttttgaggcctctttcctctacggtc

SEQ ID NO: 1522 - DNA, 218 bp, Homo sapiens
ctcgtgcgcggacaactcagcctgccaaggagccgtgttaggagggtcggggagaaatcaggctctagaggctcataaaattcaacgtgaggaggcaagtgacaaggccaagcaaggcacagtggacggtcatgaaggagcggggttttggcaggcgggtaacgtccaghgagaggaagcgcccctgttgcccttggcccgccgtctggacgcgcggc

SEQ ID NO: 1523 - DNA, 298 bp, Homo sapiens
gataggtacaagagttacagcccttatgacatgttggaaagcatcaggaaagaggttaaaggagacctggaaaatgctttcctgaaccctggttcagtgcattcagaccaggcccctgtattttgctgatcggcctgtatgactccatgaggggcaaggggccgcgagataggtcctgatcagattcatggtctcccgcagtaagtggacatgttgaaattaaggtctgatttcaggagagagtccggcaagtccctgtactattatatccagcaagacactaagggcgactaccaga

SEQ ID NO: 1524 - DNA, 119 bp, Homo sapiens
gggtcccttgcaaggtgacaggcccctcggctctgtctggtacgcctatcccttcacccaggggcaattggcattgttttcccacctgtccctaagaggcttctaatattgcttgtatt

SEQ ID NO: 1525 - DNA, 221 bp, Homo sapiens
gaaaaagcaaggggtttgtccaggtggcccctgaattctgcgcaagggaatgggcctgggggaacctcaagggaggcctaaagcacttgtaactttgacccgtctgtctggagtcagaccctgttggaaagcaggggtagaggggaccctggaggcaggcttttccggatccctaggggtggcaagtccagcccttcctcaccacttttcccctttcagtg

SEQ ID NO: 1526 - DNA, 99 bp, Homo sapiens
ggaacttcacaagagttttgggtactcagaggcaggcaggatcattgaggggtcatctttgaaggcttggtacccacttattccagatatatccttatc

SEQ ID NO: 1527 - DNA, 450 bp, Homo sapiens
ggaacttcacaagagtgtgggtactcagaggcaggcaggatcattgagggtcatcttggaagctggtcaccactaatcccagatatatctatatctatagatagatagctagatagatagatttagacagagtctcactccatcacccaggctggagtgcagtgtcatgatctcggctcactgcaacctctgcctcctgggttcaagcaattctcctgcctcagcctcccgagtagctgagattacaggcacatgccaccttgcctgactaatttttgtatttttagtagagatgaggtttcaccatgttggccagcctggtctcgaactcctgacctcaagtgatctgtctaccttggcctctcaaagtgctgggattacaggcatgagccaccacgcccagccaagagtgtgtatagtccagtgcaatgggagggacctgaaaggggt

SEQ ID NO: 1528 - DNA, 105 bp, Homo sapiens
cccctctgaacctgagattttggtcaattctctgcttgcacagctctaccttccttcctaatcaattggtcataaacgggtacgaggcagcttgctcacttccag

SEQ ID NO: 1529 - DNA, 160 bp, Homo sapiens
cctgcctccgttttcctggacagctcaatgctgacctccgcaagtttgcagtcaccatggtcccctttccaacgtctccatttccttaatgcctggctttgcccttttaccaagccgtggaggcaagcagtatcggagctctcacaagtccccggactct

SEQ ID NO: 1530 - DNA, 198 bp, Homo sapiens
gggaacatcgaggagatggtggcccagctgaggaacagctcagagctggcccaagagaaaagtgtgaggtcaacttgcagctgttggatggttccaacaaggaaggagcctgtcttccctggggcttcaacatcaaccaggaccccagccgtaatcccgtgggaccttccgaggaccgggtgccttgttcttggcttg

SEQ ID NO: 1531 - DNA, 218 bp, Homo sapiens
caagaaggccctgctcctcagggctcaacgagatcgagatcgcgccgagggcaacagccgcttcaacctcagcgtcactgtcgattgccttcacgagtaacaaccggagccctgggcaaggcaagtattttattcaaaaccaccaagaccctccggcctcccaataatgaagttgcccccttggacggttgggtccccagacccaggaatttggcctt

SEQ ID NO: 1532 - DNA, 150 bp, Homo sapiens
gggagaagctgagcagtcaagatgtgtgacttcaacgaagaacaagaccgcagagttcagggagggccttcaagctgttttgacccgaaacaaggtgaatggcaagaattcctgtacaagccaagttgttggggattgtgaatgaagggg

SEQ ID NO: 1533 - DNA, 275 bp, Homo sapiens
accaagtttagggaggactgccgcccggatcgcgaggaacctgggccgcacagctgggcctgtcctccacaccctggccgcctactaccccgacctgcccaccccagaccagcagcaagacatggcccagttcatacatttattttctaagttttacccctgtgaggagtgtcctgaagacctaagaaaaaggctgtccaggaaccacccagacaccgacccgggtatgcttacacagtgcgtgtccacctgacactgagtgacccgaagctggg

SEQ ID NO: 1534 - DNA, 281 bp, Homo sapiens
gtttgcttaggcgcagacggggaagcggagccaacatgccagttgcccggagctgggtttgtcgaaaaacttatgtgaccccgcggagacccttcgagaaatctcgtctcgaccaagagtctgaagctgatcggcgagtattggtctccggaaacaaacgtgaggtctgagggtcaaatttaccctggcaagagtccgcaagggcgcccgggaactgctgacgcttgatgagaaggacccacggcgtctgttcgaaggcaacgccctgctgcggcggctgg

SEQ ID NO: 1535 - DNA, 284 bp, Homo sapiens
ctgagatggcattttatctgccaactgcagacttatggcttctcaagacctcatttgtccccttcctcatatgttgtttttatatgactgaaatcacatgcagaaattcgtgattagtatggctctgcttttagtttttggtggatattggtatgtataaattttcagtacttaaattgattttagcactttgataggataggctctcaaaaggttgtgtaaaacagctgagtgtaatttcacagcgcttatgtctcttgcatatttaagagactctctgtgaa

SEQ ID NO: 1536 - DNA, 552 bp, Homo sapiens
ctgagatggcattttatctgccaactgcagacttatggcttctcaagacctcatttgtccccttcctcatatgttgtttttatatgactgaaatcacatgcagaaattcgtgattagtatggctctgcttttagtttttggtggatatgggtatgtataaattttcagtacttaaattgattttagcactttgaatagaataggctctcaaaagtttgttaaaacagctgagtgaatttcaaagcattatgactttgcatttgaagacactgctgagagccaggaaaaaggagtgggttctgacattggcttgacaggattgatccaacaggtttgtaattaatttatctggtaattggttggagtatacatgttatacatcacatctttaagtgtaagtgttgtcattaattcctttctgttaattaaaccagtattttttctgtgtagggctagatagtaaatattttaagcaagtcatatgctcactttttggtttggtttggttttggtttgggtgacaaagtgagactccatcctcaaaaggaaaaa

SEQ ID NO: 1537 - DNA, 190 bp, Homo sapiens
gtgcactggcccctccccacccctagggggcactcagtagctgctgagaaggcctgtccacgaggctgttggaacccctccaataaatacttaggaggtagtgtatctgatgcttggttttcggtggaggaaaattgtattggggaacttaaaacatcagggttatttttaataggatccgcagcaccca

SEQ ID NO: 1538 - DNA, 200 bp, Homo sapiens
tttcattgtgggagcagacaatgtgggctccaagcagatgcagcagatccgcatgtcccttcgcgggaaggctgtgtgctgatgggcaagaacaccatgatgcgcaaggccatccgagggcaccttgaaacaaaccagctcttgaggaaacttctgcctaaatccgggggaatgttggctttgtgttaaccaaggaggac

SEQ ID NO: 1539 - DNA, 190 bp, Homo sapiens
gtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacag

SEQ ID NO: 1540 - DNA, 240 bp, Homo sapiens
cttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgccgagatgaaacagaattctatttgggcaagagatgcgcttatgtatatatagcacaggacaacacagtcactcctcgcgggcaaccac

SEQ ID NO: 1541 - DNA, 195 bp, Homo sapiens
ctcattttacgctgtctctgacataaggagtgcctgaatagcttggaaaagtaacatctcctggccatcccttcatttaaccaagctattcaagtattcctatgccagagcagtgccaactcttggaggtccagagtccagccaatggcctttgtgtggtagttctaaatttcaattgcacctgaaaacctggca

SEQ ID NO: 1542 - DNA, 280 bp, Homo sapiens
cgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctgtgggaaaaaaggcagcagctaccaagaaccagcccctgaaaagaagcctgcagagaagagaccttcctacagaggggaggaggccttctgcataaactcttaaatttgattattc

SEQ ID NO: 1543 - DNA, 316 bp, Homo sapiens
tttccttattctttttaattagttttattatgtatgctaccattcgaactgagagtattcggtggctaattccaggacaagagcaggaacatgtggagtagtgatggtctgaaagaagttggaaagaggaacttcaatccttcgtttcagaaattagtgctacagtttcatacattttctccagtgacgtgttgacttgaaacttcaggcagattaaaagaatcatttgttgacaactgaatgtataaaaaaattataaactggtgttttactagtattgcaatagcaaatgcaaaatattcataggaaaaaaaaa

SEQ ID NO: 1544 - DNA, 352 bp, Homo sapiens
ctcgtgccgaattcggcacgagccaagagcagacagcccacggacggactgcaagtcggaagcgcgggcggaaagctgtgcagcgcccacctcggtggctccatcggccgcgttcatcagtcagcacgacccgacctcagtggcgtcctcacaacacagaccggaccttgggtcttaccccggcacctgagaaccacttccggtgagtagcttctacttccggagacgatgactcccccgcgtcccagaccggaagaagcccggcggagaccgcctcgctcggccacttccggcaagggcggaccggcccagtggtgcgcgacccagataactccctggagaggcgggatgt

SEQ ID NO: 1545 - DNA, 353 bp, Homo sapiens
acaatccgggaaagtcgctgtggacttgccacgtttgtcatcatcctgctcttggttttttgtcacagaaggttgttgtagtggttttggggatatgtttacagagcaaaggtggaaaatgaggttgatcgcagcattcagaaagtgtataagacctacaatggaaccaaccctgatgctgctagccgggctattgattatgtacagagacagctgcattgttgtggaattcacaactactcagacttgggaaatacagattggttcaaagaaaccaaaaaccagagtgtcctcttagctgctgcagagagactgccagcaattgtaatggcagcctggccacccttccgacc

SEQ ID NO: 1546 - DNA, 358 bp, Homo sapiens
ggaagggggagaggagagaagaaagggaagaaggaacacccaccatttctgtccatgagaccaaccacccaatcactggaatggcaggctacatttataccctgtcccgaagagtttgcagaaatagctcttccagatctagagaagtgtgagtttatttttttttaacccaaaacatttccaaattctgagaaggaaaaatgtcttagtgtcgcaagagccaaatggtagaggcaatagttgagtcctatacaatgttattctccaagtgtaaaccttccagatcggtttttcacatttagatttgcaagacgccagcaatgtcagagccaaactatcatcctggttaactttctga

SEQ ID NO: 1547 - DNA, 229 bp, Homo sapiens
ggaagggggagaggagagaagaaagggaagaaggaacacccaccatttctgtccatgagaccaaccacccaatcactggaatggcaggctacatttataccctgtcccgaagagtttgcagaaatagctcttccagatctagagaagtgtgagtttatttttttttaacccaaaacatttccaaattctgagaagggaaaatgtcttagtgtcgcaagagccaaatggt

SEQ ID NO: 1548 - DNA, 344 bp, Homo sapiens
gttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgcccttttggctttggtacctacaccagcccttttttacttgttcactgcaaaatttaccgaaccttcaaggatactctcagaaggagccaatggacactgagtgtagacaatgtgaaatgccaaaacctgagagtgctcctaataaaaaggtaaatcaatcttaaaaaaaaaaaaaaa

SEQ ID NO: 1549 - DNA, 364 bp, Homo sapiens
aaattgcctgccttctcatggtgtttgtggcagtttctttgccaacactggccagtaatgtgatgtctcagtacagccctgctatagaagggcattgcaacaacatacattgcttggccaaagccatcaaccagattgctgcagctttgtttacaattcacaaaggaagcattgaagaccgtcttaaagaatttctggcgcttgcatcctccagtctactgaaaattggccaggagacagataaaactaccaccaggagatagagaatcctgattattgacctgctagatatgattgtacacggagtctccattccttacaatggatcttttgggaatcttgttgtccctatggcttgctgtgt

SEQ ID NO: 1550 - DNA, 268 bp, Homo sapiens
tccaccagatcggggatgcctactccaactcggacaaatccctcactgagctggagagcaagttcaggcagggccagggaacaggacagccggcaggaggaccaggctcaacgaggactttctgggaatgctggtccacaccaggtccctcctgaaggagacactgcgacatctctgtggggctcagggcaaatacgacctgcttggcccttaccattagggagccatgggaccgactaggtcggctgagagtgagttatcttaagtg

SEQ ID NO: 1551 - DNA, 267 bp, Homo sapiens
ttacaccatggtataaagtgggcatttaatatgtaaagattcaaagtttgtctttattactatatgtaaattagacattaatccactaaactggtcttcttcaagagagctaagtatacactatctggtgaaacttgggattctttcctataaaagtgggaccaagcaatgatgatcttctgtggtgcttaaggaaacttactagagctccactaacagtctcataaggaggcagccatcataacatgtgaatagcatgcatgggta

SEQ ID NO: 1552 - DNA, 230 bp, Homo sapiens
atcagatggataatgtcctatttctctagtattctattcactttacacctatcttaaaggattaattttgttatatcaattacctaatagtcaagcttggggtgaaaggaattttatccatctaaatgatttggtatttatataggtaggattgatttatctgagattccccattggtccagtatgtcaccaccatcccctttgatagtatgtattttatagatataaat

SEQ ID NO: 1553 - DNA, 560 bp, Homo sapiens
aatccaagaatggataaatgtccttattttcttctagtattttcttatttcacttttacacctatctttaaaaggaatttaaattttgtttatatacattaactaaatcagtacaagtttggggtgaaaaggaaatttttaatccatctcaaatgtatttggttatattatataaggtagggatttgattttatttcgaagaatttaccaattggttcagtatgtgaaaccaccatttcccctctgattagtaatgctatttttatagaatattaaattcttatgtgtcttttgtgtcttaggccaatttctgggccttctgggttttttctacactgtcaataattatcgctttaattggtgttaatatttggtagtacacagggtctcccttgttcctttaaattttgtgaaatataacttacaaataagtacttaaaacagagcttaatgggtaaagcaacagctgtgtatcacaaactagatgcagaggaggtcttgccagcactccaaaatctctgtgtgcccctctgacactcactgttcccccagagcaacta

SEQ ID NO: 1554 - DNA, 316 bp, Homo sapiens
atattttccccagttttttagccattgtgactaaagctgctatgaacatcattatatgagtctttgggacatatgctttaatttttccatggggtaaataccaaagaacggaatggctagatcatatagtagaatttaattttgattaatttctaactaacattaaatggccaaatgtggctagtgattaccatattggacagcacagttccgagtatattctttaatcagtgattctgtacaggaaagactcccctcttctgtaaatctgatttatttgctcatcatcacttggcaaggtttttgggggtcactt

SEQ ID NO: 1555 - DNA, 378 bp, Homo sapiens
ctaatttaagctgaaaggaaattatttagggatatatagataagtcactgtacccttgagatgactgaagaaacaaacaaactctagactgagattcctaggatgactgttagctctccatactgtagtacaagtcctccaaaggggcgacacaattgacacaatcaggagcactaagtcagtaggctgccacagactcccacggctcctagtaacagagtacataatttctgccatagttcagacactgctgaattaggactgccacacagctgccagtttcaggtatgctcttactgccacaatcagcatgagagagggggtatccattgtgtatctcttccctgtgtaatcagcagatcatgtcatagcagggca

SEQ ID NO: 1556 - DNA, 510 bp, Homo sapiens
ctaatttaagctgaaaggaaattatttagggatatatagataaatcactgtacccttgagatgactgaagaaacaaacaaactctagactgagattcctaggatgactgttagctctccatactgtagtacaagtcctccaaaggggcgacagcaattaacacaatcaggaagcactaagtcagtaggctgccacagaactgccacggctcctagtaacagaagtacataatttctgccatagttcagacactgctgaattaggaactgccacaccaagctgccagtttcaggatatgctcttactgccacaatcagcatgagaaaagggggatatcccattgtgtactctttccctgtgtaattcagccagaatcaatgtcataaacagggacatatgattttcaaaacccaaatcactaaaacacatcctacaagcaaggtaaccagaaaagggagcctgatagatttcactccgttatgatgagatttacaccttgcaaacaaacaa

SEQ ID NO: 1557 - DNA, 378 bp, Homo sapiens
ctcgtgccgaattcggcacgagggaaacatttacacccagtcagcttgaagagtttcaaatggaccctaccacttgagaaatcaaggctagcagtctactatggggaattgaggaaaaatggattaatacaagagtcctgtgataatatacaacccaggacagggttcttttaacatggattccatgcagtgaattgagacataggtttcttacccaacacaaatggacagtggatttgactttctaagactttttttgtggacatttgacatttgagagaagatgcacactaaccagatatagttttatgcctggaatttttgcagtttgattgaatcgtatacctctgaaatgttaattttaataaattgtacact

SEQ ID NO: 1558 - DNA, 253 bp, Homo sapiens
ctgactttgtcttctccgcacgactgttacagagggctccagagccttctctctcctggtgcaaaatgggcaactcttaagggaaaactcattgcaccagttgcggaggaggggggcaacagttcccaaacaataagggtcactgtgatgggggtttgggacaaattggtgtggctgttctatcaacatctgggggaatgcttgggctatgaaacctttcctctgggggttttgggagatgaaacttaaaagg

SEQ ID NO: 1559 - DNA, 273 bp, Homo sapiens
gcagagctgagttcaattcctgggtatccttgttgactttctgtctcgttgatctttctaatgttgacagtggggtgttaaagtctcccattattaatgtgtgggagtctaagtctctttgtagggcactcaggacttgctttatgaatctggggtctcctgtattgggtgcatatatatttaggataggttaactcttcttgttgaattgatccctttactattatgtaatggcctctttgtctctctggatctctgttgggttaaagctgt

SEQ ID NO: 1560 - DNA, 275 bp, Homo sapiens
caggccacgccttcagaagaggccaggcacaaagcacatgttatgtcattctatttgtatgaaatgtccagaatatttgtgggcagatttcacacacagggaaaaaaaaattgtcccgattgggcaattccttagggacagaaggcggttggtggttgcttagggttgggggaggatgagactcgtgccgaattcggcacgggcaaccattgagaggtgttacaagattgcagttaattttaacatgtgttaatgtgccatgggggaaagctact

SEQ ID NO: 1561 - DNA, 316 bp, Homo sapiens
aactactgtccgctaactagttatccaaattgtaaagctacagaagcccagttgaggggtaagtgtgcctggctcacacagcctgcaccctgtcacctcggcaatgagccagtgttggggcactggggacttctaacccttggattgctctttttgacctgtgcataccttctaattgtaaaatatatttcagaccgtggagtaccttgagatctgagcaactgtgttaattgaagtattaccaatggtccacaagtgaaagatgtttttgggggttgcaaaacaagaattccgtcactctttaataatgtcacag

SEQ ID NO: 1562 - DNA, 249 bp, Homo sapiens
ctgtgggaggatgaaggagtccgtgccttctacgaacgctccaacgagtaccagctgattgactgtgcccagtacttcctggacaagatcgacgtgatcaagcaggctgactatgttccgagcgatcaggacctgcttcgctgccgtgtcctgacttctggaatctttgagaccaaggttcagggtgacaaagtcaactttccacaatgttttacggtgggtcgccaccgccatgacgcccgcaagtgg

SEQ ID NO: 1563 - DNA, 110 bp, Homo sapiens
gaagagtgacagttcagttaggggtgtgaacttccagaggagcactgctttaagctggaaccttgaggagccattgtggcaaaaaggcacagttaggtctggttaaggaa

SEQ ID NO: 1564 - DNA, 102 bp, Homo sapiens
cttttatttttccttacacaatgacgtgttgctggggcctaatgtttctcacataccagttgaaaacccaaattttgttgttcatcttttcaaaggaattcg

SEQ ID NO: 1565 - DNA, 102 bp, Homo sapiens
accacgtagaatcctcaaccgtgcggaccatcaaccttcgagaaattccagttgtctttttccaagccgaatcctgcctgtagatggccggggagggcttct

SEQ ID NO: 1566 - DNA, 100 bp, Homo sapiens
ccaaagtttcattgcattctcccttggggaggctgtgagagagggcttgtatccctcttgtgctaagcagactctactcctaaactgacttcaatatttt

SEQ ID NO: 1567 - DNA, 100 bp, Homo sapiens
gagaatcgatagggttaattttggagcagtggcttataccattcacctctgtttttttgtgattatttcacagataatgagaccttaataacaaataggg

SEQ ID NO: 1568 - DNA, 100 bp, Homo sapiens
ccgcagcacccaccccgcaccggcgactccatcttcacggccaccccctgcggcggacggttgaccaccagccaccacatcatcccagagctgagctcct

SEQ ID NO: 1569 - DNA, 100 bp, Homo sapiens
cttgcaggaaaataatctgagtcccaagctagcctgtgctcatccacaatcacaatgaacatgtcaaggaagaatttgcagagactcaagggaagcacaa

SEQ ID NO: 1570 - DNA, 100 bp, Homo sapiens
caggagagtcccatcagcaggcggcattggagtctaggagctcagctgtgtgtccatcaacacacaaattcgtaaaaaacacacatggcctcgccatcgg

SEQ ID NO: 1571 - DNA, 100 bp, Homo sapiens
aattgatgtttagtttgctttagtcatttaaaaagatattgtaccaggatgtgctattaagagcacgtatccattattcttctcaacccaagaaccttgt

SEQ ID NO: 1572 - DNA, 111 bp, Homo sapiens
ccaaagaattcggcacgagccacggctactcaggtcctcttgaaatccgtcctctccatggacttccacatccctctctgctctaggtttgattaacagaaggttgtaaat

SEQ ID NO: 1573 - DNA, 303 bp, Homo sapiens
cgtccgccgattcctcctccttggtcgccgcgtccttggctggcgtcagaaaaatggctacaaacttcctagcacatgagaagatctggttcgacaagttcaaatatgacgacgcagaaaggagattctacgagcagatgaacggtcctgtgcaggtgtcctcccgccaggagaacggcgccaggtgattcctccgtgacattgcgagagccagagagaacatccagaaatcctggctggaagttcaggcccggggcctccagcggcaccagcggagaccacggtaggttgtgtccggattgc

SEQ ID NO: 1574 - DNA, 304 bp, Homo sapiens
tcaaaggcatgacttgctcatttttgcacctccaatacatagcccagtacttggtatttggtggatatccagtaactgtttattggatgaacggatgaatatatcactgagtagtaggaaacagggagccatcaccaggatgtattacaccagtattcgaaatagataagctaagcagtgggaggtatatgagtttgtggggagaaaagtaggaatcacatgggtcggacggaaggctttttcaataattcagacttagatttgggtgtggtgacacacagggataagaggtcaaatgatcgtg

SEQ ID NO: 1575 - DNA, 220 bp, Homo sapiens
tcaaaggcatgacttgctcatttttgcacctccaatacatagcccagtacttggtatttggtggatatccagtaactgtttattggatgaacggatgaatatatcactgagtagtaggaaacagggagccatcaccaggatgtattacaccagtatccgaattagattagcctaacagttggaaggatatgaatttgtggggaagaaagttaggatcaca

SEQ ID NO: 1576 - DNA, 123 bp, Homo sapiens
agaaaggggaaaggaacacgcgggtagatgatttctagcaggcaggaagtcctgtgcggtgtcaccatgagcacctccagctgtactagtgccattggaataataaatttgataaggtggtga

SEQ ID NO: 1577 - DNA, 313 bp, Homo sapiens
cggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaac

SEQ ID NO: 1578 - DNA, 313 bp, Homo sapiens
ctttttccaggctttaggtatcaccactaaaatctccaggggcaccattgaaatcctgagtgatgtgcagctgatcaagactggagacaaagtgggagccagcgaagcacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattcta

SEQ ID NO: 1579 - DNA, 104 bp, Homo sapiens
ctagtctcgagagtacttctagagcggccgcgggccatcgattttccacccgggtggggtaccaggtaagtgtacccaattcgccctatagttagtcgtattac

SEQ ID NO: 1580 - DNA, 249 bp, Homo sapiens
acaagaattatatggattttgtgcctgagaataatagagcttgagctgtctgaactattttacattttatggtgtctcatagccaatcccacagtgtaaaaattcaggaattcaatgagaaaagtctacccttaaaccctcagatcagtctttccaaagagttactctgtttgcattgttgtgattgacatttgtgaagtccaagagaagatctgttttcatgacaagtggaaatagagtttgcaaatt

SEQ ID NO: 1581 - DNA, 290 bp, Homo sapiens
caggagccggcagacctgtcacccgcaggtggggtgagtcttggagcttccagaggggctcaccgaaatcggggttccatcacaagctatgtttaaaaaggaaaattggtatttggcaaacggaacacaacctttgatgagagctttcacagggacactgtctgggggttcagttcaagctccccggcctcttccctgggaacctctgaactcctcctctctctgggctctctgtacaattcacacacgtcagcatctaatcccaagacaaacattccgctgctcgagca

SEQ ID NO: 1582 - DNA, 167 bp, Homo sapiens
ggacaacctcaagggcacctttgccacactgagtgagcttcacttttacaagcttgcacgtggatcctgagaactttaggcttctgggcaacgtgcttggcttgtgtgcttggccatcacttttgcaaagaattcaccccaccagatcaggctttccattttagaag

SEQ ID NO: 1583 - DNA, 165 bp, Homo sapiens
ggttttgtctgagttcaaactagtcccttgttgttacggaagcagccagtttaccagtgtcactctggagtacagcgggagaaacacaaaatagtatacctgaaaacattacattcagacacactccctctgccttccggcttaaagcctgtggatgatccacgt

SEQ ID NO: 1584 - DNA, 302 bp, Homo sapiens
caggttttgtctgagttcaaactagtgcctgtgttgttacggaaagcagcagtgtaccagtgtcactctggagtacagcgggagaaacacaaaatagtataactgaaaacattaacattcagacacactcccttctgccttccggcttaaagctgtggatgatccacgtttttgtttttttaatgttaaatgtgtactcagtattactgaaaaggtaccacattttgatagtagttatcactcttaggtcagacagccatcagatatctccacaccaagtagctgtacgtagtgggggaaac

SEQ ID NO: 1585 - DNA, 155 bp, Homo sapiens
ctcgaaagtaacagattaatttccaattcttactttaagttttatagcatcccatttttctaaagtttcccttcctgtactaaagagtgctatcttgctactcagcagagaaattcagaaactcatttctatcaacaacatactcattaggctca

SEQ ID NO: 1586 - DNA, 213 bp, Homo sapiens
gtcaagctcacagtcaacaaagggttgagtaaccatttccaggtcaaccacacagtagccctcagcacaatcggggagtccaactaccacttcggggtcacatatgtggggacaaagcagctgagtcccacagaggcgttccctgtactggtgggtgacatggacaacagtggcagtctcaacgctcaggtcattcaccagctgggccccggt

SEQ ID NO: 1587 - DNA, 201 bp, Homo sapiens
cggccgcgaaggtggcaagaagaagccactgaaacagcccaagaagcaggccaaggagatggacgaggaagataaggctttcaagcaggaaacaaaaagaggagcagaaagaaactcgaggagctaaaagcgaaggccgccggggaaggggcccttgcaccagggtggaattaagaatctggcaaaagtaagctgcttcct

SEQ ID NO: 1588 - DNA, 202 bp, Homo sapiens
ccacctcctgtgccaatgtcccaccctccacctgggggtggggtgcagcttccacttactgattagaagacaccactgccctcccttcccccctccctgtctgggtgtcctgtgcccccatcgtgtcgtgtcgtatatttggtcgtggtacgtcccctagggggaagggatttttgcccaatartataaaaaccacgtggtc

SEQ ID NO: 1589 - DNA, 317 bp, Homo sapiens
gggaattaggcaaggtttcctacattgttgcatctcagctgaggcttgaaggaggctgatgtagtagaagttggaagaggagtgttttcaggcagttgcaaacgatgtggaaaatttggatgacaaaagagagcaagcagcctgggcaacatagcgggaccccatctctgcaaaacaaacaaacaaaattagccaagtgtggtagcccacaccttgctttaacctgggaggtcgaggcttcagttagccatgattgtcccactgttctccaacctgggtatctcaaaaattttttttaaaaagggcagcatatgtgg

SEQ ID NO: 1590 - DNA, 312 bp, Homo sapiens
ttctcgtgcaatttcggccacgttggggccatgactcacatcgtgcgggaagtcgacaggccgggatccaaggtgaacaagaaggaggtggtggaggctgtgaccattgtagagacaccacccatggtgtttgtgggcattgtgggctacgtggaaacccctcgaggcctccggaccttcaagactgtctttgctgagcacatcagttatgaatgcaagaggcgtttctataagaatttggcataaatctaaggaggaggcctttaccaagtactgcaagaaattgcaggatgaggatggcaagaagcagct

SEQ ID NO: 1591 - DNA, 302 bp, Homo sapiens
aagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccaaaaaaaaaaaaaaaacctggggggtacttgtgggggggccggggcccattggttttccccccggggggggtcccaggtaagtttcccaattcgccctatagt

SEQ ID NO: 1592 - DNA, 331 bp, Homo sapiens
ggaagattacctagacgcatgctttccagacagggcgttttggctgcatcacagccactggctggttcctattcatttccattttttatgtatgttttgaaaagaaaaggtccggggatggtggctcacacctgaaatcccagcactttgggaggccgaggcaggaagatcattgagctcaggagtttgaaaccagtctggacaacatagggagaccccatctctaccggagagaaaaaagagtcaggcctggtggtgtgcgcctgtaatcccagctactcgggaggctgaggcaggacgattacttgagcttggaaatcaaggttgcagt

SEQ ID NO: 1593 - DNA, 308 bp, Homo sapiens
agaacgtgagcaagcccaggcacagccgacgccgcgggctttgaaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacaga

SEQ ID NO: 1594 - DNA, 116 bp, Homo sapiens
ggttccaaagatcttcggcacgagatcttcggattaagttttgacatacttacccccagcttcttgagaacggggtttttcaaaggacgcgttattagggccctcacccatcggca

SEQ ID NO: 1595 - DNA, 433 bp, Homo sapiens
actttggaataagttcttacataaatacccccagccttttgagaacggggcttgttaaaggacgcgtatgtagggcccgtacctactggcagttgggttcagggaaatgggattgacttggccttcaggctcctttggtcataattttaaaatatgggagtagaaaacaacaaagaatggaatggactcttaaaacaatgaaagagcatttatcgtttgtcccttgaatgtagaatttgtttttgatttcataattctgctggtaaatgtgacagttaaaatggtgcattatgtatatatattataatttagaaataccattttataattttactattccagggtgacataatgcatttaaatttgggatttgggtggagtattatgtttaactggagttgtcaagtatgagtccctcaggaaaaaaaaaaaa

SEQ ID NO: 1596 - DNA, 301 bp, Homo sapiens
ggggggcgggctcccgcggtcctgctcggcggagtggcctctctgctcctgtcttttgtttggatgccggcgctgctgcctgtggcctcccgccttttgttgctaccccgagtcttgctgaccaatggcctctggaagccctccgacccagccctcgccggcctcggattccggctctggctacgttccgggctcggtctctgcagcctttgttacttgccccaacgaggaggtcgccaaggagatcgccaggaccgtggtggagaagcgcctagcagcctgcgtcaacctcatccctcag

SEQ ID NO: 1597 - DNA, 298 bp, Homo sapiens
cagctgccctggctgtgatgagtgtccttgcaggggccggagtaggagcactggggtgggggtggaattggggttactcagatgtaagggattccttgttgttgtgttgagatccagtccaggttgtgatttctgtggatcccagcttggttccaggaattttgtgtgattggccttaaatccagttttcaatcttcgacagcttggcttgaacgtgaactcagtaggttgaacctgtctgacccggtcacggtcttggatcctcagaactctttgctcttgtcggggtgggggttgg

SEQ ID NO: 1598 - DNA, 305 bp, Homo sapiens
catctctcgggacaactggcacaagcgccgcaaaaccgggggcaagagaaagccctaccacaagaagcggaagtatgagttggggcgcccagctgccaacaccaagattggcccccgccgcattccacacagtccgtgtgcggggaggtaacaagaaataccgtgccctgaggttggacgtggggaatttctcctgtgggctcagagtgttgtactcgtaaaacaagggagttctatcgatgtcgtctacaatgcatctaataacgagctggttcgtaccaagaccctgtgaagaattgcatcgt

SEQ ID NO: 1599 - DNA, 195 bp, Homo sapiens
gtttacttaaaaaaattatgtctctctttttaaatttttaatctgttaacataagtggaggaaagaaatcaggcttccagaaagaggtcaacagaagcctttttaagcatatattgtattcccctaagaggtttttgaatcgtgacagtacagaccatacttaatcctctgtaaccccccaggcagggcaggctt

SEQ ID NO: 1600 - DNA, 570 bp, Homo sapiens
  misc_feature 42, 44, 80, 94, 139, 164, 167: n = A,T,C or G
gtttacttaaaaaaattatgtttttttttttaaatttttaancngttaacataagtggaggaaagaaatcaggcttccanaaagaggtcaacanaagccttgttaagcatatattgtattttttaagaggttgttgaancgtgacagtacagaccatacttaanccnctgtaaccccccaggcagggcaggcttgccccttgcaccaggtcctatgcttctgaagcactttgcttgttccacagaaccattagacccatactcagagtatgaagcagaaatcacaatcgaaattgtccctgaggctccctaaatctctcacaaaaaacagctaatccgtattccaatttacccggtcctatatgtatgtatgtgtaatgtgtatgtagaaattaataatgcctgaagtaggtggtttgagtttggaggctttgttatatgaaaaatttgtacctttaaacagtagcatccagctcagtgcagagaaatgagaagcgtaaagaaccagtgcctgactgtaggagggtacaaggcccggggcttcaatccaagtgtactcgggtgtgcatgc

SEQ ID NO: 1601 - DNA, 202 bp, Homo sapiens
ttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtc

SEQ ID NO: 1602 - DNA, 299 bp, Homo sapiens
gcgtgcttatgctcctgtactcttcagagaagaaaatcttcattggcctcatcccccatgaccagggcaactttgtcaacggcatccggcgtgtcattgccaaccagcagcaggtcctgcaggcggaacctggagcaggagcaacagcaacgagggatgggggggtagtggttaccccgggctgggccctccaggagtcacagatgaggcccccgcagagatctggtgaacaggcttcttagcaggggcccctgggacttcaactgcccagcaacatggaggatggtgtcctgaggcct

SEQ ID NO: 1603 - DNA, 299 bp, Homo sapiens
tgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctttgttcattgtggacaaagttattattttgcaacatctaaagctctttacgaatggggtgacaacttatgataaaactagagctagtgaattagcctatttgtaaatacctttgttat

SEQ ID NO: 1604 - DNA, 148 bp, Homo sapiens
cgcagcttggccccctcttcagcccagcagttctccgcagcgttttgccgcgtgactgctggcagacgaaagggctttaaccgcggcttaccttagccctttttaccctggcctagtttcgcaagcatccgctgaggccgccagcccc

SEQ ID NO: 1605 - DNA, 580 bp, Homo sapiens
cgcagctcgagccctcctccagcccagcagtgctcccgcagcgtctggccgctggtcgtcggcagacgaaagggcttgaaccgcggctgaccttagcctttgtccctcggcctagttccgcagctgccgtcgaggccgccagcccctcccccagcatgtttgggctaagccgcctcctttccgcctgcgttggagagagaggtaccagaaggaatgaaaggactggggcttgtctccatggcaactgaaagaggtgggttataaatccttcgccaccctcctgtggcgaaggaggggaagtgggagccgggaagtagagttggcttttgcaggagagtctggagcccctttctgggtgatgcattgggggccatagaaggatttggctgccgctttggagcatggattttttttttaaacatcttcctttctcttttggagagaaaaattggtcacctccaaggactgagaacctgacccttccaaggcaatccccaactaccaaaaggctggccaaagcccgggaagggatcccaatcccgttcctggaactcctgagggtcaacttccctcaactccg

SEQ ID NO: 1606 - DNA, 295 bp, Homo sapiens
gcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccct

SEQ ID NO: 1607 - DNA, 293 bp, Homo sapiens
taaagtggccacatttaagaaggccaagctttgtagtggttgcacagtcacactgatatgctgatttgctctttctcattgtatgtctatgctttgtcatcagtgctatagtaaattacaaagaaataggtagattgtatgagcatacccacaaatgcctatgatttaggttaccaatgtattctttctcatttggggttttgcttctgtctgtctgtttattggaaacttgtacttcaagtagggggaatcctaattctaataactccttagctaagttttattattcaggc

SEQ ID NO: 1608 - DNA, 294 bp, Homo sapiens
ggtttggtctgggagtcagcaggcatggagtttagttccgttgtattagtcgaaggtcttcaacaaatcatgttagccgtttgagccttggcttccatttataagagagggttgaacaacattccagctctgccagtcttacatacccagagcccttcctcagccggggagtctcctagtgggacattgtccttaagccagccttggttttgctctgcgtaggttttgtgctttgtgacaggtcattcaggcaatgactgcatacctagactaggtgttgtcaggggaaaggag

SEQ ID NO: 1609 - DNA, 297 bp, Homo sapiens
ctgccctgaccaccttcgtggcaggggccatgatgatgccctccacagttctagcttacacccagctgggcaccttcatgatgctcatcatgtgtatcagttgggctttcgccaccttctttttccagtgcatgtgccggtgccttggaccacagggtacctgtggtcagatttcctttacctaaaaaactacagtgcagtgccttttcccatgccttgtctacaggtgccagtgacaagggacaaagcagcacacataccataaatgcttatcatttagatcccaggggcccaaaa

SEQ ID NO: 1610 - DNA, 620 bp, Homo sapiens
ctgccctgaccaccttcgtggcaggggccatgatgatgccctccacagttctagcttacacccagctgggcaccttcatgatgctcatcatgtgtatcagttgggctttcgccaccttctttttccagtgcatgtgccggtgccttggaccacagggtacctgtggtcagattcctttacctaaaaaactacagtgcagtgccttttcccatgccttgtctacaagtcccagtgacaagggacaaagcaaaacacataccataaatgcttatcatttagatcccaggggcccaaaatctgaactggagcatgagttttatgaattagaacctctggcttcccacagctgcactgcccctgagaagacacttatgaagagaccacatctgctctgaatttttcaacagccaagcaaagaatttagggatgcctgtgcatgcagcttacaacagtgaactcagcaaaagcactgaaagtgacgctggctctgccttgttacagccccctcttgacagcataccgtgtgtcacttcttctctctgaatcagagatgtagctgccccgatgcctacaaacacttgactatgggccacactcctgcagcagatgggggactgctt

SEQ ID NO: 1611 - DNA, 298 bp, Homo sapiens
ctcgtgccgaattcggcacgaggcttcgggagccgcgacttatggtgcagacatggccaagtccaagaaccacaccacacacaacgagtcccgaaaatggcacagaagctggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaa

SEQ ID NO: 1612 - DNA, 284 bp, Homo sapiens
ctggagggtctcgtctgaggacgggaggaggctctcgctggacgtctggcctgtgcgctggtggacggatgcctacgtggttttggaggacccgatgaccaggcgtcctgcgagtccgcccgctggcctgcagcacccacctcggacttggctgtggacggttggtgcaagtgcatcctgcaggctggctgtgcgcagtgtgggctgacctttgcagagttttgtggagtagtttgcaatgtcataaaagtgcaataaaggtacagcagatgtgaaaaaaaaaa

SEQ ID NO: 1613 - DNA, 297 bp, Homo sapiens
caggtttcagcatctgccattagatttgagacacatatttgagtccatgaaacacctatcaagggaggctttgataatatcagtgtaattaaaatgggtatcaggtcccctctattcctcttgagtttgttaatacttttcttcctagataattacagttgcacagtttttcaggcttattggtataaagttgctcaaagtactcatgatttctaagtttcatatagctctcgttctcttttacttaatcctaatcggttttgacccgttctattccgtcctattttatctcattca

SEQ ID NO: 1614 - DNA, 517 bp, Homo sapiens
caattttcagcatctgccattagatttgagacacatatttgagtccatgaaacacctatcaagggaggctttgataatatcagtgtaattaaaatgggtatcaatttttttctatttttcttgagtttgttaatacttttcttcctagataattacagttgcacaatttttcaggtttattggtataaaattgctcaaagtactcatgatttctaaatttcatatatttttgttctcttttacttaatcctaatcgtttttgaccctttctattccttcctattttatctcattcatttgtatttctgtctttatttctgttcttatagtttccttacatttatctagctgtttgttaagagacagagtcttgctctgtcacccaggttggagtatggtgatgctatcacaactcattgcagcctcaacctcacagctgagctcaagtgatcctcccacctcaacctcagtagtagttggaactacaggtgcaggcagcatacctagctaattaaaa

SEQ ID NO: 1615 - DNA, 294 bp, Homo sapiens
ccacctccaaaaggtaggggtgggactggaggcgtccctaggtcaggccgttgagttcgagctccgatgggccaccttgaatccaggactgaccgcccgtgtgtgcacagtttgttcttggacgaggactcgtgaggatcgagggctggggacccggtgtgagcaggatggggccctgcctcccgtgggagttgtggactcgagcccaggggctgcccgtcacagcggtgtcccaggtccctgccatccgattttacctgggatgtcttctctggagtttggaattgctttagg

SEQ ID NO: 1616 - DNA, 296 bp, Homo sapiens
ggaccagtccacctgaaccacacactctaaagaaatattttttaagataacttttattttcttcttactcctttcctcttgatttttttcctataatttcattcttgttttttcatctcattatccaagttctgcagaccacacaggaacttgcttcatggctctttagatgaaatagaagttcagggttcctcactctagtcactaaagaaggattttactctcccagcccagaaaggtgattctttctttaccatttctggggactttagtcttaattaggtaccttattaaca

SEQ ID NO: 1617 - DNA, 297 bp, Homo sapiens
ccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggttgcttttggaaacatgtgtcgt

SEQ ID NO: 1618 - DNA, 175 bp, Homo sapiens
cggcacgagacttcttttctctcttatttattaaccatggtctgagagttgtttttgttctatgtaacagtattgccacaaaactataggcaaatcgtgtttgcagggagatttctgtatgcctcttttggggtgttttttaagttaaaggtgtgccacattttaagagaggcca

SEQ ID NO: 1619 - DNA, 119 bp, Homo sapiens
cttgcggcatccacgagaccaccttcaactccatcatgaagtgtgacgtggacatcccgcaaagacctgtacggcaacaggtctttcgggcggcaccacattttattccggcatttccc

SEQ ID NO: 1620 - DNA, 153 bp, Homo sapiens
aggagatggtggtcacggagcatgtcagtgacaaggaggcccttgggtccttcatctaccacctgtgcaacgggaaagacaacctaccggcttccggcggccgggcaacggggaggcggatcaacaagcttggggccaaggacttccaattcc

SEQ ID NO: 1621 - DNA, 149 bp, Homo sapiens
cgggaagggcctgtcccagtcggctttaccctatcgacgcagcgtccccactttggttgaaggttgacatcttacgacgtgaaggagcagatttacaaacttggccaaggagggccttacttccttcaaaaggtcggtttaattcttag

SEQ ID NO: 1622 - DNA, 166 bp, Homo sapiens
cgaagatggcggaggtgcaggtcctggtgcttgatggtcgaggccatctcctgggccgcctggcgcattcggtggctaaacaggtacttcttggcccgaaggttggtggtcgtacgcttttaaggcattaacatttcttggcaatttcttcaggaacaggttaagg

SEQ ID NO: 1623 - DNA, 109 bp, Homo sapiens
aagaaaatgaggaacagaataatcaagaatgaagttaagaagcttcaaaaggcagctcttctgaaagcttcttccaaaaaagcaccttggtacttaaggggtacttctg

SEQ ID NO: 1624 - DNA, 132 bp, Homo sapiens
agctcctgagggaagctgggcctgagctcagttctgagtaccgggcccttggggcttgctgtacaacttgcttccgggaacaaggaggcccgttgcgagagaaccttcttggcccttgaagccgttcgttgc

SEQ ID NO: 1625 - DNA, 114 bp, Homo sapiens
gcctcctgcactgccacccagagcttctctaccttccggtagccctagacttggggtcaggggaaggtagaactggagcttttacaggaataaaacccaagagtttcattatta

SEQ ID NO: 1626 - DNA, 139 bp, Homo sapiens
gaccaatttaagaacttcatatacatggaatcatatagtgatttgtccttttgtgaatggtttatttcacttactgtaatgtcttcaaggttcatccatgttgtagcatgcgtcagaattttctttctttttaaagcag

SEQ ID NO: 1627 - DNA, 319 bp, Homo sapiens
cggcacgagctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttgggtttctactgttatgt

SEQ ID NO: 1628 - DNA, 298 bp, Homo sapiens
gctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgta

SEQ ID NO: 1629 - DNA, 318 bp, Homo sapiens
ctggatcctttgagtcaatcctccttattttagtaacccgtttacttgagtgccagaggttcttgatactgttgatttcttgagaattccaaggtgtgcatctagttggttctcaattttctctagtgtgggttggagattttgctttctggggcctgctaagtctgttaccattcttccatctgcttgcaaacatcgtggtctgctctcctgttatttgtgtgtgtgcacgtatgtgtgtgcatgtgtgtggttggatgtatgtctgtgcatatgtgtgtgtgtgtgtgaatctgtttactatcattctggtggact

SEQ ID NO: 1630 - DNA, 154 bp, Homo sapiens
cacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattccca

SEQ ID NO: 1631 - DNA, 313 bp, Homo sapiens
gtgagaataaaatggtctgtgagcagaagctcctgaagggagagggccccaagacctcgtggaccagagaactgaccaacgatggggaactgatcctgaccatgacggcggatgacgttgtgtgcaccagggtctacgtccgagagtgagtggccacaggtagaaccgcggccgaagcccaccactggccatgctcaccgccctgcttcactgttccctccataccacccctcttctaggatagcgctcccttacccagtcacttcttggggtcacttggatgcctcttgcagggtcttgctttctttgacct

SEQ ID NO: 1632 - DNA, 314 bp, Homo sapiens
tccgtttgtcccctcagattcactcttcacttagggtggaggtcatctgtgcaatgaaggaactgcttgatcttgcttcactgtacagttgggaacccgtaagaaaagacagatctaaagatagatgttaaaatagccaggatagagtgttgccaggactgccctggaggagacgactatacgctgaaagcttattggaccttgcaggtccatgctggcaaaagcctgggcagcaggagtgggagtcggtccaaggcggtggacccaggagcaaaataaaggtcttgattggacttaattcattgacatgagat

SEQ ID NO: 1633 - DNA, 613 bp, Homo sapiens
tccgtttgtcccctcagattcactcttcacttagggtggaggtcatctgtgcaatgaaggaactgcttgatcttgcttcactgtacagttgggaacccgtaagaaaagacagatctaaagatagatgttaaaatagccaggatagagtgttgccaggactgccctggaggagacgactatacgctgaaagcttatgggaccttgcaggtccatgctggcaaaagcctgggcagcaggagtgggagtcggtccaaggcggtggaccaaggagcaaaataaaggtcttgattggactgaattcattgacatgagagtgctctctatggatttgggttccaagtgttgggttgaccacctgctagtggtgttgatattctggccttatcatggctccagataatgaggtcagaatgctaaaatgtccttgcacactgccgagggagggaggaaggagttggaatgcataaggacaggcatggtggtatggagctatgatgtgcagtctgctcagcatccctaatcttgcctgctgggagaagcagagctcacacttttcatcacagcattggcaagggaggcgccagcgtctttgaagagccctgtgcatggctgt

SEQ ID NO: 1634 - DNA, 294 bp, Homo sapiens
acatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgttgcaggtgaccattggcacacgctagagtttatggcagagctttacaaattaaaaaaaacctggca

SEQ ID NO: 1635 - DNA, 303 bp, Homo sapiens
ccacagcgctccgcccccatcctgcagcgccgacttcctgcacctgggggatctgccaggagagcccagcaagatgacagcctcgtccagcaacccagacctgctgggaggatgggctgcctggaccgagactgcagcgtcggcagtggcccccacgccagccacagaaggctcaccagctggattccctcctggggggcttcattccaaaacggccaccacgccaaaggcagcagctcctggcagaaagtcggccgccagcccaggcgcctatggcccataggccaagccgcccccaaagct

SEQ ID NO: 1636 - DNA, 318 bp, Homo sapiens
attttttagctttttgactagcatatgggccaggcgcagtggctcatgccgataatcccagactttagggagccaaggctggaggatcacttgaggccaggaggtcaggaccagcctaggcaacatagcgagactccacccccacctcttgtgtataaaaaaaaatttgccaggtgtggtggtgcacacatctagtcctagctactcaggggcctgaggccgaagatctcttgagcccaagagttggagttccagtagctatattggtgcctacactccagcctaggcaacctaccaacagagtagacctcttttcga

SEQ ID NO: 1637 - DNA, 224 bp, Homo sapiens
cggcacgagcaccaaactaccgcaacaccaggacccctcgcactccccggacaccacagctcaaagactcaagccagacatcacggttttacccagtggtgaaagaaggacggacactggatgccaagatgcctcgaaaaagaaagacaagacacagttcaaacccaccctttgagagccatgtgggctgggtgatggattcccgtagcacaggccccgtactg

SEQ ID NO: 1638 - DNA, 230 bp, Homo sapiens
gttggtgccccagaccaggaattcggcttcgacgttggccctgtctgcttcctgtaaactccctccatcccaacctggctccctcccacccaaccaactttccccccaacccgggaaaaaagaaaaggaaacccaaacttgaacccccttaaaaggcaaaaaatgggagacaatttcacatggactttggaaaatatttttttcctttgcattcatctctcaaacttagt

SEQ ID NO: 1639 - DNA, 199 bp, Homo sapiens
ctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaacc

SEQ ID NO: 1640 - DNA, 292 bp, Homo sapiens
ctctactccacgtaccccaaaaagataagctgtcctcagatcctccttctacccaggagggaaataatggatattgccaagggaacaatcagaactcatctggctttgaaaacgacctgccaagtttggctagcaggttcagacaacaagagagtaacaattggtggagagccacaggtagctggaaaagatactcccagctgacagggtgataaaaggcagggaagaattgggcctgtgctgatccaggaaggttttattgtttgcttgttttttgtatttactcgtgact

SEQ ID NO: 1641 - DNA, 130 bp, Homo sapiens
gccatgcttggggttaaaatttcaacatgggttccagaggagacaaactatattcaagccacagcaatatgccaactgagagaagatataagtacagacagattcagagtataacacagagctcggagat

SEQ ID NO: 1642 - DNA, 219 bp, Homo sapiens
tggagatgaagatgaggaagctgagtcagctacgggcaagcgggcagctgaagatgatgaggatgacgatgtcgataccaagaagcagaagacccacgaggattactagacagcaaaaaaggaaaagttaaactaaaaaaaaaaaggccgccgtgcacctattcaccctccacttcccgttctcaaaatctaaacgtggtcaccctcgagatagagagg

SEQ ID NO: 1643 - DNA, 185 bp, Homo sapiens
aagcattcaagagccaggcactacattagagtctgagaatacagcagtgaacaaaatacaattttaagtcttcattttttaaaaaagttattataagccaggagcagtggctcatgccctataatcccagcactttgggagaccgaggcaggcagatcacgaggtcaggagatcgagaccatcct

SEQ ID NO: 1644 - DNA, 196 bp, Homo sapiens
actcgtgccgaattcggcacgagctagggaccactgtctttaggagtttaatgagggcaaggaattgggtagtaggagacagggcagcaatagtgattaaacttttggtactaattggttgcaaatatgcatttgggggttaggaggccacttgttttggacgttgagctttgtagttggaacgattggacgttcc

SEQ ID NO: 1645 - DNA, 580 bp, Homo sapiens
ctcgtgccgaattcggcacgagctagggaccactgtctttaggagtttaatgagggcaaggaatggggtagtaggagacagggcagcaatagtgattaaacttttggtactaatgggttgcaaatatgcattgggggtgaggaggccactggtgttggacgtggagctttgtagttggaacgatggacgtgccctttgtgtgggggtcatgcagtcacgtgctcggtggctttcatgcagtgtcttcgtagggtggggagggatggcaggcattcagttggtggcaggttgtgttgggtcctttccaagctttgcttcattcaggctttaagcaggacctggcccgtgaggcacttggtgcagagtgagaacacctcggctgtccctgggaactgcagggacagagggtgtgtggcaagggtgacaagcggagaagcagctgtgggggctggcgagagcctctgtgccccagagtggaggaggaaagaagcgatgctcgaggtttgagtggagctgtgtgtgagaaagggccccttggtgctcactggacaggaagctgctgctgggcaatgctgtgctg

SEQ ID NO: 1646 - DNA, 192 bp, Homo sapiens
ctaggtcgcggcgacatggccaaacgtaccaagaagtcgggatcgtcggtaaatacgggacccgctatggggcctccctccggaaaatggtgaagraaattgaaatcagccaagcacgcaagtacaatttctctttctgttgcaaaaccaagatgaagacacgagctgttgggatcttgcactgtgtgttcc

SEQ ID NO: 1647 - DNA, 253 bp, Homo sapiens
cttttggaaggtctctgataatttaggggtgctggaaaccagcactgtgttatccccaatccctcctgtgccaccagttttgtgatttaggttgctttagtgggttactaacttttgttcaattaaaccagggtttgttttgggtttttttctttgctacttacatatttaaaggtacaagtttcttatttcaaatctctactgatagtgcccctatggggagatgctggaacacatatttgcaaatagtgac

SEQ ID NO: 1648 - DNA, 166 bp, Homo sapiens
caggactgggtcaacaggcccaagaccgtgcgcggcacgctgctggcgctgcaccagcacggccactcgggggcccttcgggagcaagtttaagaaggagccggccctgacttccagttgcaagaacagcaaggaaaaggaagccctctccagaacccagaagggt

SEQ ID NO: 1649 - DNA, 198 bp, Homo sapiens
cttggagagagcacccttggggcctccgtgtcggggtacacccagcacttttgcgacctgcggcccagcaggcgcggaggattggcggggaaggaagccagcagcccctgtcgtttaactgtcgtaagaaaggtcttgtgttttggttttggggtttttgttttgtttgtgttttgtttggcttgtttgtttttaaag

SEQ ID NO: 1650 - DNA, 342 bp, Homo sapiens
ccagcgtggtctgtttcatctggtgctcctgacaaaacccttcccagggcaaggactctctgagtccccccagagcctggcaagggaggtggtcttggccctaccctgacaccaaaaattatcttggagaacctctgccattccctggtgtgctgagagattctgaactggaacgtcttgtccatccaacataggcacgtcccagttcccccgtggagccacctacatatacagttccacacgggagcgtgcacggtgtgcggggcaccttgccaggctttgaaatgagcaggacccagcccctgactctcaggagtcctgttctaatagaggggtcgaggc

SEQ ID NO: 1651 - DNA, 601 bp, Homo sapiens
ccagcgtggtctgtttcatctggtgctcctgacaaaacccttcccagggcaaggactctctgagtccccccagagcctggcaagggaggtggtcttggccctaccctgacaacaaaaattatcttggagaacctctgccattccctggtgtgctgagaaattctgaactggaacgtcttgtccatccaacataggcacgtcccagttcccccgtggagccaccttcatattcagttccacaagggagcgtgcacggtgtgcggggcaccttgccaggctttgaaatgagcaggacccagcccctgactctcaggagtcctgttctaatagaagggtcgaggcaaacgcattctccagagaaggacaacgccaggcaaggggagaaaaaaaaatgccagcgagacacttttaaaagagggaaagtctgcatgtgcaaaaccattctttgaaatgatgcatttggttatgtgcatatttgttatgcatttgggtatgtgcatatttgttaatcctagctccgtgatttttaagtgtcctaaaccacagattttttttccaaataaaatctttcctgaaaacccccagtgtgtgtacagacatg

SEQ ID NO: 1652 - DNA, 241 bp, Homo sapiens
cctgtgcccttcagccctttcacctaacaggcccatattcgggcctttgcctgaccaaagagaagaaccgtatgttccctttactgcacggcctttatcctcctgggcccctggggcggggacctgagctggctgtttcctgctttgcctgcacattgtcctccttcctccaactcctcagggcctctctgtatctgtgcctggccagtggcagcactagcagtggtatgagcttatgcca

SEQ ID NO: 1653 - DNA, 244 bp, Homo sapiens
acctgacggtgcaactgcacagacatcagcagatggttcccaggctcagaatctggagtcccggacaataattcggggcaagaggacccgcaagattaataaccttgaatgttgaagagaccagcagtggggatcagaggcgggccccactggctgcagggacctggagtctgcaccagttccagtgaccactcagaacccacctggcgcacccccattgtgctctggcagacgcattggcttg

SEQ ID NO: 1654 - DNA, 219 bp, Homo sapiens
atttaaagctctgttgattttgtttccgtttggatttttgggggaggggagcactgtgtttatgctggaatatgaagtctgagaccttccggtgctgggaacacacaagagttgttgaaagttgcaaggcagactccgcatgtctctaatgctttgtatcattctggagcaatcgctcggtccgtggacactaaacagtattatcagagaaaaactcgt

SEQ ID NO: 1655 - DNA, 152 bp, Homo sapiens
ggactaccccgatgcatacaccacatgaaacatcctatcatctgtaggctcattcattttctctaacagcaggtaatattaattaattttccatgatttgaggaaggccttcgcttcgaggcgaaaaggtcctattagtagaggaaccctcc

SEQ ID NO: 1656 - DNA, 194 bp, Homo sapiens
ttgacctccatgtaactgatttgtgtctagtttctttccttcttctttaaaaacaccagaagggcccttctctttttattgtccctgtaccttctctagctggttgaattgtttgcttgtccaaacttagttttaatttttcccttaaacctgttcaggccaattgtgctcctaataggaattccaataattaa

SEQ ID NO: 1657 - DNA, 625 bp, Homo sapiens
ttgacctccatgtaactgatttgtgtctagtttctttccttcttctttaaaacaccagaaggcccttctcttttatgtcctgtacttctctagctggttgaattgtttgcttgtccaaacttagttttattttttccttaacctgttcaggccatttgtgcttcttattagaatttcattatttaatattgtgaaaaccagtaaaagatgagtacaaataaaaagagtccttgtatccttaaagtctaagttacatgtctcggaagaaatgtgaatcacttaaagacattgtaaaagttcggcgaaaatgaaagatgtagtttaattctgcactcaaatttcttcacatgggtgctttaagtttaaaaactctgaaacatgaaatcaagaaaacaagaaactcctatcaaagaggaggctatgatctctcatccaaagcttggctaactgatgaatattttatattttgagctaaaataaaatgcttaggatatgaatgcatacttcaattttctggatttcctaaccaataaatttccctggtttggattaatctgatcccctttggaggtcagggtaaagaaagggttgccaacaagaagtggtagaataatgggtccaatgt

SEQ ID NO: 1658 - DNA, 144 bp, Homo sapiens
gtcgtttagatcagggtaaggcagtcaggcgggtgttcaccactgccttttcttcctctgagcgtgagaacactgaacccagccactgcccctgggttcctgttctgggaatggtctaataaattcctttcccttcttaagcta

SEQ ID NO: 1659 - DNA, 294 bp, Homo sapiens
cagatgtgagattctgatgtggaactctgggtggattgtgtgcgtgggtgtgcatggcacacacacacatgcacgtaagacggaggaaaaaacaaacagaaaggtgagcaaggtgactgaattttgagctctccagggtgcttctgagatgtggggcttgcacacgctgttgctatagtacgtgttgatcctgactgctgtcatggcgtgccctctggagaaggcccggatgtgatggtgtcaccttccacaagtactcgggcaaagagggtgacaagttcaagctcaacaagt

SEQ ID NO: 1660 - DNA, 296 bp, Homo sapiens
gtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacggcaacaccatcgtgtgcaacagcaaggacggcggggcctgggggaccgagcagcgggaggctgtctttccctttccagcctggaagtgttgcagaggtgtgcatcaccttcgaccaggccaacctgaccgtcaagct

SEQ ID NO: 1661 - DNA, 181 bp, Homo sapiens
ttaatcttcagctgaacacaagcaaaccttctcaggaggtgtctcctaccctcttattgttcctcttacgctctgctcaatgaaaccttcctcttgagggtcattttcctttctgtattaattataccagtgttaagtgacatagataagaactttgcacacttcaaatcagagcagtgat

SEQ ID NO: 1662 - DNA, 160 bp, Homo sapiens
atttgtattttataagaatttgtatttattcactcatttattttccaacttgcttattccagtccagggttgagggtggccacagcccatcccagcagctctgcaagctgcaaggtaggaatcgaccttgaacaggacaccattccattgcagggtgcac

SEQ ID NO: 1663 - DNA, 148 bp, Homo sapiens
tgaagctttatacctttcagatgacactaaaggaacaattttcctagacaaacttgggtataatttggggtaatctcttgcatgggcaggcaccctgttaccttcatttgcatttacacaattccttttaattctggtattaatgtaa

SEQ ID NO: 1664 - DNA, 480 bp, Homo sapiens
tgaagctttatacctttcagatgacactaaaggaacaattttcctagacaaactgggtataatttgggtaatctctgcatggcaggcacctgtaccttcatttgcatttacacaattcctttttaatctggtaattatgtaaatagcagacaagatttttgacatctcactttcttattctgctttggaaaatgactagacattacattgcaggcaatttgctattttaacatgcacaaaagatggattcatttaagcaaaaatagagtgaataactgcatttctgctctccaaaatgcaccatgtatttttgttcaattgtataagtccacaggatttatataactggaggagtctgttcaaaactccagctcgagagtacttctagagcggccgcgggcccatcgattttccacccgggtggggtacaggtaagtgtacccaattcgccctatagtgagtcgtattacaattcactgg

SEQ ID NO: 1665 - DNA, 162 bp, Homo sapiens
cggcacgagcaaacacattgtgaatattagattgctgaattaaggatcatagtcgggcatacttatctatatccatacctctatatccttaaattaatgtgaggactgttcttaatggggaggcctcctttgcaaccattattaattgtaatttaggattga

SEQ ID NO: 1666 - DNA, 201 bp, Homo sapiens
gggtgagctctgcccggctgcagggatggcggggaggggtaagctcatcgcagtgatcggagacgaggacaaggtgactggtttcctgctgggcggcataggggagcttaacaagaaccgccatcccaatttcctggtggtggagaaggatacaaccatcaatgagatcgaagacaattcccggcaatttctaaaccggga

SEQ ID NO: 1667 - DNA, 241 bp, Homo sapiens
cgcgatacagttaggatggctgtagtacctctgctgttgttggggggtttgtggagcgctgtgggagcgtccagcctgggtgtcgttacttgcggctccgtggtgaagctactcaatacgcgccacaacgtcccgactgcactcacagacgtcgctatgggtcaagtagttggcagcagttagttacaagtgtacctctgtggatgacagcaacagttacttgaggataccggggaagagt

SEQ ID NO: 1668 - DNA, 200 bp, Homo sapiens
ctgtgccgaattcggcacgaggggaagacaatcattgaatacaaaacaaataagccaatcacgcctgcccttccttggatattgcacctttggacaatggtggtcctgaccaggatttctttgtggacattggcccagtctggttcaaataatgacctcaattctaattaaaaggaaagaatttgaaaaacctttctctt

SEQ ID NO: 1669 - DNA, 199 bp, Homo sapiens
cgacgttcgggcaccccccgaatggacaatctttccttctgtcaacggcaggggcaggcctagtttgactctgacagtcctcccactaaggaattcctggtgacttggaagggggaagtgactcaaggccctcaacctctagcaaggtaagggtgctaacctctgggtgggcaatgccaagttctcaagtgggcccagc

SEQ ID NO: 1670 - DNA, 215 bp, Homo sapiens
ttttggagttagaaaaggtccacgaactgtgcgataacttctgccaccgatacattagctgtttgaaggggaaaatgcccatcgacctcgtcattgatgaaagagacggcagctccaagtcagatcatgaggaactttcaggctcctccacaaatctcgctgaccatgtaagtctgctagcctttagcaatctctttaaggccacttggcacaag

SEQ ID NO: 1671 - DNA, 182 bp, Homo sapiens
ctcgtgccgaattcggcacgaggttatgttgcccttggacagatctttgagaatctcatacatctgtgaaaaagataatgtgaattaaacagtaaaaaaaaaaggtatgttgatggcagtaagagtaatcatgtcttaaaacgtgaaggttttttttcctttagttttgctcttgatagctg

SEQ ID NO: 1672 - DNA, 268 bp, Homo sapiens
gaacagggtgccaccggcctgcctggtgtcagggccctcgggtagagcaccgacagatcagcacattaagcaggtttgcatgagagtcatacaagaacattttgctgagatggctgccagtcttaagcgtccagactcaggtgccactgggctccctggaagccttggccctcctggtcccccgggccctcctggagaaaatggtttccaggccaattgggaatgcgtggccttccgggaattaaggggcccctggtgctctgggttt

SEQ ID NO: 1673 - DNA, 150 bp, Homo sapiens
ctagagtccatatcaacaatagggtttacgacctcgatgttggatcaggacattccgatggtgcagccgctattaaaggttcgtttgttcaacggttaaagtcctacgggatctgaggtcagaccggagtaattcaggtcgggttctatc

SEQ ID NO: 1674 - DNA, 188 bp, Homo sapiens
cagccagcctcgaaatgcagaacgacgccggcgagttcgtggacctgtacgtgccgcggaaatgctccgctagcaatcgcatcatcggtgccaaggaccacgcatccatccagatgaacgttgccgaggttgacaaggtcacaggcaggtttaatgtgccagtttaaaacttatgctatctctcgggg

SEQ ID NO: 1675 - DNA, 158 bp, Homo sapiens
ggtcagagagctgggtgggaagatgcactcatcttcccttatttgatctaacatttcttgtagtaatggcttctcattctcttcctctgtttggctaacatgcctttggaatgttgagcactaaggtgaggtgcttttcacttttcatcccatttttt

SEQ ID NO: 1676 - DNA, 619 bp, Homo sapiens
ggtcagagagctgggtgggaagatgcactcatccttcccttatttgatctaacatttcttgtagtaatggcttctcattctcttcctctgttggctaacatgcctgggaatgttgagcactaagttgagttgctttccattttcatcccattttttcttaaccatcattttgtgtttttgtttttttctgtttagccttaaagaagaataatatcactaaatttccaaatgttcactcgagggtaaggatttcttctagcacaccggtggtggaggatacacagagctggcaagcatcactttttacttagcttcctcctctctctgtatgcagatcaatggttttcaatctatggctgagggtaatactgggtgagaatctgaccagggagtttttgtacctcacattccaatgatgcagggattgagcctctctgttggactctttctcggctgcttttaagttctaagtgtgatggcttgggcaagggtatttgctgatgattgtatttgctttgagtgttgggctgtccttcccttaaccctggtcttgggctttgagttactcagttaaacccaattttgatctgaagcgactgaaagcaaggtcctgggcaag

SEQ ID NO: 1677 - DNA, 150 bp, Homo sapiens
cgacagtagcgctgtcgcggagagaggtcgcgtggctaagagcctaagtggtggttccgagataaggcgctatcctaatcccgtttgggttcctacacacacaaggctctcgggcccttgttgtcctaaccttttacacatcacatacac

SEQ ID NO: 1678 - DNA, 385 bp, Homo sapiens
gccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaaaaaaaaaaa

SEQ ID NO: 1679 - DNA, 232 bp, Homo sapiens
gacgatttattggacatgatataggtcgtggatgtatgggggaatctaagagagctgccatcgctttgatgctgggagttctaacaaaacaagttggatgcggccattcaaggggaagccaaaatctcaagaaattccagcaggttacctggaggcggatcatctaattctctgtggagtgattacacacatatatattacaagggataatttagacccatacaagtttata

SEQ ID NO: 1680 - DNA, 300 bp, Homo sapiens
gctggggaaggtgaacagtgtggcccgccatgttcttctccgcggcgctccgggccccgggcgggctgggcctcaccgcccactggggaggacatgtaaggaatttgcataaagacagctatgcaaaatggagctgggggagctttatttgtgcacagagatactcctgagaataaccctgatactccatttgatttcacaccagaaaactataaggggatagaggcaattgtaaaaaactatccagaaggcataaagcagcagctgttcttccagtcctggatttagccaaaggcagat

SEQ ID NO: 1681 - DNA, 317 bp, Homo sapiens
cgaacgggagagcacgccatgaaggcctcgggcacgctacgagagtacaaggtagttgggtcgctgccttcccacccccaaatgccacacggcgcccctctaccgcatgcgaatctttgcgcctaatcatgtcgtcgcaagtcccgcttctggtactttgtatctcagtaaagaagatgaagaagtcttcaggggagatttgctacttttggcaggttttttagaagtcccccttccggtgaagacttcgggatcttgctcgtattactccgagcggcaccacaacagttaccgggataccggacctacacgcagcg

SEQ ID NO: 1682 - DNA, 180 bp, Homo sapiens
ctatccacctttgggtcgctttgctgttcgtgatatgagtacagacagtttgcggtggggtgtcatcaaagcagtggacaagaaggctgtttggagcttggcaaggtcaccaagtctgcccagaaagttcagaaggctgaatggatattatgcctaattacctgccaccccactcttatc

SEQ ID NO: 1683 - DNA, 285 bp, Homo sapiens
  misc_feature 37: n = A,T,C or G
ctcgtccattttgggcggaaaaagggctatggcaagnatgctgctggcattgcaatggaagccattgcttttgcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaattaagccgtggmccagctggtcaagttcaacagagccttgctgcaccattctatggctcagacacct

SEQ ID NO: 1684 - DNA, 310 bp, Homo sapiens
catgtgtgtgtgtacactgggatatgattcagccataaagaggaatgagctccaacccatgctaccatgtggatgaaccttgaaaatatgacggtgagtgaattaagccagacacacaaggttgtgtggtgtgtaattccatttataccaaatatccaaaatgtggctacagcagaatgtcgatagatctatagagacagaagcagatggaggttccgcagagcttgggggaagggaaggaattaggagtaattacttagtgggtaggaggttcctttgggggtaatgagacattctggactagataagg

SEQ ID NO: 1685 - DNA, 416 bp, Homo sapiens
catgtgtgtgtgtacactgggatatgattcagccataaagaggaatgagctccaacccatgctaccatgtggatgaaccttgaaaatatgacgctgagtgaatgaagccagacacacaaggttgtgtggtgtgtaattccatttataccaaatatccaaaatgtggctacagccagaatgtcgatagatctatagagacagaaagcagatggaggttcgccagaggctgggggaagggaaggaatgaggagtaattacttagtgggtaggaggtttcctttgggggtgatgagaacattctggaactagatagaggtgactgcaccactgtgattgtcccagatgccccaatggaaaagtgtatttagtctatcttgccacatagaaataaattttccaaaaaaaaaaaaaaaaaa

SEQ ID NO: 1686 - DNA, 310 bp, Homo sapiens
cactagtggatccaaagaattcggcacgagctgccgccaaggtgctcggtccttccgaggaagctaaggctgcgttggggtgaggccctcacttcatccggcgactagcaccgcgtcccggcagcgcagcccttacaatcgcccgcgccatggcctctgtctccgagctcgcctgcatctactcggccctcattctgcacgacgatgaggtgacagtcacggggggtaagatcaatgccctcattaaagcagccggtgtaaattttgagcctttttggcctggcttgtttcaaagccctggccaacgtca

SEQ ID NO: 1687 - DNA, 310 bp, Homo sapiens
aaactttgaaaggacttcactgctcctttacgatattccaaatagttttttacattggaaaaactaattcttgggattctttcatacattttcatcaaaactttcagtgtgattatgtattcatatcttcagtttaatatgtcagtataatagatattgttcaaaaggctcttgttgctaaagtggtgtaatctgttacacagatgaatagctagatgtggaagggatatgtaaccaggaacccttgggtattgtttctaaggaaatatgggacagccatggtaggcaacttaggtctgtactgcattgt

SEQ ID NO: 1688 - DNA, 106 bp, Homo sapiens
cagatgctaaaagacatcaagaaggagaaagtgctgctgcggaggaagtcggagctgccccaggacgggtacaccatcaaggcacttgaggcgcacaagcgggcgg

SEQ ID NO: 1689 - DNA, 210 bp, Homo sapiens
ctcgtccaatttcggcaggggggccgagtggagactcgtgttctcaaacccggtatggtggtcacctttgctccagtcatacgttacaacggagtaaaatctgtcgaaatgcaccatgaagctttgagtgaagctcttcctggggccaatgtgggcttcaatgtcaagaatgtgtctctcaaggatgttcgtcgtggcaacgttgctggt

SEQ ID NO: 1690 - DNA, 247 bp, Homo sapiens
gttgactgtaacatggagacatctacagaagagaaggaaacttaccccgagatacagtggaggtatgtgaatctccttttccaagtcaaccttcggtaaataaacatgtaacagtgcatccatattttaaatttatcacaacctttttcataactgatttccccatttactcctctttttactaaaggatgtgcatttgatcattccaatggtaaactctttagggatagtgacttgctgtcttgtg

SEQ ID NO: 1691 - DNA, 217 bp, Homo sapiens
cccacagctgggtcagcctggaaaatccatctattagggactttttggcagccagattggcagcattagcccattaggtctcatcccgagttccaagtctttggctgcaaatgagcctcagttcgccttactggagagcacccccagattcctgggcacagttcatttccagcctttctagatctgatcttttaggggggaagacagcttaaaatgt

SEQ ID NO: 1692 - DNA, 262 bp, Homo sapiens
cgtagatgatgtctgtaacgtagttttgtttgaaatatgagaatatgcggcttaaactttgatctgtaaggagcggggccgtggcgttttggagcacgctgtagacaccgttcctcatgctgccgggtgggttttgcagaggctcccttagtgatttcatgtttaccaggcagcatccattttcagattttcctggcattgatttatattttgagcatccaggaaactcctcgtttcctcgtttagccccaccagatcaggt

SEQ ID NO: 1693 - DNA, 200 bp, Homo sapiens
cggccccgggcagagctctgctgcgggcgggcgctggacggctgcttcggggaggcgtccaggagctactgcggccgcgacatgaagggaacgcccctgacctggcctgcaacttcagcctttctcaaaatcggggcacggtcatcgtggagcgctggtggaaggtaccccttggccgcggagggccggaagccgcgcct

SEQ ID NO: 1694 - DNA, 226 bp, Homo sapiens
tggttgtgactgtactatttctagtatagtgaactacatactgaatatccaagttctcagcacctacttttgtcaaatcttaacattttgccacttcgagatcacattgccattcctcccctccagaggtaacaattatccacaatttgatgtttatcattcctgtgttgttgtactttcactgtgtataacctaaaccatctactctctagtactgtgttatata

SEQ ID NO: 1695 - DNA, 104 bp, Homo sapiens
gtcctctagctcttatctctgtctcttactcttttctctttctctttttctctgtcatgagactgtgtgtgacagggccacctgtctttttttttttcttaaat

SEQ ID NO: 1696 - DNA, 253 bp, Homo sapiens
cggcacgagggaaaatcaaatgaggcagtaaagtaagagcaacctgggcagtgggtgcagaagctcaactgatgcaaatcaggcagttaaaagttgtgcaaaaggtaaaataatgcaccagaagcaagatacaagttgtcttaagaatcccattactgcccaggtgccgtgactcacacctgtaatcccagcactttgggaggctgaggctggtggatcacatgaaggccaggtgttcaaaaccagcctggga

SEQ ID NO: 1697 - DNA, 206 bp, Homo sapiens
ccttgttggccatccagctgaccttcctgcgcctgatgtccaccgagggctccaagaacatcacctaccactgcaggaacagcgtggcctacatggaccagcagactggcaacctcaaggaggccctgcttcctccagggctccaacgagatcgagatccgcgccgaggcaacagcgcttcacctacagcgtcactgtcgatggct

SEQ ID NO: 1698 - DNA, 143 bp, Homo sapiens
gcccacgatgcctggagttactgtaaaagacgtgaaccagcaggagttcgtcagagctcttggcagccttcctcaaaaagtccgggaagctgaaagtcccccattggtgggataccgtccaaagctggccaagcacaaagagt

SEQ ID NO: 1699 - DNA, 131 bp, Homo sapiens
ccggaggtgcaggtcctggtgcttgatggtcgaggccatctcctgggccgcctgccgatccggtgggctaaacaaggtacttcttggcccggaaggtgggtggtccgaccgcttgtaaaggcatcaaccat

SEQ ID NO: 1700 - DNA, 118 bp, Homo sapiens
gtgaacctgaagccagcagccccgcatcatgtcaaagctcggccgggccccccggggcctcaggaggcccgaggtcggccggtgtgatccgggcgatcgtgcggcaaggcctggccat

SEQ ID NO: 1701 - DNA, 109 bp, Homo sapiens
cctcgccaattttggggcgagaaaaattaaaatgaatgtcacaaggcctgagttcagtcctctgtaaccttcagagaaattttgggagcctgtattttttccctcctgt

SEQ ID NO: 1702 - DNA, 640 bp, Homo sapiens
ctcgtgccgaattcggcacgagaataaatgaatgtcagaaggcctgagttcagtcctttgtaacttcagagaaattgtggaggctgtattttttcctctgataaaaggagaaggttatctagagctctgttatcattgtgaacattgcaaatgtggctattcctggaaaagagagaatgaagagtgtggtaagcaaagagaccgcttcccaacttaaaaagggcaaagaatttgtgagaaaatccagggaaatgatcatggaaatattaagtagccgttgctactcatttgttttcctttcctcaaacattccaggcaatgtgtccaaaaaacatacttaatccaaaccacagcataaagcaagaaagcagagaaaacctgagaagggtgggatgggaaagtctggctaacctggtagagaatgccaataccacattccctgttggtgggaggtgaggaaatagagctcaagcctttgcttctcctttaaaatattgggcaattctgagatctagcccttggctttatagctcaatcaaatctggccagttgggaaaggggagacagcctatagcctggacaaagggcttccctggcaagcctcccttcaacaaatttccggcaagctccctggggactc

SEQ ID NO: 1703 - DNA, 123 bp, Homo sapiens
tagctgtaatttattatacattttgaaatagctagaggatttggaatgttcccaccataaatgataaatgtttgatacatgataaatatcccaattactctaatttggattattacacataat

SEQ ID NO: 1704 - DNA, 260 bp, Homo sapiens
tagctgtaatttattatacattttgaaatagctagaagatttgggaatgttcccaacataaatgataaatgtttgatacatgataaatatcccaatactcttatttgattattacacattatttacatgtatcaaaatatcacatgtaccccaaaaatatgtacaattatgtatcaatttttaaaaataaaaaactaagtttttttaaaaagacaaacaatattcagaaatacttttctacagaaactaaaaaaaaaaaa

SEQ ID NO: 1705 - DNA, 205 bp, Homo sapiens
gaattttaccataaaaacagtataattcttaggttcttatgtcagcctacaaaagtctgtctattctaccctgtctataaaatgtagtattattttacctaattgccatttagagcattttttcaaggatgacctttaatactgaaattctgagatatgacttttagttcagagtttatgaattgggcattggagggtgtatatg

SEQ ID NO: 1706 - DNA, 615 bp, Homo sapiens
gaattttaccataaaaacagtataattcttaggttcttatgtcagcctacaaaagtctgtctattctaccctgtctataaaatgtagtattattttacctaattgccatttagaacattttttcaaggatgaactttaatactgaaattctgagatatgacttttagttcagagtttatgaattgggcattggtagggtgtatatgtgtatgttggtgaaaatcagtttgccagtatctgccatgtgatagtgataataaagtcatgaaacctgttacaagttatttgagaaacttttaggtttaagatcttgacttgaatatatttagggctatggcttgtgagattcagacctcagagaaaagcttcatttttccccatgtctcttagcacagcagacctggcaaatttattttgctctctaacagtcgagcccgggcctattccaaagtgtctgggtaatttatcctgggctatcccaatctcttcaattctggatgtgctgctacttattagtagcaggggtagcaggggtcagccctacttaataaactccagcctacttaataaattagtagcaggtaggcaggggtcagccctacttaataaactcaa

SEQ ID NO: 1707 - DNA, 131 bp, Homo sapiens
ggatccattcagctcatgccctcaatgtttatattgtgttatctgttgggtctgggacatttagtttagtttttttgaagaattacaaatcagaaggcaaagcaagcattttaaacacaactaataactgt

SEQ ID NO: 1708 - DNA, 247 bp, Homo sapiens
ggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgacccccactattggcaagttatgtgcccattctaaacaccgccaat

SEQ ID NO: 1709 - DNA, 184 bp, Homo sapiens
agctcaagtagcttgataatcttcggttttctattttctaatcaactgcccttagttatgatgtctacagtacatgcagtgcaatattaggctaagtatagtaatttaggagggtgaatctatcatccctaatgatgtaaccattaccccatttaggtaaatgaatatacacaatatagacagt

SEQ ID NO: 1710 - DNA, 346 bp, Homo sapiens
agctcaagtagcttgataatcttcggttttctattttctaatcaactgcccttagttatgatgtctacagtacatgcagtgcaatattagactaagtatagtaatttaggagggtgaatctatcatccctaatgatgtaaccattaccccatttaggtaaatgaatatacaaaatatagacagtgttctgttaatatgtatgtatattacatttactttttacccacaatataaaacaattcactttgggaggctgatggaggaggatcacttgtgctcaggagttcgaagccagcctgggcaacatgatgaaactttgtctctgtaaataaaaaaaaaaaaaaaa

SEQ ID NO: 1711 - DNA, 134 bp, Homo sapiens
attctgcctaggcaggagagatggcgcactgccacttaacttttttttggtacacagttttcagagtgggagattcacccattctttccttcccctagtcacctagctttgagggtgccttaggctgaatggct

SEQ ID NO: 1712 - DNA, 136 bp, Homo sapiens
ccagcagagttaccaccacaggtttaaacaaattctgtccactagagatcttttcccagtccagcagtgcaatagtttcattccagccccactcgctgggctctgtctgacccaatgaatgcgctgcctcaggact

SEQ ID NO: 1713 - DNA, 597 bp, Homo sapiens
gccagcaggaagttaccaaccacagggttttaaaaacacagattcctggtccacctcagagattctgattccacaggtccaggacgtagcacatacgtttccatttccaagcccccagctgcagctgaggctgctggtctgagaccacacttggaatagcgctggccttcaaggactagaacacattcttgccgcactccatgtcgaatcttcttctcactgtttcagtctaatattatgcccttgaatttcaccaagggctagtgtgggataggccatgtttgcagtgcctgattgttttagagaggtcagagaggtcatctcagagacttcactcattatggtgctcagtatgcgtcgtggaaaattactctcagatctgaggatgcagacgtattcagtcccttcttaggaattggtgaacatcttagtagatggtgaaagttctggaagtcatcatctttctcccattacttgcagaactggggatttttcctaattgctacagcgtttcctagacagaattctcaacatagttttttcaagttcctaatataatttcctccttttgctgcttgattttgtacttttcgtatg

SEQ ID NO: 1714 - DNA, 271 bp, Homo sapiens
ggtggctggactctgaacaactcccttcagtaaaggggccagtcttcactggcagtggctggtacttggctctcagcctcggaggtggcagctctcctagcagctggggttcactcccacttcatcctcggctgaaagaggtgctgtgcttttgaaatgcagccaatgaatacccagtctgattaccagatttgggcagaccagcagtgctcgccagagtggtctggcctcctatgggggatccaggttggtgtacatgtccatttcatgt

SEQ ID NO: 1715 - DNA, 149 bp, Homo sapiens
gaatttttaaaaaatttttaagaattgtttgtcacgtcatttttagaaatgttctacctctaatatggtaatgtccagttttaaaaaatattggacatcttcatcttaaacatttctatttagctgattggttctcacatatactccta

SEQ ID NO: 1716 - DNA, 124 bp, Homo sapiens
  misc_feature 97: n = A,T,C or G
gcatttagtgctgtaaatttccctcttaacacagctttagctgtttccccagagattctggtacattgtgtctgttctcattagttccaacaacttntttatttctgacttaatttcattattc

SEQ ID NO: 1717 - DNA, 203 bp, Homo sapiens
gaaacacgtctggctaggagaaactatcaatgctggcagccagtttgaatataatgtagaaggagtgacttccaaggaaatggctacccaacttgccttcatgcgcctcctggccaactatgcctctcagaacatcacctaccactgcaggacagcattgcatacatggatgaggggactggcaacctgaaaagggctgtcat

SEQ ID NO: 1718 - DNA, 132 bp, Homo sapiens
gccacgcgacgtgttgtgtctgagatcccggtgctgaagactaacgccggaccccgagatcgtgagttgtggggtgcagcgacttaaggaggaatatcagtcccttatccggtatgtggagaacacaagaat

SEQ ID NO: 1719 - DNA, 120 bp, Homo sapiens
gtctggaggacttgacgtcaagaagacctgtgcatggagaatctgataccgagcagctccaggatgatgacatagagaccaccaaggtggaaatgctgagactttctcttggcacgaaat

SEQ ID NO: 1720 - DNA, 216 bp, Homo sapiens
gagctgtcccaaagagggaaagcggtgaggtttgaggaggggcagaagcaggcccggcaaaggttgtaccttcataaggtggtatggggggtttggggtcaggccctgaacatcgtcctacttgagaatctgtcaggggaaaaagtcaaggggagcaggaggaagagccaagaaggccagagagaaaaagagttggagtcttaggggccaaggtga

SEQ ID NO: 1721 - DNA, 128 bp, Homo sapiens
gtcaactatcctcagctgtattcgtactcaattgtcagtatggcacagattactgtattaaaatattctcctttcgtcttcatatttaccttctgaggtaatcggctaaccttaatgtgttactacaa

SEQ ID NO: 1722 - DNA, 128 bp, Homo sapiens
ggaacctccaactggtctggcaactacttcaacggagacggcgggcacctcgctgctggtaacgaagaatgggaggggcggcctgcggaccagctggaggcaattttcctaagggacttggactccct

SEQ ID NO: 1723 - DNA, 159 bp, Homo sapiens
ccttcgccatgacccgcggtaaccagcgtgagtcgccccgccagaaggaatatgaaaaaggcagagcgrcctcggttaaggggaaagcgccgagaatgacgggctttctgctgccgcccgcaagcaggagggcctcggagatcatgcagcaagagcaga

SEQ ID NO: 1724 - DNA, 100 bp, Homo sapiens
ctttgaagccccatttttggggtaggggacagtgatgacttaatgtcatggccatctcttggggccagttttctttcatcccctccgagattgggggaga

SEQ ID NO: 1725 - DNA, 104 bp, Homo sapiens
aatatctgttctgcaactgttgaacaaataattggctacaatgaccctaattaaaggtaaaattttggccatgtatgtcacggtttatggtgtaagtgtctctg

SEQ ID NO: 1726 - DNA, 212 bp, Homo sapiens
gaatatgagaacttaagccttgactttaaattgccagttaatcatccattggtatccatgggagattgggtccacgacccccctgtccaattccaaaatccacagatactcaaggcccttacataaaatggggtaggattttcatataacctacacatatcttctcatatactttaaatcatctctagggttacttaggacaatataaatgt

SEQ ID NO: 1727 - DNA, 237 bp, Homo sapiens
cttccttgggagatgccataaagcacctggatgatctcaagggcaccttttgcccagcttgagttgaacttccacttgttgacaagcttgcattgttggattcttgagaacttcaaagcttcttgggaaatgttcttgtgaccgttttggcaatccatttcggcaaagaattcacccctgaggtgcaggcttcctggcagaagatggtgacttcagttgccagttccctttcctcca

SEQ ID NO: 1728 - DNA, 234 bp, Homo sapiens
aaaaaattttaaaaattacaaaaaaagaaaaaattaactccaggtataaggtgttagagtttgttagatgagctatgaagacttgacattacatggagtatagtaaagataaaaagttagaggttggttcaccttctatttactcaggccagattctctaacagaatatttttgaacttgattcatctaggagtgctcagagttttttgaggagcaaatcccaaaacttcacat

SEQ ID NO: 1729 - DNA, 611 bp, Homo sapiens
aaaaaattttaaaaattacaaaaaaagaaaaaattaactccaggtataaggtgttagagtttgttagatgagctatgaagacttgacattacatggagtatagtaaagataaaaagttagaggttggttcaccttctatttactcaggccagattctctaacagaatatttttgaacttgattcatctaggagtgctcagagtttttgaggagcaaatcccaaaactgcacatgcaggtgaatgggtcttaacagatttggaagtgccccttgccttaatttcttctgacttgacacaaagtctgtaattccagcactttgggagactgaggctggaggatctcttgaacccaggagtttgagaccagcctgggcaacatggtgagacactgtctcaacaaaaagtttaaaaaattaaccagatgtggcagtggctcaccctgtaatcccagcactttgggaggcggggcgggcacatcacctgagttcgggagacagagacagctggcaacatggtaaaacccgtcatactaatatacaaaaatagttgggcgtggtggtgcatgcctgtaattctagctactcaggaggctgaggcaggagaatcgctt

SEQ ID NO: 1730 - DNA, 165 bp, Homo sapiens
aaacatatgtccaaggactctaaattgagactcttccacatgtacaatctcatcatcctgaagcctataatgaagagaaaagatctagaaactgagttgtggagctgactctaatcaaatgtgatgattggaattagaccatttggcctttgaactttcatagga

SEQ ID NO: 1731 - DNA, 102 bp, Homo sapiens
ccaacctggggggcagtggtgtggagaagcacaggcctgagatttcatctgctctccttcctgggagccaagagcaggccaagcagaagcgggctggtgtct

SEQ ID NO: 1732 - DNA, 211 bp, Homo sapiens
tggaagtgacatcgtctttaaaccctggcgtggcaatccctgacggaccgccgtgatgcccaggggaggcagggcgactggaaggccaactacttccttaaggtcatccaactattggatgattatccgaaatgtttcattgttggagcagacaatgttggctccaagcagatgcagcagatccgcatgtcccttcgcggggaggctgttg

SEQ ID NO: 1733 - DNA, 107 bp, Homo sapiens
cattatccaaaatcagcttcaacaaatggtttctggagacaaataatttgttttcattatcattgtataatcaggttaatgatttatttcctgactaaatgtgcaat

SEQ ID NO: 1734 - DNA, 119 bp, Homo sapiens
cttccgaggaagctaaggctgcgttggggtgaggccctcacttcatcccgcgactagcaccgcgtccggcagcgccagccctacacttggccgcggcatggcctcttttcttccaggct

SEQ ID NO: 1735 - DNA, 254 bp, Homo sapiens
gacagctggtgcgcctgcccgggaacatcctcctggactcaatcatggcttgtggtctggtcgccagcaacctgaatctcaaacctggagagtgccttcgagtgcgaggcgaggtggctcctgacggtaagagcttcgtgctgaacctgggcaaagacagcaacaacctgtgcctgcacttcaaccctcgcttcaacgcccacggggcgccaacaccatcgtgtgcaacagcaaggacggcgggcctcggggca

SEQ ID NO: 1736 - DNA, 156 bp, Homo sapiens
tcaaaaagtcgggaagctgaaagtcccgaatggtggataccgtcaagctggccaagcacaaagagcttgctccctacgatgagaacttgttctacacgcgagctgcttccacagcgcggcacctgtacctcccgggtggcgctggggttggctcca

SEQ ID NO: 1737 - DNA, 405 bp, Homo sapiens
acatcagcaagaaccccaaggacaagaggcatgtctggttcggcgagacattgacccatggattccagttcgagtatggcggccagggctccgaccctgccgatgtggccatccagctgaccttcctgcgcctgatgtccaccgaggcctcccagaacatcacctaccactgcaagaacagcgtggcctacatggaccagcagactggcaacctcaagaaggccctcctcctccagggctccaacgagatcgagatccgcgccgagggcaacagcgcttcacctacagcgtcactgtcgatggctcacgagtcacaccggagcctggggcaagacagtgatttaatacaaaaccaccaagacctccgccttccatcatcgatgtggccccttggacgttggtgcc

SEQ ID NO: 1738 - DNA, 410 bp, Homo sapiens
gagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttacccaagatggggatattctttgtaaaaatgaaattaaagttttttaatggaaaaaaaagggtacttctggagcgccgggcccatcgatttccacccggtcgggtccaggtaagttaccaattcgcctatagt

SEQ ID NO: 1739 - DNA, 199 bp, Homo sapiens
cggcacgagggacaagttgaaggcattccctctgagaactggaacaagacaaggatgcccactctcaccactcctcttcaacatagtactgacagtcctagtcagagcatcagacaagagacagacataaagggcatccaaatcggtaaagaggaagtcagactgttgctgtttgctgatgacatgattgtatacctag

SEQ ID NO: 1740 - DNA, 345 bp, Homo sapiens
gaattcggcacgagccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctcctcctcttctatcagacctgaccccacacaaacctgtcccctcggttgtgttgaagtcccctcgacagtgggcaggggtggcagaggacacgagcagccagtccccgtacccctgtcgtgtgtgtagcccgt

SEQ ID NO: 1741 - DNA, 350 bp, Homo sapiens
ccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaattggctacaaccccgacacagtagcatttgtgccaatttctggttggatggtgacaacatgctggagccaagtgctaacatgccttggttcaagggatggaaagtcacccgtaggatggcatgcagtggaccacgctgcttgaggctctggactgcatcctaccaccaactggtccactgcaagcccttgcg

SEQ ID NO: 1742 - DNA, 390 bp, Homo sapiens
aggcgccgctccggcttgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctcccctgaaggccccgaggcgaagggtaccgaaagcacagtaatcactggtgtcgatattgtcatggaccatcacctgcaggaaccaggtttcacaaaggaggcctacaggagtacatcaaggttacatgaatcatcaaggggaac

SEQ ID NO: 1743 - DNA, 290 bp, Homo sapiens
cgtccaatttccggccaggggggccaaactcagtgttgaagacctttcagtcaccttgcgccactccgtaatcgcctgtttcaagaaaactctgttctcagttcactccccctcaattctctgagtaggaacaatgaagttgacctgctctttctttctgaactgcaagtgctacatgatatttcaggcttgctgtctcgtcataggcatctagccaaggatcattctcctgatttatattcactggagctggcaggtttggatgaaattgggaagcgttatggggaaga

SEQ ID NO: 1744 - DNA, 285 bp, Homo sapiens
catcctagagtcaaggaaaaagagaagatttttacttgctcaaagtcaagcaggtaatgtcagaatttaatctcaaatctatatctttatagaatttcagttccttggttatataataccaagtcacaatacaggtaatttcccaccattgaaccttcctgttggtgtgagatgccaaatctgtgaaacccagacacaggtggccaggtgggtgtcgaactcctgacctcaagtgatccgcctgcctcagcctcccaaagtgctgggattcacaggtgtgagtca

SEQ ID NO: 1745 - DNA, 310 bp, Homo sapiens
tggccacagagctggagcccctgtgcactccggtggtcacctgtactcccagctgcactgcttacacgtcttccttcgtcttcacctaccccgaggctgactccttccccagctgtgcagctgcccaccgcaaggcagcagcagcaatgagccttcctctgacttgttcagctcacccacgctgctggccctgtgagggggcagggaaggggaggcagccggcacccacaagtgccactgcccgagctggtgcattacagagaggagaaacacatctttcctagagggttcctgtagacctagggaggac

SEQ ID NO: 1746 - DNA, 214 bp, Homo sapiens
tgatgccagctcagctatggacacatccgagccagccaaggaggaggatgattacgacgtgatgcaggaccccgagttccttcagagtgtcctagagaacctcccaggttgtggatcccaacaatgaagccattcgaaatgctatgggctcccttgcctcccaggccaccaaggacggcaagaaggacaagaaggaggaagacaagaagtgaga

SEQ ID NO: 1747 - DNA, 175 bp, Homo sapiens
aggcaccacggaggaggagctcctgcgcaagtgaatgagcagcgggacatcctggctctgatggaagtcaagatgaaagagatgaaaggcagcattcgccacctgcgtctcactgagggcaagctgcgcgaagaacttcgttagaaggatcggctgcttgccatgggtgtcatcc

SEQ ID NO: 1748 - DNA, 194 bp, Homo sapiens
tgtgcacgcatagcaatataagatttactatgcacgtgatacattttatggagtgcctcaagccaagatagtgaatttatatgaagggtgtgaaatgtatttctttactactatagtagtttagttataacttttgcatctataattgagctttctcatctgtcaaatgctatggtttccttaaaatgttacat

SEQ ID NO: 1749 - DNA, 193 bp, Homo sapiens
tcatcctgagctgaacgggaagctcactggcatggccttccgtgtccccactgccaacgtgtcagtggtggacctgacctgccgtctagaaaaacctgccaaatatgatgacatcaagaaggtggtgagcaggcgtcggagggcccctcaagggcatccttggctacacatttgcacccaggtggtttccttt

SEQ ID NO: 1750 - DNA, 300 bp, Homo sapiens
catgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcactaacggcaggctgtccataatggtgttaccagctaagtttgctcgagccttcagtccgttgcagaggagcgagctggacgccactctggcgctctcagagtctcactctaactgg

SEQ ID NO: 1751 - DNA, 257 bp, Homo sapiens
gatgattgttggctgcatgtatgtcttctttagaaaagtgtctgttcatgtcctttgcccattttttaatgattttttttcgtgtaaatttgtttaagtccctcacagatggtggatattagatctctgtcagatgtatcgttagtaaaaatttcctcttattctgtaagtctgtctgtctactctcttgatagtttatctcgctgtgcagacgctcttgagtgtaaatagagcccacttgtcatatatcgctctgs

SEQ ID NO: 1752 - DNA, 192 bp, Homo sapiens
gtctttctcctaaactggtctttgtgctctctttgttttttcttatttccctcttgtctctcattttttcttcccattcccctcccatttcagcccttaacttttctctttcccatcttccactcagtattccaatggcaaaccctgatggatgtaacaaccgccgatggagacaatcggacctttccggac

SEQ ID NO: 1753 - DNA, 173 bp, Homo sapiens
tacccccagaagggtcaatgttgggagtggttgtggctctgagctgctctacagagcttcagtgtgagaggatcgagccattgaaagctcattaccagtaggacataatttttggctctccctattcacaaccagtgcaccagttttaccacagttggctcaggttgacaagt

SEQ ID NO: 1754 - DNA, 214 bp, Homo sapiens
taaccctttaccctataattgctatccttaaagatttcaaataaactcggagggaacttcagggagaccaacttatttagagcgaattggacatggataaaaaccccagttggagaaagttcaaaggtgattagattaataattttatagagggtgagtgaccttttataaattactgtaagaatgaacttgtaaataaggatgggataattta

SEQ ID NO: 1755 - DNA, 193 bp, Homo sapiens
tccctgtccctcgggcagatctgttgtgtctctcttcccaccttggcagcctcagctctgtgcccctcaccctgcttcctctcgccccttctcttccaccccttccttctgagccgggcccttgggattggggagccctcttgttccttatgagggtcaacttaagggggcttgagcatatcatcacatttcc

SEQ ID NO: 1756 - DNA, 200 bp, Homo sapiens
tccagatggatccctctgtgcttctgaggcaaggatggccaggcatgttatgggatctcaacgaggcaaacacctttacacgtagatggtgggacatcaatcaacgccctgtgcttcagccctaccgctactggctgtgtgctgcacaggccccagcataagatctgggatttgagggaagatcattgtggatactgagc

SEQ ID NO: 1757 - DNA, 200 bp, Homo sapiens
ataccttctccccacagcctctgctgatgacagagctgcctacacctagacacgtcctggcagggggcctcgggcactccactaccaacccagctccacccagcagtttcctggggagaaggaagctgaccctctccccagccttatatgccttgccacaccctacagctcctcttggagaagctgtttgctgagacccc

SEQ ID NO: 1758 - DNA, 387 bp, Homo sapiens
  misc_feature 350: n = A,T,C or G
ctggccgggacctgactgactacctcatgaagatcctcaccgagcgcggctacagcttcaccaccacggccgagcgggaaatcgtgcgtacattaaggagaagctgtctacgtcgccctggacttcgagcaagagatggccacggctgcttccagctcctccctggagaagagctacgagctgcctgacgcccaggtcatcaccattggcaatagcggtccgctgccctaggactctacagccttccttcctggcatggagtctgtgcatcacgaaactaccttcactcatatgagtgtgacgtgacatcgcaagactctacgcacacagtctgtttgcgcacacatgtnacctgcattcgacagatgcagaggagatactgcctga

SEQ ID NO: 1759 - DNA, 350 bp, Homo sapiens
gcctggccaccgggccacggcccacagacccagcacgtatctccatgcgccaagtggagcccccagccaagaagccagccacaccagcagaggatgacgaggattatgacattgacctttttggcagtacaattaggaggaggacaaggaggcggcacaacttcgggaggagcggctacggcagtacgcggagaagaaggccaagaagccttcacttgtggccaagtctccatccttcttggatgtaagccttgggattatagacggacatggccactggaggctttttcgtttatcagctggacggctgtctggggtctccagctgctcccgtgctacggtatcgagca

SEQ ID NO: 1760 - DNA, 165 bp, Homo sapiens
atcgaccagaacccgtgatggtattatagacacggaggaccttcggacaccttcgcagccattggccgcctcaattgtgaaggattgaggagttgggatgccatgatgaaggaagccagcggtcccatcaacttcaccgcttccttgaccaggttcgggggagac

SEQ ID NO: 1761 - DNA, 90 bp, Homo sapiens
aggttaggggagaggagcatgtccatagacctccgacggaagctgttaagcttccttgccatagctttcaataagccaagaaattactgt

SEQ ID NO: 1762 - DNA, 626 bp, Homo sapiens
agcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaagcaaagcaaaagctggaagatcgcctcgcagctgctgcccgggaaaagctcgcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggatccagcactacgccctgccctctactgactggaggcaggctctgcctactttagaagttaaaccaacccgataggccttcgagcaaaagcaaagatccaccgagagagagagaagaaaaaaaaaaaaa

SEQ ID NO: 1763 - DNA, 125 bp, Homo sapiens
tctctttccctgtagaaacctcttccgccatgagagccaagtggaggagagcgaatcccagctgagcgcaaaagaggaagatgaggcagaggtccagtaaaccctagctttttgcaccgtggagg

SEQ ID NO: 1764 - DNA, 115 bp, Homo sapiens
cggcggcggcctgaaccggggcctgcgcggaagagcactcctgctgagcgcctgccaaaggccaagagggaggcgccgccaatggagaggccggaggtggtgaggacgcacctcc

SEQ ID NO: 1765 - DNA, 145 bp, Homo sapiens
atggccaggccttgggctaacgtctggcttgcatggtcttccaagggaatcagccccatcaacaaagttcaaatcggggcaagagcttcacttgtccccctatatggttcttagggaccaagcttagggcttgcaatttctgtag

SEQ ID NO: 1766 - DNA, 150 bp, Homo sapiens
gggtccacatcctttccagcatttttgtttcctgactttttaatgggcggcattctaacttgtgcacacagtattttttttaaagctaaatctttttttctcgacttcaagggctgtgaaaaagctgtaaatgccccctgtagggggggt

SEQ ID NO: 1767 - DNA, 230 bp, Homo sapiens
tttgaagtgaacagatcttgtccggaacaccctgcggactgacctgcgggcttgcttgctgactcctctcaaagggacagagcgcccctgctccaggggaggaggctcaccggaccctggggcagagctgagcttggaaaccagcggaacagggaccccttctgatctgacttcagagtaatggttctccttcctcctgagggacccaaattgatgagagcaagtttgag

SEQ ID NO: 1768 - DNA, 350 bp, Homo sapiens
gaaacaccctgttgatcccttcccaggctcggcactgtctgctcactggagccggactcccaggttgtaattctaatgttgcctcatgagaacagaatggcagaagtttagtcctgacagattccccatagggagtaatgaggacagcatgaaacttggataggttttaccttagtcctataaggtggattttactaaggtttttaaatgatactgtcatcctcttggggtttatcagccaggttagaggagcccagtgtcctcacctctctcagatcatggcagagaaggagctgcctccagcccctctctgctgagtctcatttgagcagttccatgttagacataca

SEQ ID NO: 1769 - DNA, 130 bp, Homo sapiens
aacttttgctcttggatttaagtcaaggtactgtatagaagttgtgtaaaatcagtatgaaagttcaatgttgctgttcttgctcagtggattttaaagaattgagtagttcctatgtgatttttttttt

SEQ ID NO: 1770 - DNA, 310 bp, Homo sapiens
ggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaggatcaggcaaaaatgatcatgccgaaaaagtgcggaaaagctagaagctctctcggtgaaggaggagaccacggaggatgctgaggagaagcaataaatcgtcttattttattttctcatctctctttcctctcctctttttaaaaaattttaccctgcccctctttttc

SEQ ID NO: 1771 - DNA, 210 bp, Homo sapiens
tccaactacccgggactcagtattagccttcgctcactggcttctctgcacaagaggcggcttcggagtagccctcggtgaagccccagaccacagctatgagtcccttcgtgtgacgtctgcgcagagaacatgttctgcatgtgcagctcaaccggcccaacaagaggagtgtcatgacacaggtcttcttgagagagatggtagagt

SEQ ID NO: 1772 - DNA, 115 bp, Homo sapiens
ttttgcacagtcttccagcagttcggcagtatctgttttcactctatgaatgccgttactctgttttcttccaatcattagcggttgtgggacacggaaatgaaaaaggactcgc

SEQ ID NO: 1773 - DNA, 200 bp, Homo sapiens
gccttaacacggccccatttgatcagttccctgccaactcttgtatcctcatttcactaagctttgttacactcactagactgttaacaacggagaaaaactgttggtactgaatatgccatatacaacttgctatttattctgttcccgtttagagaggcattgctacccttaactatctgaactctttctgtgctctg

SEQ ID NO: 1774 - DNA, 612 bp, Homo sapiens
aaaagccttaacacggccccatttgatcagttccctgccaactcttgtatcctcatttcactaagctttgttacactcactagactgttaacaacggagaaaaacctgtgggtactgaatatgccatatacaacttgctatttattctgttccctgtttagaaggccatggctacccttaactatctgaactcttcctgtcctgtaagactgagctcactggcaatatcctataggctgctttccctaagcctccccatctttcttcctccctctttctacttctctcctacctccttttccctctctcccctactcacctgctttccttttgcccctcccacatcctcttcccccttcttgtcatttttccatgtcaagaaatttccagatatataggaatatgatggagaatgctgacaggcagttctttgagtagtcaaattaagatgtaatggttgaattgtataatggcaatcacataaactacatatataaagcttctagcttagtaaactctaaatgtgtttttttaaactaaagaatgagggggcaggcgtggtggctcatgcctgtaatcccaacatttaggaggctgaggcatgaggatcgc

SEQ ID NO: 1775 - DNA, 150 bp, Homo sapiens
ctcgtgccgaattcggcacgagagacctgaagcagttcagttctttaatgtgaccacactccagaagggagctgtatgactttgctaaggaaaatataatggatgatgatgagggagaagttgtggatatgtggatgaccccttggaact

SEQ ID NO: 1776 - DNA, 215 bp, Homo sapiens
gaggagctgtgccggcagatccaggaggaggaggacgagaagcagcggctgcagaatgaggtgaggcagctgacagagaagctggcccgcgtcaacgagaacctgcacgcaagattgcctctcgcaacgagttcgacccgaccatcgcggagacggaggcgcctacctcaagatactcagagagctcccagactttgctcagcgttctcaagagg

SEQ ID NO: 1777 - DNA, 170 bp, Homo sapiens
gctcaggctcagctgtcaagatagaaggacatggaaacccattcagcacctcaacatctccagctacatctggagattctggctcctactctacggtattgtgggggtattaatggaatttggtacatcctaagctcaggggaccatcaaaacagagacaacagttctga

SEQ ID NO: 1778 - DNA, 366 bp, Homo sapiens
aattcggcacgagcgattggcgacggtcgcagcaaatccagctgctgctgcggcggctgtggcggcggcagcagcggtgactgaggatagagagccacagcacgaggagctgcaggcctggacagccagtcgcgccagtagaaacggcgagagtgggcagaacgtccactgcgggccggcgaaagtggttccttgtggagagcactggtataggcagtggaggcatacgtcagggaggggacaggactcagcaccttctggctgcatcacaatgcacactcttcaggatgagataactggcgctcaggaggtactgtggaggcgaggatatgtctgctccagcagctgctgcatacctggtcagct

SEQ ID NO: 1779 - DNA, 120 bp, Homo sapiens
gaaaagcgaatgaagaagggaggcggcaggcagcccttcaggttggcccagggcttcaatctggcgcatgcaagtacgtcccgaacaattcagctggaggattcttccctcaaggcccaa

SEQ ID NO: 1780 - DNA, 309 bp, Homo sapiens
gaaaagcgaatgagaaggagcggcaggcagccctgcaggtggccgagggcttcatctcgcgcatgcagtacgccccgaacactcaggtggagattctgcctcagggccatgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgcaaaaaaaaaaaaaaaaaa

SEQ ID NO: 1781 - DNA, 120 bp, Homo sapiens
acaattgagacaccatcctgagttccaagagatccagggtagtcgtcttgccacttaggaggatacttaattgtgacaaggttaattggttccagcacaaccaacatggcacaatgtttt

SEQ ID NO: 1782 - DNA, 244 bp, Homo sapiens
acaatgagacaccatcctgagttccaagagatccagggtagtcgtcttgccactgagaagatactaattgtgacaagttaatgggtgcagcacaccagcatggcacatgtatacatatgtaactaacctgcacattgtgtacatgtaccctagaacttaaagtataataataataaaataaaataaaaataaaataaaatctaatcttctgtgcaggcaaaaaaaaaaaaaaaaaaaaaaaaaa

SEQ ID NO: 1783 - DNA, 125 bp, Homo sapiens
aacaacagctagcaaccttcagaaaaataaaaccgctagctccacgacaaaggagaaggagacaaaactacctttactttcccgtgttccaaggtcctggttccctcttagtaccattaaaatgc

SEQ ID NO: 1784 - DNA, 621 bp, Homo sapiens
aaaaaagctagcaaccttcagaaaaataaaaccgctagctccacgacaaaggagaaggagacaaaactacctttactttcccgtgttccaagtgctggttcctctctagtaccattaaatgctaaaaattgtgctcttccagtttctaaaaaagataaagagcgttcctcatctaaagaatgttctgggcattctacagaatccaccaaacacaaggaacacaaagcaaagactaataaggccgattctaatgtatcttcagggaaaatttatgggggacctttgcgctcagaatatggcactcctacaaagtctccccctgctgctttggaagttgtgccatgtatcccaagccctgcagcaccttcagataaagccccttcagaaggagagagttcaggaaattccaatgcaggtagcagtgcactgaaaagaaaactaaggggtgattttgatagtgatgaagaaagtttaggttacaacctagacagtgatgaggaagaggaacattaaagtcactgggaagaaataatggctttgacttcaatcagactcctgcagctacaggaaagctcctgctctttccaaggggcttagatctcagtcatcagactatacagg

SEQ ID NO: 1785 - DNA, 165 bp, Homo sapiens
gcaaaaccagcgtggcggcccgcgctctcttccaggacatcaagaagccagctgaaggatgagtgggtaaaaccccagacgccatgaaagctgccatggccctggagaaaaagcctgaaccaggcccttttgggtcttcatgccctaggttctgcccaacggacc

SEQ ID NO: 1786 - DNA, 100 bp, Homo sapiens
ttcgtaggtagggttcgtaggtagggttagtagcacgtctgtactgcttcacctgtgcttcctgttcccaaatcaaagggcctaaggtggtccctccttt

SEQ ID NO: 1787 - DNA, 150 bp, Homo sapiens
ccgagcaggaggcgccatcatgggagtagacatccgccataacaaggaccgaaaggttcggcgcaaggagcccaaggagccaggattatttaccctaggcgtgttggtcaaagttaataaaggtttcttgccgaaggacccaacttcaca

SEQ ID NO: 1788 - DNA, 280 bp, Homo sapiens
cagactcatctcacacataataaataaatmaataaataaataaataaataaataaataacaatgacacatagaattactatgtcaattagcaagtccacttctggtttaacccacaaaaattgacagcagggacttcaacagatatttgtaaattcatgcgtatagcaacattattcatgatagccaaaaggtggaagcattcattgacagaggatggataccacatgtgtacagatatacagtggcacattacttagccttcaacaggacattctgtgg

SEQ ID NO: 1789 - DNA, 320 bp, Homo sapiens
aaccctgcggagggacttcaatcacatcaatgtagactcagccttcttggaaagaaaaaaaagaggctcccgggttgacaaatggtggggtaacaagaaaggaacttggctaccgttcggactatttgttagtcatagtacagaacatgatcaagggtgttacactggggcttccgttacacagatgagggtctgtgtatgctcacttcccatcaacgttgttatccaggagagtgggtctcttgttgaaatccgaaattcttgggtgaaacatacatccgcagggttcggatgagaccacggtgttgcttgttcagtat

SEQ ID NO: 1790 - DNA, 310 bp, Homo sapiens
ctggggcagctgcttgagaacagagactgctaccccatcctgcccatgcaggcaggctcttgccagccccgttctgacccgtgtccccccaggctctgcctgggcagaagactcaccttggaggagtgggccctcggagtgctgtccctcccagaagcccccagggtggggatttctcaggctgtcagtgcaggcccaggtctcaggagaaggggaggccctggctctccgggatcagtcctaggacacaggctcagcctcaggttgatgggggatgatgtgctcccgggctgcctcctgcacggggctc

SEQ ID NO: 1791 - DNA, 126 bp, Homo sapiens
atttagttcccattttccacggtgattgactcaatttaagtgtattgtggctatatgtaatttacaggctgctttgcgttgcaggtgggaaaatttcccaggcttgtgtgaggctgaacttgggta

SEQ ID NO: 1792 - DNA, 130 bp, Homo sapiens
ccggcaaaacgcagcagtagcagaggcagcttctgagagcctgggcaggcagcagctggctgaccaagtccactggaagagaaggctttgtgccaaccgggagaaggaagccggggacaggatggagagc

SEQ ID NO: 1793 - DNA, 250 bp, Homo sapiens
gggatatcatcaccgatcccacagaaatacaaactaccatcagagaacactataaacacctctacacaaataaactagaaaatctagaagaaattgataaattcctggacacatacaccctctcatgtataaccagaagagttgaatctctgaatagacccataacaggctctgaaattgaggcaataattaatagctctaaccacccaaaaaaagtgcccaggcccatagggttcacagacccaattct

SEQ ID NO: 1794 - DNA, 128 bp, Homo sapiens
tcgtgccgaattcggcacgaggctcccccaaaaatttgaatttttttttcaacactcttacacctgttatggaaaatgtcaacctctgtaagaaaaccaaaataaaaattgaaaaataaaaaccataa

SEQ ID NO: 1795 - DNA, 238 bp, Homo sapiens
aggtcgacactagtggatccaaagaattcggcacgagaacggttatagtcagacaatgaatgccttttctttggggatgtctcattttacttcatgccattttatctttttatccaattttaagggcttaattaactattaacatgacaattggggaattgagtctctttaccatatttcagcccagatatacttttgttccctggagggtcttttaactgtatttttaaaattaaat

SEQ ID NO: 1796 - DNA, 600 bp, Homo sapiens
aacgggttatagtcagaaaatgaatgctttttctttggggatgtttcattttacttcatgccattttatctttttatccaattttaaggctaataactattaacatgacaaatggggaatgagtctctgtaccatatttcagcccagatataatttttgtcccttgagggttctctaaatgtatttttaaaaataaaatgtattttaaagctgatttttatggtatagtgttctatgaaatcctttgaattacacgtttactgaataaatattgtagtacaaaatccatggtatataactctataaatttatttgaatgagtaatgttcactgaacagctaccatagtaaaaaaaaattaaccatgttgtatttgcattttttcctaccagtttgaattaaagataaaatatgtttatacatttaaacataagtatttatatctatggttagaatcttatacatatttggtatttttaattttaaatgctatataacctactttcagataaacaatgttgaacaggaagacccttaattaaatgggttgcttacttcacttttataagaaatttaaattgtggtatacaattagctatga

SEQ ID NO: 1797 - DNA, 257 bp, Homo sapiens
tgccgattgtggccatccagctgaccttcctgcgcctgatgtccaccgaggcctcccagaacatcacctaccactgcaagaacagcgtggcctacatggaccagcagactggcaacctcaagagggccctcctcctccagggctccaacgagatcgagatccgcgccgagggcaacagccgcttcacctacagcgtcactctcgatcggctgcacgagtcacaccgcagcctggggcaggacagtgattgatacaca

SEQ ID NO: 1798 - DNA, 392 bp, Homo sapiens
gtctgccaggacctcagggtccacctggacctcaaggaccaagtggtctgtccattcaaggaatgcccggaatgccaggggaaaaaggagagaaaggagatactggccttccaggtccacagggtatcccaggaggcgttggttcaccaggacgtgatggctcaccaggccacaggggccttccgggaaaggatggatcctcgggacctccaggaccaccagggccaataggcattcctggcacccctggagtcccagggatcacaggaggcatgggaccgcaaggcgccctgggaccacctggtgtcctggagcaaagggggacgaggagagcggggtacctccagtctcaggccatggtgagatcagtggcgcgtcaagtatcctacaag

SEQ ID NO: 1799 - DNA, 297 bp, Homo sapiens
tctcctcactcccttctacctgccactcacacagccaggtgcctttggagggtcccaagctggggcccagcccaccctcctgtcttcccagggtagcccgcctgccagtcctagctgcacagggcagctgggcccaaccctgtctttagagggccctggtgttttctagcacttgccttcacggtgggccttgcttgggacggggggcccagtcaggctttttcccagtctatccagagaggccccttcccatgggagacgagggcctcgggcccagccccacagctcttctgatct

SEQ ID NO: 1800 - DNA, 208 bp, Homo sapiens
ttttacttactgtaaagagtcattttcataaagatcaattcattgatttgttttttgtaaagctatcattcaatatatattataaattcgatataagtttcaaggggaagctcttattgtaagggggctttagagccaaactgtttaagctggaatccaacccaacaaaggaatcctttcaaggacgggggcaatgcaataagcttaa

SEQ ID NO: 1801 - DNA, 235 bp, Homo sapiens
aattgaattcatgtttaataattacaggcaccgtgcccccccttccccctgcccaggcaacagcaggggtggtacaggggctggggcatatgcccccagcagcgaggacggcagtcccgagagttattttcagaaaataaaaaaagggaccccaggggcaggcgttggtgcccctctcgtgccgaattcggcacgagttggaattggtgacgggtytaatgatgatgatgacaat

SEQ ID NO: 1802 - DNA, 346 bp, Homo sapiens
ctcgtgccgaattcggcacgagggacataggagggcccgagcaggaattcggtggtggacatagggccggtctgcttcttgtaaaagcctgaacccagaaacaacacaatccgttgcaaacccaaaggacccaggtactttccaatctcagtcactctgggactctgcactgaatggctgacctgacctgatgtccattcatcccaccctctcacagttgggacttttctcccctctctttctaggaaacctgactgggcagactccaaataaaatctgggggtctatttattatgtctcctgctagacctcggggtcaggcagagcgggaaactactggtgttgt

SEQ ID NO: 1803 - DNA, 211 bp, Homo sapiens
aaatttggagctccacagaaggatgttaagcatctggctattcttggtgcaggcctgatgggagcaggcatcgcccaagtctccgtggataaggggctaaagactatacttaaagatgccaccctcactgcgctagaccgaggacagcaacaaggtttcaaaggatttgattgacaaagttaaggaggaagctttacatcatttgaagggt

SEQ ID NO: 1804 - DNA, 236 bp, Homo sapiens
gtgatttctctactggcgaaacctgtatccgggcccaacctgaaaacatcccagccaagaactggttataggagctccaaggacaagaaacacgtctggctaggagaaactatcaatgctggcagccagtttgaatataatgtagaaggagtgacttccaaggaaatggctaccaacttgccttaatgcgcctgctggccaactatgcctctcagaacatcacctcccactgcaag

SEQ ID NO: 1805 - DNA, 174 bp, Homo sapiens
cagaaatacccacaactgtaaacagtaggtccatgcagtgcgcattggacacacagcacctgtggaaagtaggaacccaaggccaataaacttggttcttttgactacatgatactatttatttcatggatgttatgctgtatccaaatggttattgagtgaatcaggagcacc

SEQ ID NO: 1806 - DNA, 184 bp, Homo sapiens
ctcgtccgaatttcggcagaggggtgaaagaagctgagctgaaccacattacgatggatgatggaaccataagactatcaagaatcaaagtggtaatgggccgaagtttattcaagcatccggcaatggacttatcgtagttggggaaaagggtgttccgaataatatcctggaagttattagg

SEQ ID NO: 1807 - DNA, 160 bp, Homo sapiens
gtgagaagcttcatttagtgtttaaaaatgtggggagataaatcagacttaacatgtatgtaagatcaattcacttaaaagtatggtccaaatagcaaaaataggaccaggtgaaccatgtagtcattttttaaaaccatgtacttggtcttttgtgtgt

SEQ ID NO: 1808 - DNA, 167 bp, Homo sapiens
cggaggcgttcagctgcttcaagatgaagctgaacatctccttcccagccactggctgccagaaactcattgaagtggacgatgaacgcaaacttcgtactttctatgagaagcgtatggccacagaagttgctgctgacggtctgggttaagaatggaggggttat

SEQ ID NO: 1809 - DNA, 163 bp, Homo sapiens
ggccggcgcctgaaaggtgagttgaggccctcggcagctgcagccggggtgtctggtacccccccggcgtggtgcttagcccaggactttcagacgcggccgctggccgggaggttttggtgggagagacgggatcgctgatttcggtcttggcgccccttct

SEQ ID NO: 1810 - DNA, 207 bp, Homo sapiens
gcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgc

SEQ ID NO: 1811 - DNA, 344 bp, Homo sapiens
cggcacgagggaacgtctgaggttatcaataagctcctagtccagacggccatgggtcatttcacagaggaggacaaggctactatcacaagcctgtggggcaaggtgaatgtggaagatgctggaggagaaacccttggaaggctcctgggttgtctacccatggacccagaggttctttgcagctttggcaacctgttctctgcctttgccatcatgggcaaccccaagttaggcacattgcaaggaggtgcttgctttcttgggggatgccttaagcacctggtgtttttaggggccttttcccagtttggtcacttacttttgacgtttgcttgggttcc

SEQ ID NO: 1812 - DNA, 283 bp, Homo sapiens
cggcacgaggatttgagaagctgttacaagtattaggcagagttatttttcctgttttacatttttttttttttttttggggaaaaaattgggtagggtgttctaattacctgttttaccttcattggttattattgcaggttaaaggttttaaaccaaccacttgcatggtttgcttttgatggattccctttgggaaaatttgcacttttcgggggccacttggggaaattgcgcatttcactcttccctctcttttcccccttccttttggcgagaccgt

SEQ ID NO: 1813 - DNA, 252 bp, Homo sapiens
ggcaggttggaggagctgcagctaccaggtccaggcccagccagcagggccttgccaaggtccggaagccaggccggtgccaagagtcccagcaaagggtgcaggcctttgttgtccacggcaggagggccagccagggtagtgtaaagagaacccagggcgctacactgtatcacattggcgtgggagcgcccagtccccttacacgggatcccttggacgcccagaggggaagtttttgtaactttcatc

SEQ ID NO: 1814 - DNA, 464 bp, Homo sapiens
ggcaggtggaggagctgcagctacaggtccaggcccagcagcaggcctggcaggtgcgaagcccagcggtgcagagtccagcaaaggtgcagcctttgtgtccaagcaggagggcagcgaggtagtgaagagacccaggcgctacctgtatcaatggctgggagccccagtcccctacccggatcccctggagcccaggagggaggtgtgtgagctcaatccggactgtgacgagttggctgaccacatcggctttcaggaggcctatcggcgcttctacggcccggtctagggtgtcgctctgctggcctggccggcaaccccagttctgctcctctccaggcacccttctttcctcttccccttgcccttgccctgacctcccagccctatggatgtggggtccccatcatcccagctgctcccaaataaactccagaagaggaaaaaaaaaaaaaaaaaaa

SEQ ID NO: 1815 - DNA, 209 bp, Homo sapiens
agaatcttagttcacctttaaatttgccaacagacccctctaaatccctgtgtaattttaactgtttagcccaaagagagaccagctctttggaccactagggaaaaaccctttgatggagagaggtaaaaaattttaccaccctctggtaggcctaaagacagccaccattgagagaaacgcttccagttcaacaacgatacactaag

SEQ ID NO: 1816 - DNA, 184 bp, Homo sapiens
gtggctaggtcggttcctctcctttccagtcggagacctctgccgcaaacattgctccgccaggaccatcggtcaggccaagaggcattccggccttgatctcccctctttgtattttattggagactgtgaggctaacgtgagccaccattgtagtctcttgtcggctctggcattggttcaa

SEQ ID NO: 1817 - DNA, 185 bp, Homo sapiens
gccacctggtacttgtccaccctgcctcctctgttctgaaattccatccccctcagcttaggggaatgcacctttttccctttccttcttaattttgccatgtttttactgatcattcggtatgttaacccttcttagcccttagccttggagaggagagcttttacagcctacagtcagagttt

SEQ ID NO: 1818 - DNA, 226 bp, Homo sapiens
ctcaaaacagcctctgacttcatcaccaggatggactaccccaagcagactcaggtctcggtccttcctgaaggcggtgagaccccactgttcaagcagttcttcaagaactggcgggacccaaaccagacaagatggccttggctttgtctatactttcacagccaatatcgccacactgagacggtctcccttcggacgccagcaactctaaaaacatcccatc

SEQ ID NO: 1819 - DNA, 199 bp, Homo sapiens
cggcacgagcaaagatatagttagataggaggaataagtttccgtgttacattgcacagcagggttgtctatagttaacaatatagtgtatctttcaaaatagctaaaagaaaagattttgaatgttctccccacaaaggaacaaatatttgaatgtgatggaatatatctaatttccctaattttggatccatggcac

SEQ ID NO: 1820 - DNA, 222 bp, Homo sapiens
aaaagctggaagatggccctaaattcttgaagtctggtgatgctgccattgttgatatggttcctggcaagcccatgtgtgttgagagcttctcagactatccacctttgggtcgctttgctgttcgtgaatatgagacagcaggttgcggttggtgtcatcacagcagtgggacaagaaggctgcctggagcttggcagggtcacacagtcttctcagaag

SEQ ID NO: 1821 - DNA, 187 bp, Homo sapiens
gtggattgtgtgtctgagaatgatggctgtggagggggctacatgaccaatgccttccaatatgtgcagaagaaccggggtattgactctgaagatgcctacccatatgtgggacaggaagagagttgttatgtacaacccaacaggcaaggccgcctaaatgcaggaggtcacagagagttccccg

SEQ ID NO: 1822 - DNA, 118 bp, Homo sapiens
ccgcgcggtgaggttgtctagtccacgctcggagccatgccgtccaagggcccgctgcagtctgtgcaggtcttcggacgcaagaagacagccgacagtgttgggcgcactgcaaacg

SEQ ID NO: 1823 - DNA, 142 bp, Homo sapiens
gtcctctgccagcctacaggaggaaaagcaaggcttacagaaggatgttccttcaggaggaagcagcactaaaagcactctgagtcaagatgagttggaaaccatcttctggttgccggattcgggccgggccggttcccgt

SEQ ID NO: 1824 - DNA, 130 bp, Homo sapiens
cttgttcaacctcagctcagaatatgtgtacagcaagtgtttttgctgtaccacaaaatttgaggttaggcaaattcacaaatacgggatccatgaattaacgaggatcaactgtacttgactatatttg

SEQ ID NO: 1825 - DNA, 202 bp, Homo sapiens
gaaagctcagctggtggtgattgcacacgacgtggatcccatcgagctggttgtcttcttgcctgccctgtgtcgtaaaattgggggtcccttactgcattatcaagggaaaggcaagactgggacgtctagtccacaggaggaccttgcaccactttcgcctttcacacaggttaactctggaagacacaggcgctttggc

SEQ ID NO: 1826 - DNA, 106 bp, Homo sapiens
attattttgttcttgtgggcagaagtgggaatgatggaatatcctcacggaaaaggcagttaagttgggagtactgcttacaaaacaagggtcaccagttcattat

SEQ ID NO: 1827 - DNA, 117 bp, Homo sapiens
ctcgtgccgaattcggcacgagtatctagaataggagaatacataaagaaagaaagtagatgaggtcttcccaggagctgcggggacgggagaataaggggtgacttccaagggagt

SEQ ID NO: 1828 - DNA, 120 bp, Homo sapiens
agaactggttctacacgcgagctgcttccacagcgcggcacctgtacctccggggtggcgctggggttggctccatgaccaagatctatgggggacgtcagagaaacggcgtcatgccca

SEQ ID NO: 1829 - DNA, 126 bp, Homo sapiens
tctcagtagagtactggctccttttataatttgttaccagctttacttttgtgataaaatattgatgttgtattttacactcttaagtcttaaccacagtcaggattatcttaatggtgattatta

SEQ ID NO: 1830 - DNA, 134 bp, Homo sapiens
cgcacatccgcgccaagaggaagcgggaggagctgagcaacgtactggcccccatgaggaaagcttgcttgccaagaaaggactgaggcccctcccctgccctcttccttgaaataaagaccagctttgacaga

SEQ ID NO: 1831 - DNA, 140 bp, Homo sapiens
atgttgagcaaagcttaggccaacatgaattgtttgtgaagtgtggttgatggtgctttgtttttttctgactacttctatggaaggccagtgaagaagcaaaggaagacaagaaaattgacgctcaatcttcttcccat

SEQ ID NO: 1832 - DNA, 224 bp, Homo sapiens
ctggcacagtggttcacacctgtaatcccagcactttgggaggcctaggcaggctggtcttgaactcctgggctcaagtgatcctcccacctcagtctcccaaagtgctggaattacaggtgtgagccactgcgcacggccagtcttttattttaattggtgacttaaaaatcagctggtgtgttgttacagagaacagtgctaattctaattttgtgtgacac

SEQ ID NO: 1833 - DNA, 235 bp, Homo sapiens
tgcggcacgagcacaggtgtcgtgaaaactacccctaaaagccaaaatgggaaaggaaaagactcatatcaacaatgtcgtcatttgacacgtagattcgggcaagttcaccactactggccatctgatctataaatgcggtggcatcggcaaaagaccattgaaaaatttgagaaggaggctgctgagattggaaaggctccttcaagaatgtccttggtctttgataaactaa

SEQ ID NO: 1834 - DNA, 230 bp, Homo sapiens
ctgacttgctgtgtgaccctgggcaagtcacttaactataaggtgcctcagttttccttctgttaaaatggggataataatactgacctacctcaaagggcagttttgaggcatgacttattctttttaggaagcatttttggattcctcagcacagaggattcttaagagccttgagtattttttatatataggaatgtgcaccatgtgactcttatacggcgtgtgtg

SEQ ID NO: 1835 - DNA, 360 bp, Homo sapiens
ctcgtgccgaattcggcacgaggagggagagcagatgcagctccaggggctcgacttatagccagttacagctccccggctctctggatggcagagcgtcgtttccgggccctcaggctggggagctcagttcccattgcttgtgctcagggctgagtcttaaagaagggtttgccggccctaacgctgcagcgcgtgcgcggtgagaggccctttttgagcctgtatactcctgtggcctgggacagaacagtaaatactctgtgcacggaggaaagacatgcccaagaggaagggatgtactgcaccatcggctgcctgtgagcagcttagcaaggagcccttgctcctggaaaggcg

SEQ ID NO: 1836 - DNA, 210 bp, Homo sapiens
aaggaagaggtcagggttgacgagagctccaggaaggatgaaagtgcctctggaaggcaggaggaaagtactgtaatactttatcctagggtgggaccaagagtcttggaaagctctgccctataaagtccctttcccaatttcttccaggtcccaggtgttggtgtgataaggagagtttgcccaatctctggagctcaggggtctcta

SEQ ID NO: 1837 - DNA, 170 bp, Homo sapiens
aaaagatccaatttattttgtggtaattttgctagacaaagctctctagggttgagtcaaggtacaggtacatgggaaggaaggccaatgcatgtagacttcataagatacttattacagttcacttataggttctctccagtcaagatgcaatgttgccaatcaagagt

SEQ ID NO: 1838 - DNA, 200 bp, Homo sapiens
gacacattttttaggaaatgtttttaataaaagaaaattacaaaaaaaattttaaagacccctaaccctttgtgtgctctccattctgctccttccccatcgttgcccccatttctgaggtgcactgggaggctccccttctattttgggcttgatgactttctttttgtagctctggctttgatgtttcttcactgtca

SEQ ID NO: 1839 - DNA, 170 bp, Homo sapiens
ttgagaagaaacttaatcagaatagcaggtcagaggctcctaactggcaactcaagattctggcttctactgaaggaccataaagaaaagatgaaaaaaaaaactttcaaagaaggtgaaataataaaactattatataaagggtgcttacattttggaaacaacatatt

SEQ ID NO: 1840 - DNA, 375 bp, Homo sapiens
cagtctcttccccacaacaatattcatgtgcctagaccaagaagttattatctcgaactgacactgagccacaacccaaacaacccagctcttcctaaggttcaaactagactacttctccataatattcatccctgtagcattgttcgttacatggtccatcatagaattctcactgtgatatataaactcagagccccaacattaatcagttcttcaaatatctactcatcttctcattaccatactaatcttagtgaccgctaacaacctatttccacctgttcatcggctgagagggcgtaggagttatatctcttgctcatcagttgatgatacgcccggcagtgccaccacagcagccatttaggcatt

SEQ ID NO: 1841 - DNA, 260 bp, Homo sapiens
agtcatcaacgggatacagttccatattgccttaaacctccttgttttagacacactaacatttataccaaattgcagattattctgcagagagggaattgcatgtttgtgttgtatatttagtatgaactcttttcagaatataatatttctcaggtatcacaagtaggttgggaacatattgcaagactatgaacacagagttgctgctcttatattttcactccagagtgtgaattcacagccccatattatatatc

SEQ ID NO: 1842 - DNA, 290 bp, Homo sapiens
tcctgtggctccttttggggcttgtgcttggcagttcctgtgctgtcctgtctcccagatcctgagaccctggctgagaacttggcccagcctgctgcttaaaggcaccatggggacctgggttgccctgagacccaagccattgttagcagctagccagccacaccaaccacggcagggggaggaaagggaaggacttggagagacacagagaccagagccagccatagggacaagagagttcagatttaggcctcttctcatggtcccccaccccagatgccgctagt

SEQ ID NO: 1843 - DNA, 105 bp, Homo sapiens
ctcgtgccgaattcggcacgagggcaaatacaaggaagaaaccattgagaagatgcaggaataaagtaatcttatatacaagcttctattaatacttgaacaaaa

SEQ ID NO: 1844 - DNA, 360 bp, Homo sapiens
gccgttctggtaaaaagctggaagatggccctaaattcttgaagtctggtgatgctgccattgttgatatggttcctggcaagcccatgtgtgttgagagcttctcagactatccacctttggtcgctttgctgttcgtgatatgagacagacagttgcggtgggtgtcatcaaagcagtgacaagaaggctgcttgagcttgcaaggtcaccaagtctgcccagaaagctcagaaggctatatgaatattatccctaatatctcccaccccactcttaatcagcgggtggaggagcgctctcagagctctttgtttcaatttgccatattaagtgtagtagtgaaagactcgttaatga

SEQ ID NO: 1845 - DNA, 330 bp, Homo sapiens
acacacttctgctttcacttaagtgtctggcccgcaatactgtaggaacaagcatgatcttgttactgtgatattttaaatatccacagtactcactttttccaaatgatcctagtaattgcctagaatatatctttctcttacctgttatttatcaattttcccagtattttatacggaraaaattgtattgaaacacttagtatgcagttgataagaggaatttgggataattatcagtgggagaatattttttatactgtatgtgccacagctttactactgtggagagacaactgttttaataaaagagttacattccacaaaaaa

SEQ ID NO: 1846 - DNA, 200 bp, Homo sapiens
attttagagtacaaaagaagaaatgggctggaataaacttttgaaacactaatgtagtatgctccgtatagtgattgtagctgttcctctggattcaccatctgttgagttgtaaatgtgagagaaaaagttatatgtgaatatatatcaagccagcatttgtattttgcatcattaaataaagaggaataaaataaaaa

SEQ ID NO: 1847 - DNA, 235 bp, Homo sapiens
gaaaaactggaaactctaaaaatcagaggacctctcctcctccaaaggaacacagctcctcaccagcaatggaaaaaagctggatggagaatgactttgacgagttgagagaaggaaggcttcagacggttcaaactactccgagccaccaggaggaaggtcggaccattgcaaagaaggttaaaacctttgaaaaaaaattagacggatggatatactagagatacccatgtag

SEQ ID NO: 1848 - DNA, 224 bp, Homo sapiens
gtggaaattttttgttatccttgctggtggcccgtgaaagacaccttactatttaatgtgaaatataggtaggaaagagtgtagagtccgctatgagcccgaagatatttggcctccagttatattgcttgacaactggtagacaagggtttcctattgcctggaaatcttccagtcggaggtaattggcccacagatacagctcggtctctctgtccctctcg

SEQ ID NO: 1849 - DNA, 166 bp, Homo sapiens
cggcacgaggccacattgagatgatccttacggaaaaggaacagattgttcctaaaccagaagaggaggttgcccagaaggaaaaagatattccagaagaaacttaaggaacaaaaacttattggacggggagttaatttaggcattaaaattaattgtatttaaa

SEQ ID NO: 1850 - DNA, 323 bp, Homo sapiens
cccttgcaaggtgacaggccgctgcggctctgtgctggtacggctcatccctgcacccaggggcactggcatcgtctccgcacctgtgcctaagaagctgctcatgatggctgggatcgatgacttctacaacctaggcccggggcagaactgccaccctggggcaacttcgccagggccacctttgatgccattttctaagacctacagctacctgacccccgacctctggagggagactgtattcaccaagtctccctatcaggagttcactgaccacctcgtcaagacccacaccagagtctccgtgcagcggactcagg

SEQ ID NO: 1851 - DNA, 192 bp, Homo sapiens
agttaacttatttacaatatttaagttctctgcttctgcatttggttggtttcctgaagcgcagcccctgttaataacaaggttgcttttcattggtttcttttgtcaagagaaaattgattaagggcttaatttgaggatttaccagaagcagattaacctcagaaatcctgtctggctggcagatttcar

SEQ ID NO: 1852 - DNA, 257 bp, Homo sapiens
ccgcgacgagtaggagggccgctgcggtgagccttgaagcctagggcgcgggcccgggtggagccgccgcagggtgcagatcttggtggtagtagcaaatatttcaacytaggattcaagatttcagtatgtgttttaaaccataattttttcccatatccctggactcttgagaaaattggtacagaaatggaaatttgccttgttgcaccatacacttgcaaaagatgagtttaaaaaattacatacaaacagct

SEQ ID NO: 1853 - DNA, 230 bp, Homo sapiens
ctcgtgccgaattcggcacgagtattggtttccttcttcaccttgaacttttgttgaactgtatgtactttaccccaaaactgttagtattttgagggcttctatttgaaagcaaaggaataattttgattactctggcattcataaattttattgatgagattattaattttaaaggtttgaggtaacatctctggttgtaccacagagagagataaatatggtttctt

SEQ ID NO: 1854 - DNA, 199 bp, Homo sapiens
cggaggtggcagccatctccttctcggcatcatggccgccctcagaccccttgtgaagcccaagatcgtcaaaaagagaaccaagaagttcaatcggcaaccatcaagaaccatattgtcaaaatttagccgttacttggsggaaaccaagaaggcaattaacaccagggtttcgtagaggattcaagggccagatctt

SEQ ID NO: 1855 - DNA, 205 bp, Homo sapiens
ctcgtgccgaattcggcacgagatatagtaccgcaagtgaaagatgaaaaattataaccaagcataatatagcaaggactaaccccgataccttctgcataatgaatttactaggaattactttgcaagggggagccaaagcttaggaccccgaaaaccagccggagctaccttaagaccaggctaaaggagcacacccgtctat

SEQ ID NO: 1856 - DNA, 179 bp, Homo sapiens
ctcaccagaagcagacgctggcaccgtgctgcttgtacagcctgcagagccgtgagccaagtaaacctctttaattacccagcctcagggccagacccgagggtttctgagccgtgactttggcctaaggcctttaattgctttgggcttgcaaagggaggtcaagaacacctcccgtk

SEQ ID NO: 1857 - DNA, 216 bp, Homo sapiens
atgctctggtggctggaattgaccgctacccccgcaaagtgacagctgccatgggcaagaagaagatcgccaagagatcaaagataaaatcttttggtgaaagttgtataactacaattacctaattgccacaagggacttttgttggtaatcccttgggacaaaactgttgttcattagggttgtttttaagaggttccctgctcttacaccgca

SEQ ID NO: 1858 - DNA, 128 bp, Homo sapiens
ttcttgttcaggactgtcatagccacagtttgcaaaaagtgcagctattgattattgcaattgtaggtgtcaattaggatggtacattccctgagggccttttaatctgttgtagctttgtctttttc

SEQ ID NO: 1859 - DNA, 213 bp, Homo sapiens
gctcagcctagtgaactgcaacctcaaaggagcaaggccttgacacagttgctgggggaagtggccagagtagagatgctgggactgagggttgagcagcaaacttggtgaaactacatctccaatgtgctttctaatctcctgccagctcttttcaagcaggggatcctggggagatgtagttttcagatacctggttgggtttgggagtag

SEQ ID NO: 1860 - DNA, 245 bp, Homo sapiens
aagatggcccagtttgatgctaaaaagtttgcagagacccaacctaaaaaggacacaccacggaaagagaggggttcacgggaagagaagcagaagccccaggctgagccggaaggaggagaaaaaggcggcttcccctgctcctgaggaggagattggattgaatgtaagcaggcgctggctgctgagcccaaggccaaggaccccttcgttcaccttcccaagagtacctttgtgttggatga

SEQ ID NO: 1861 - DNA, 185 bp, Homo sapiens
taaataatgttttaccttaccaaagtatcttgttctgatttcatttttaccaaatgatattctgatctccacattcatattttggtattctcagggcgttggtagctacttggcgccaaagagttgctcttaaaatgtgtttagaattaaagcgcagggctctagggcaaaatgctccggggaca

SEQ ID NO: 1862 - DNA, 615 bp, Homo sapiens
taaatagatgttttaccttaccaaagtatcttgttctgatttcatttttaccaaatgatattctgatctccacattcatattttggtattctcagggcgttggtagctactggcgccaaagagttgctctaaaatgtgtgtagaatgaaagcgcagggctctagggacacatgctccgggaacacacagagatttgctgggaatatccatgggccccagggcacatttgcatatccagtgggatctgtcatttaggaaagattaaaaattttagttatcccttaatgttggaacagatagaccaacttcagtggtctgagagagtatggagctcactcccaaaggaatccttactatgtgtcccagatgacatacacagcattgactggcacccacgctcagagcagtcttctccaaaagataaaggacacatccaaattgaagtccttcgatctttgagaataattaaataactaactaagggaaaatgttttgataaaatgcttgccacagtacctccctaaatatctataaagacagaagattcctgattataaaacacttctgacaaaagtgatagtaaatattctcatgtatttctgaaaaaaaaaaaaa

SEQ ID NO: 1863 - DNA, 195 bp, Homo sapiens
ccactccaccctactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcattatgaattaactaggaattaactttgcaag

SEQ ID NO: 1864 - DNA, 200 bp, Homo sapiens
gcctggagttactgtaaaagacgtgaaccagcaggagttcgtcagagctctggcagcctttctcaaaaagtccgggaagctgaaagtccccggaattggttggataccgtcaagcttggccaagcacaaagagcttgcttcctacggatgagaacttggtcttacaagggaactgcttccacaagcggcaccgttacctc

SEQ ID NO: 1865 - DNA, 143 bp, Homo sapiens
ctcgtgcgaatttcggcacgagggaaaatttcctaagatcctggaggatttcctacccccgtcctcttcgagaccccagtcgttattgttggaggaagagccaccttccaagatggacacgagccacaagttgcactgtgaac

SEQ ID NO: 1866 - DNA, 240 bp, Homo sapiens
gccgagcgatgggcatctctcgggacaactggcacaagcgccgcaaaaccgggggcaagagaaagccctaccacaagaagcggaagtatgagtttgggcgcccagctgccaacaccaagatttggccccggcgcattcacacagttcgtgttcggggaggtacaaggaataccgttgccttaggtttggcggtgggatttcttccttgggcttagagtgtttggatctgtgtaaacaagg

SEQ ID NO: 1867 - DNA, 155 bp, Homo sapiens
gtgaccatggtacctggcaaaggacccagcttcccagagccattaagagaagagcaggacctagaacgcctacgggatccagaagttggtagcctccttgagcttaggctattgtgttccaaagccattcaacctttaaccccacaaccgacttg

SEQ ID NO: 1868 - DNA, 190 bp, Homo sapiens
agagtgtaaatttgccaaatttacccacgcaacagacatgattttacctaatacatgtgaattattgaagattaaactgattgaaatagtttgggaatataaaacttaagaatactttgcgccgggcacggggccttaacaccttgtaatcccagcacttttgggaggccgagcacaggtggatcagagg

SEQ ID NO: 1869 - DNA, 260 bp, Homo sapiens
ccagaacatcatccctgcctctactggcgctgccaaggctgtgggcaaggtcatccctgagctgaacgggaagctcacttggcatggccttccgtgtcccactgcaacgtgtcaatggtggacctgacctgccgtttaggaaaacctgccaaatatgatgacatcaggaggtggtgagcaggcgtcggaggcccctcagggcatcctgggctacactgagcaccaggtgtctctctgactacacagcacaccactctcca

SEQ ID NO: 1870 - DNA, 150 bp, Homo sapiens
aaagaaggaaaccctgggccacttgggccaattggacctccaggtgtacgaggcagtgtaggagaagcaggacctgaggccctcctggtgaagccttggcccaccttggcccttccggtcccccttggccaccttcacagcttgctcttg

SEQ ID NO: 1871 - DNA, 150 bp, Homo sapiens
ctacacaaaatagccagacatcatgcacctggtcccacatgttgagatatgtagtgatttatgatcataataaattagtgtttcccaaaacctacttctgttggaccttgaggtcaaataacttttggaaccttgccacttgtatcctct

SEQ ID NO: 1872 - DNA, 429 bp, Homo sapiens
gctacacaaaatagccagacatcatgcacctggtcccacaatgttgagatatgtagtgatttatgatcataataaattagtgtttcccaaaacttactctgtggaaccttgagtcaaataactttgggaactttgccaactgtatcttcttaattattgtgaaagttgtcagaatcaaaatggagtcatgaatgttaagaaaaccctgacaaatggagccaacaaaaaccataaagaaggggttctgacacttgtgtgctcgataatgaaaaagactatacaaaaaccacaacctggcacacaacccattgcaactgtacaaaaaatatatacaagaatatctgcccagcaactgcctgtccaaacttgtactgggtgtcacccttgtcattgatctttgtaaccaaagataagtatttcaaaaacaaa

SEQ ID NO: 1873 - DNA, 110 bp, Homo sapiens
atcttaaagaaacagctttcaagtgcctctctcgcagttttcaggagcgcaagataagatttgggataaggataagtctctaggtttttaacaaccgcaactctcacaaa

SEQ ID NO: 1874 - DNA, 100 bp, Homo sapiens
cgactagctcacagtcaagcgactactatactcattgatccataacttgaccacggacaagttacctagggatacaacgcaatcctattctagagtcata

SEQ ID NO: 1875 - DNA, 110 bp, Homo sapiens
cggcacgagagtacttctagagcggccgcgggccatcgattttccacccgggtggggtaccagggtaagtgtacccaatttcgccctatagtgagtcgtattacatttca

SEQ ID NO: 1876 - DNA, 225 bp, Homo sapiens
cagtttattattgttggatacaaagttcttcattgataagagtcctataaataagataaatacgaagataaagctttattctttagtgttaaaatacagtatatctaataactagcctcattagtagagcagtatattaaccaatgttttatgtaaaaaggtgtttatcttcagcaccaaatacatgatacatgtatcagtcactattaataaacagagctttca

SEQ ID NO: 1877 - DNA, 214 bp, Homo sapiens
cacagaatccatcaaccgggacagcaaagagcccttctcttcagttgagatccaggctgctctgagcaagatgcaggatgacaatcaggtcatggtgtctgagggcatcatcttcctcatcttgaggaggcctcgtcttctgaacttgggtgttcccgagagagtttgttcctgtgttcccaccttttccctgacccaaggtctttggcctcta

SEQ ID NO: 1878 - DNA, 167 bp, Homo sapiens
gatatttatagctgatcaatctatatgtgtcacagaactatgctgcctaaagtgatcttggctccttaatgggtccttttggccctttggataggttaacagctgaactaatcctaatctctcctgtggttttccttgccttaaccaacaatggtggtccttttgga

SEQ ID NO: 1879 - DNA, 170 bp, Homo sapiens
gatgcattctcttttggacatattgagttggctatctctaaaagatattcatgtgcagatgtctggcagacttattagaaatgctgggtttggacctcaagggaaaaggtaccaaaaatttggactaggtaattggatggactatttggaggttaattcctatgcttcag

SEQ ID NO: 1880 - DNA, 613 bp, Homo sapiens
gatgcattctcttttggacatattgagttggctatctctaaaagatattcatgtgcagatgtctggcagactattagaaatgctggtttggaactcaaggaaaaagttacaaaaaattggactaggttaatggatggactattttgaagttaaatcctatgcttcagtataaatgaagacatattttttttttctataaccactatgaagttcccctccccctccaaattatagtattgtctttggagtgtttgatccacattggcagggactgggatatggagaaaggagtgaaaaaaggagtttgagactacaggaaaagtcattagcaattgcacttagaattgaaaatcatgacagaaagaccggtgcagtggctcatgcctataatcccagaactttgggagcctaaggcaggtgatcgcttgagcccaggagttcaagaccagcctaggcaacatggcaaaatcttgtctttactaaaaatacaaaaaattagccaggcatggttgtgcatgcctgtagtcccagctacttaggaggctgaggtaggagaatcactgggcctgggaagtcaagcctgcagtgagctttgaatgtgcactggactcca

SEQ ID NO: 1881 - DNA, 123 bp, Homo sapiens
tcttgaacagacagaaggatgtaaaggatggataatacagcaggtgctagccaatggtctgggacaacaagctccgtgaaagactgggagcgacttgaaggaaggattcggggcccataggag

SEQ ID NO: 1882 - DNA, 175 bp, Homo sapiens
caatccctgacgcaccgccgtgatgcccagggaagacagggcgacctggaagtccaactactttccttaagatcatccaactattggatgattatccgaaatggtttcaattgttgggagcaggacaatgttgggcttcaaggaaggttgaaggaggttccgaattgtcccttcg

SEQ ID NO: 1883 - DNA, 210 bp, Homo sapiens
taagtagagactaagtggtttcatcctacctgaaaattgccttcttgaaataaatgttttgatacccactggcctatcttcctctgggaaaacaaggagtttttcaatttagaagtcccagtttggttgggattccaagttaaggccggtttcaacctgaacttgaattacggcccccttggaaccaaggctttgtccaggagccaaccg

SEQ ID NO: 1884 - DNA, 250 bp, Homo sapiens
ggagtagattgctgcctctagcagagactgaactggggaatttgaacattcctttacattgttggagaaatgaagccaaagttattcagatggttttcccaggctaaaggaaagtcacctgcaagagatccgcacttatctgagcagctgacaaggtggggtctcccttaccacagagaagagccactctctcgcgctctgggtgaccacctctgctctgggctcttaaaggttccacattgctgaggcc

SEQ ID NO: 1885 - DNA, 170 bp, Homo sapiens
ccttggctccctgctgccctcaggataaagtctggaccctcagcatggcttgtgagactcatggtgtccttgtccctgctcacctctctgggctyatcacttgccttcttgcattctggtgccagcctctgtatccagagatgcagttgctcttcattgccactctgatt

SEQ ID NO: 1886 - DNA, 115 bp, Homo sapiens
agaagcaacaatttcatttatacacttacatgctattttttaaagcacttttccctccaatcttcatttgtattataaataaatatgtatgttcacaaccctcttaaaaaaaaaa

SEQ ID NO: 1887 - DNA, 140 bp, Homo sapiens
ctagtcttgaagtccctcatttaaacagaggtcaagcaataggcgcctgcagtgtcaagcctgaaaccaagcaattaccgtcatgtttcagccaagcccagagccctaggattacaaccacctatggccggaacctccta

SEQ ID NO: 1888 - DNA, 125 bp, Homo sapiens
cgtgataggacactgaagacatccgattcttacacacatttatagtgacactacagttttatatttacaattaggctctgtatccttaagggctctatgctttaccagtaattcacaggggattt

SEQ ID NO: 1889 - DNA, 482 bp, Homo sapiens
cgtgaattaggcaccactgaaagcacatcccgaatttctttaacaacaacattttatagtgaacactacaagtttttatatttaaaaattaagactctgtatccttaaggtgctctatgctttaccagtaattcacagggtatttcaaatggtagaatcattttagcttctgtgcttcctttttctaaataatgcaacttgtaagagttgacattgtaataagctttataatagtatatatatatattttttttaaatcacattaattttaccaagtgaaaccaagccatactgtttttgagccaattaagaaaattgccatttttaaagtgtagcatttcagggtaaagacccatgaaatggcttgatgtattctagactactgaaagaaaaccacttcaaagattttgttgaaagttttagtgttgtctgaaatgcaagagggaaggtgattggtagtgagttaaaaaaaaaaaaaaaaa

SEQ ID NO: 1890 - DNA, 170 bp, Homo sapiens
cggcacgaggtcagccaaagaaacatttcactgttggtgaaccaataccataagcactgttattatctaagcacttttatcaagatatatacattttgtacaagctctcaattttgttcaattattatcaaaattttaaaaaacaagtttggattttgtattgggataga

SEQ ID NO: 1891 - DNA, 281 bp, Homo sapiens
agttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatccaccgccctacgacaagaaaaagcggatggtggttcctcctgccctcaaggtcgtscgtcttaagcctacaagaaagtttgcctatctggggcgcctgctcacgaggt

SEQ ID NO: 1892 - DNA, 124 bp, Homo sapiens
cgagtccagagacagtgccccagtggagtggagcccaagctgtcagtcgagagtaacgttgagttagagttggtacaacgtgtagttacagtatccgtgttgatgtccgtcgtccgtccagcgt

SEQ ID NO: 1893 - DNA, 619 bp, Homo sapiens
cgatccagagacaatggccccgatgggatggagcccgaaggcgtcatcgagagtaactggaatgagattgttgacagctttgatgacatgaacctctcggagtcccttctccgtggcatctacgcgtatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggacagatctatgacatattccaaaagctcacagcacacccaggtagttttgctgtcagcca

SEQ ID NO: 1894 - DNA, 109 bp, Homo sapiens
tgggtgtttccaagcattcatcatgtgcaatgccatccattcgccagacggtatttcaagtcatgcacaaagctcattccatgtcatcatattgttagcgagctgccag

SEQ ID NO: 1895 - DNA, 609 bp, Homo sapiens
tggggatgtgtatgcccaggcccttccttccttggtggcaatggagcctagccattagggccagcgggagtctgtgacccaggtactggcacccaaagtgactttgccctgcttcctgccatcttgttaaagaaaaggtagccaggattccctaggaaataagctgtggagaaaccactcagcaactgcagacaggggtctgtggccagttcagggtctgagggccagtgaaggtgggtgcaggcaggctgaaaggacaccagcacagccctcggggtgggggcttgtcactggtgtctggtctccctgcttttcccatgtggcctgggctccatgatacgttctccaggcctgggcctggaaaacaggtctttcctgttctctgggacctgctagaaagcttcagtcagtttggtccctgggagagaaaacgctcttcccatgacggctctgtggaggccaggaatggggtagtgggttgactgggagtactccttcctgccgccctggtcaagggactagtgtgagtcggagtgcatttttggaatggggcaagggtgtttttcatgaccatttatttgagtggtttgattggtatgcatacccctt

SEQ ID NO: 1896 - DNA, 201 bp, Homo sapiens
ctcgccatttcggcagggtaatccccagccaacaacgtccctggacactgccctgcccttggggctggcctgcctagtatcatagactaggtctgggtgggggttggcacgtttgtgagctcacatcttcctaactacctgtctttgtctgcttatcaaattcagacagcttcagacacaggaggaggggagggcaggggg

SEQ ID NO: 1897 - DNA, 212 bp, Homo sapiens
cggcacgagcaaaaacggaagggtggcgagaagaaaaagggccgttctgccatcaacgaagggttaacccgagaatacaccatcaacattcacaagcgcatccatggagtgggcttcaagaagcatgcacctcgggcactcacagagattcggaaatttaccatgatggacgatgggaactccagatgtacgcattgacaccaggctcaaca

SEQ ID NO: 1898 - DNA, 255 bp, Homo sapiens
ctcgtccattttcggccacgggccttaacaggtcaaaatagcagatcttcgtgaaaaccctttaccggcaagaccatcacccttgaggtggagcccagtgacaccatccgaaaatgtgaaggccaggatccaggataagggaggcattcccccgaccagcagaggctcatctttgcaggcaagcagctggaagatggccgtactctttctgactacaacatccagaaggagtcgaccctccacctggtcctccgt

SEQ ID NO: 1899 - DNA, 310 bp, Homo sapiens
cggcgtcttggcgattcggcccgacgagctccgctttcgctacagcatggtggcctactggagacaggctggactcagctacatccgatactcccagatctgtgcaaaagcagtaagagatgcactgaggacagaattcaaagcaaatgctgagaagacttctggcagcaacgtaaaaattgtgaaagtaaagaaggaataatctaccctgactaaagcttgaaatgctacatttccaaggtgaagatgttttgggcacatgttatggcagattgaaaaggatctcattccatgggaaaaaaaaaatcct

SEQ ID NO: 1900 - DNA, 260 bp, Homo sapiens
ccagtatagcctatataatatccatttcccattctctggctaactccatctcactcttggaggtaatgctatttcataccaacatgaaaggtgaggattaagggagatagatatagacatacaataaaatctcctggtaacaatgtccttcaacccacttaaaataacataattagaggagtgactaatattgcactgctgaaataggctgtgaaaaaaaattgaatataatagacataatgggtgaaagaggcccactt

SEQ ID NO: 1901 - DNA, 220 bp, Homo sapiens
cggctgctgttggttgggggccgtcccgctcctaaggcaggaagatggtggccgcaaagaggacgaaaaagtcgctggagtcgatcaactctaggctccaactcgttatgaaaggtgggaggtacgtcctggggtacaagcagactctaggatgatcagcacaggtcaaagcgaaattggtcattctggctaacactgcccacctttggggagatttgaa

SEQ ID NO: 1902 - DNA, 255 bp, Homo sapiens
ccctgaggtgcctctctgctcctgtcttttgtttggatgccggcgctgctgcctgtaggctcccgcctttttgttgctaccccgagtcttgctgaccatggcctctggaagccctccgaccagcccttcgccggcctcggattccggctctggctacgtctcgggctcggtctctgcagcctttggttacttgccccaacgagaggtcgccaaggagatcgccaggccagttgttgcagagcgctagcagcctgc

SEQ ID NO: 1903 - DNA, 195 bp, Homo sapiens
ccttcattaggggtaaaggttttacttttcacttatcttgttttttatgggaagattcagaattttgagtttagggggaaatatgacagataagagcaggaactcccatatggggcttacgtttaaagatacatggtatgaatttttttaaaggacatacattatattgtactactgagggctaaatacactgtt

SEQ ID NO: 1904 - DNA, 245 bp, Homo sapiens
tgagctttcctgtctttccttttttctgagagattcaaagcctccacgactctgtttcccccgtcccttctgaatttaatttgcactaagtcatttgcactggttggagttgtggagacggccttgagtctcggtgcgagtgtgcgtgagtgtgagccacctcggcaagtgcctccgcagggcccggccgccctccatctggccgggtgactggcgccggctgtgtcccaggccttaccctgcct

SEQ ID NO: 1905 - DNA, 110 bp, Homo sapiens
ttaagtaactgtattgaacttttacgtatactttcggaacacgcatgaacggcagtttcgaataccagaaacatctacttcggtagcttcgtgccattatccagtcgatc

SEQ ID NO: 1906 - DNA, 205 bp, Homo sapiens
tgaagatcacctcagccagttctcagacacttaggggacatgttctctgcaggaccactctgagggactcttctgcatattgctgacctgagaggatggcctaagagctgacttgggcaatcctcccaacaggaaggggagaaattgcctccactgagggaacaggtcaatgaaggtggagataatctgcaaggggcgcgagacc

SEQ ID NO: 1907 - DNA, 174 bp, Homo sapiens
cctcgacatcttatgtagatgatccacaacttcaaaatttagtctgggcctagtgcagtggctcacacctataatcccaacactttgggaggccaggagttttgagaccagcctgggaacatctgcctctacaaaaaaatacaaaaattagctgggcatagtggtgcatgccts

SEQ ID NO: 1908 - DNA, 135 bp, Homo sapiens
tgtggcctctccaagcgtcctgcacgtgtccgccgtagctttaccattttagtgagggaagccagccctggggtgggagggggtgtgtctgggtgtgcctattgagagcgtgtaatggcgtttgggagctcgtgt

SEQ ID NO: 1909 - DNA, 264 bp, Homo sapiens
gttcggacatttttcatgacatcaagaaatttaagctaacaaacatatctgtataaacattacttaatatacaatattatcttagtatctgtgttttctggaacaacaacttcctgtggaatgccaaatataatgtgaaataccaaatataaagcattgcgtctttacatacttcagcctttaccacatacaaacaattcttatttttacacagagtcctttctgagaaattttacttcacaccaaacttagagtcctcagtag

SEQ ID NO: 1910 - DNA, 138 bp, Homo sapiens
cggcacgagcacaacagtaacagaactttgcaattttctggggttttgtttttttaccctttttcccccctttttttttaaatggagtgtgctggatgtctctataattttattcagatgactgcagaacctggaaaa

SEQ ID NO: 1911 - DNA, 296 bp, Homo sapiens
gcggcgcgaagggagcctctgggtgaggaccaacttgggctccgcgctgctgctgctgaccatggccttggccggaggttcggggacgcttcggctgaagcatttgactcggtctttggtgatacggcgtcttgccacccggcctgtcaattgactacccttgcacacctacctaaggagagggttgtacgcatgtcagagaggttgcaggctgttttcaatttgtcagtttttggatgagggaattgacttaaatcggactaaattggaatgtgatcttcatgtccagagcattt

SEQ ID NO: 1912 - DNA, 237 bp, Homo sapiens
atttaatatttagtgcaaattttatgataagggaataggggagatattggaggtaaagtagaaattaattaatttaccatgttactaatacatcttgttggttttgaagtaagcattttacctgtaatcattgaccttctacaaatgtttcaaggggaaatagctaaagactgtcaggttcactgatactaaaaacatatatcaagaattttaatggcagtccgatgggtcctaagc

SEQ ID NO: 1913 - DNA, 670 bp, Homo sapiens
atttaatatttagtgcaaattttatgataagggaataggggagatattggaagtaaagtagaaattaattaatttaccatgttactaatacatcttgttggttttgaagtaagcattttacctgtaatcattgaccttctacaaatgtttcaagggaaaatagctaaagactgtgaggttcactgatactaaaaacatatatcaagaattttaatggcagtcctgatggtgcctaagcacaccattacatcataggtcctgtgatccaatactgattttaggaaatatggtcatagcataactttcatatcaactgaaaagaatagaaacaatatgagagaaggggagttaaaagacccagaacacaaagtccaagagctgggatgaagatagcaataaaaatacgggaatatatatatatatataatatatgtattttatatatatataaaaatgtatgtattatatatatattttatatatataaaatatatgtattatatatatattttatatatataaatatatgtatatatatatatgtattttatatatgtattttatatatataaaatatatgttgtatatatgtattatatatatataaaatatatgtatatatgtacatatggtatttttatatatatatgccaagtggttaaaataattt

SEQ ID NO: 1914 - DNA, 279 bp, Homo sapiens
caagaagcagaagcccggaaattaagaagaagattctggcttagagacgcaagccgctcaacatcgatcaccttggtgaagacaaactgagggacaaggccaaggagctcttggagaccctccaccacctggagattgacaagttcgagtttggggagaagctgaaacgccagaaatatgacatcaccacgctcaggagccgcattgaccaggcccagaaggacaaccaggagggttgggaccccgccaagggcaaattcggcgggccttggagtagaa

SEQ ID NO: 1915 - DNA, 238 bp, Homo sapiens
accacatggagaggcctgagtcaacatggagaggagaaggacttgacttaattcagccttccagctgttccctaccaagggtgccaaggcattagaattaagctgtctttgaacctttgaagggccagcttagccaccagatgccaaacactgagcaggctttgtttctccacccacaaaccaagaggcgtgtcttaaccggggggggttgggagtgggagaaaagggagaattaaga

SEQ ID NO: 1916 - DNA, 297 bp, Homo sapiens
accacatggagaggccctgagtcaacatggagaggaagaaggacttgactgaatccagccttccagctgtccctaccaaggtgccaggcatgagaatgaagctgtcttgaactctgaagaccagcttagccaccagatgccaaacactgagcaggctttgttctccacccacaaaccagaggctgtctcagcaggaaggagttggagttggagaaaaaggagaattaagaatctatctggcgatgtggattaaataaacaacaaattggcaaaaaaaaaaaaaaaaaaaaaaacccc

SEQ ID NO: 1917 - DNA, 127 bp, Homo sapiens
tgaactgacttagataagaaagtggcaactatctaacttagacattggcagaattgccttttttttgagaattggcttaggcaaggaactattctattttaacacactaaaatttcgagcgcacact

SEQ ID NO: 1918 - DNA, 680 bp, Homo sapiens
gtgaaactgacttaagaataaaagaaaaagtgggcaaaactaatgctaaacttgagaccattgggcagaaatttgcctgtgtgtgtagagtaattggtcttgagtcaaagtaactatgcttatttttaacatcactgaatattttctagcgttacactctatataggcttgtagaaataaacccaggggtaagcccagaaattgaatatcagtcctaaagaaagcctatcaagagcatcctattctctttaagagctgctattcgaatttaggactgggctggtttgctgctcattctctcgaggcataggcagccacacttgaattttgccaagtatgcagataattccaacttgtagtcaggatcatcaggtaatagcattataaggggagctgtacagactgtatactttctacagtttgttgaaatagaaacatttatatggatacatacatctgcaaaggttagggagaaaacggtagccctggcagagaagagctagttagtgtattcagggatagggcaagggaagctgtcatttctctactaagtctcaattggtggaaaagccacaaatgtccctagtacagtataagggaaaaaagggctgaaccgtggtgggctcacaacctgtagtccccagggactttttcggaagggattgctttgagccccaagg

SEQ ID NO: 1919 - DNA, 331 bp, Homo sapiens
ggaaaccagctatatgtctttgggggcggagagagaggtgcccagcccgtgcaggacacgaagctgcatgtgtttgacgcaaacactctgacctggtcacagccagagacacttggagatcctccatctccccggcatggtcatgtgatggtggcagcagggacaaagctcttcatccacggaggcttggcgggggacagattctatgatgacctccactgcattgatatagtgacatgaaatggcagagctaaatcccactggggctgctccagcaggctgtgctgccactcagctgtggccatgggaaacatgtgtacatctttggtgg

SEQ ID NO: 1920 - DNA, 312 bp, Homo sapiens
cgccttttcagtggttcttgggatgctccgcagccaattaagccgactgagttcctttcctcatggggacccagtgtgcgatggctgcacacagcagctttccttggtagtgtacgcagcctgttggttgtattggttgctctaagggaccttggagacaggcctttcaggtggatgttcatgtttctgaccttgcactaccccaatgtaggctccaaacaggcatgcgaggtgcctttggaaagccccaggcactgtggccagggttcacattggccaagttatcatgtccatccgcaccagctgcagaca

SEQ ID NO: 1921 - DNA, 301 bp, Homo sapiens
aacgaagactgttatactacttccttcctaatcagtagtatacttctatgtctttttcttctcttattgccctatctagaacttccagtataaaattgaaaaagagtggtgaggggaaatatcttgctttgttcctgaccttagagggatgctttcctcaaagtttcttagaattaagggtaatgggaattgtggttccttgtagaggtctttaccaaattgaggctattccctctattccctcgtctattgagttttgttttgtttttttggatgaatcagtgtggattttgaaaaatgt

SEQ ID NO: 1922 - DNA, 311 bp, Homo sapiens
cctcactgtccccatgtcccacccacgtcctacggcactcaggaagcacttggtgaggacgagccctcacccttcttgtcttccttcccagcagcgcccgcagcggccattttacacgtcgaggctggcacctggcgcgctcgggggccactgtagcgtctgcctgctccctggactcgcaggcctcgcctgtggcccctttcccagggccagcctgggtcacgagatgctgtcactcagccagatcagtattgacccaccaggggaggtggggtttggtgagagacgccagcctcagactttttcccact

SEQ ID NO: 1923 - DNA, 340 bp, Homo sapiens
gcgaggacgtggtgggtcctctggtgcgaaattccggatttccttgggtcttccggtaggggctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgagatattgcaggagtcatagtgacataaaggcgagatgaaaggttctgccatt

SEQ ID NO: 1924 - DNA, 308 bp, Homo sapiens
gttgagttcgggtcgagctgtgcgcccttttttcctctcgctctctcggttatcataaccttgtattccctctggaaggaaatggaaattcctttggatcatcttctaggtaaacagtttaattagctgcgtgaggtgacaaacttgctcggatgaagtcatgggagctgaccgaattggcctgaatccaagaggggagtgttcagggcgcgcgtgtcctcggaggcctgaggtaacgctggctccttcccgggagtcctaacgccggctttggatctcagacagctctctagcaggcgttggcacct

SEQ ID NO: 1925 - DNA, 376 bp, Homo sapiens
cggcacgagcggcacgagctcgccaaaattttcggcaggaggcccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagatctagctgccttcacaaagacccagaaggaccctggtgtcttgaccgcatgatgaagaactggacaccacagtgatggtcagctagatttctcagatttcttaatctgattggtggcctagctatggcttgcatgactcttcctcaggctgtccttccagagcg

SEQ ID NO: 1926 - DNA, 377 bp, Homo sapiens
cagaagcagtgtgatcagtttgtggcagagtacgagcccgtgctgatcgagatcctggtggaggtgatggatccttccttcgtgtgcttgaaaattggagcctgcccctcggcccataagcccttgttgggaactgagaagtgtatatggggcccaagctactggtgccagaacacagagacagcagcccagtgcaatgctgtcgagcattgcaaacgccatgtgtggactaggaggaggaatattccatcttggcagaaccacagcattggtttttttctacttgtgtgtctgggggaatgacgacagatctgtttgactttgttataaaatagggctccccacctccccatttctgtgtctttattgtagattct

SEQ ID NO: 1927 - DNA, 336 bp, Homo sapiens
ggaattttttcttgtgtgttatatttttaaaaacctcaaaccagagcatactgataaatccaagttgttatacatagattatttttactaaagaggattaatctttcgtaattattgaagatcattgttttagactgggttatgtaatatgactcccaacacacattttcaaagctgatactctagttgctattatctcttggaacaaataagaagtaaaaggtaggagtaaaattccttttatttcaatgtttaatgtagcatggctgataatatggcaaccacatttctgtggaatgtgctactctctgggggaggctaatggtccatctgatc

SEQ ID NO: 1928 - DNA, 684 bp, Homo sapiens
gaattttttcttgtgtgttatatttttaaaaacctcaaaccagagcatactgataaatccaagttgttatacatagattatttttactaaagaagattaatctttcgtaattattgaagatcattgttttagactgggttatgtaatatgactcccaacacacattttcaaagctgatactctagttgctattatctcttggaacaaataagaagtaaaaagtaggagtaaaattccttttatttcaatgtttaatgtagcatggctgataatatggcaaacacatttctgtagaaatgtgctactctcttggggtaggctaatggtgcatctgatctgataaagtagaaagatagcctcttgcactttgacctgtagattctggctgcatagagcctggatgtcatattgttgcacacacatgtgctctcacctactcaccagattaatagtgaacatcagtgaaatttttggcagaattcagagagttatgagtttgaataacaattttccaatcaaatatgaggttatgcctatggagtttctctgaaaattgaaaatgccttttacgtttactaatgcataataattaagatggcaatttggactcagacagctgtgagtttgaatacctgtctgatgctacacattgtttccagctcagctacaatagcctccctaaag

SEQ ID NO: 1929 - DNA, 312 bp, Homo sapiens
ctcgtccttggggattaaatgcataacatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaacccaaagttatttgttttgcatggctaagccattctgttatctctgtaaatactgtgatttcttttttattttctcttgggattttgttaaagaaattctaaaatttttaaacacctgctctccacaataaatcacaaac

SEQ ID NO: 1930 - DNA, 300 bp, Homo sapiens
cgaggctgcggtgtctgctgctattctccgagcttcgcaatgccgcctaaggacgacaagaagaagaaggacgctggaaagtcggccaagaaagacaaagacccagtcaacaaatacctggggcaaggccaaaaagaaggagtggtacaaaggcaaagttcgggacaagctcaataacttagtcttgtttgacaaagctacctatgataaactctgtaaggaaggtgccaactataaacttataaccccagctgtggtctctaagaaactgagattcgaggctcctggcaggcagccttc

SEQ ID NO: 1931 - DNA, 109 bp, Homo sapiens
gttaagtcagctcgggcaggatcgctgtgtgcgcacgtctgatacgccgctgtttaaacttcgtttcctctggccccataagtgatctatgcaagtaacccacaagcat

SEQ ID NO: 1932 - DNA, 616 bp, Homo sapiens
gttcagtgaggtcgggcaggttcgctgtggctggcgcctgggccgccggctgtttaacttcgcttccgctggcccatagtgatctttgcagtgacccagcagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggctcccctcagggtgccatgactcccggaatccctatctttagtccaatgatgccttatggcactggactgacccacagcctattcagaacaccaatagtctgtctattttggaagagcaacaaaggcagcagcagcaacaacaacagcagcagcagcagcagcagcagcagcaacagcaacagcagcagcagcagcagcagcagcagcagcagcagcagcagcagcagcaacaggcagttggcagctgcagccgttcagcagtcaacgttccagcaggcaacacagggaacctcaggcaggcacacagtcttccaatcacaga

SEQ ID NO: 1933 - DNA, 113 bp, Homo sapiens
gttttttttttttttttttaaaattaacttttttataagatttttacaagacacccatttttaacacatacagaattggtttcaaaggtttttgttttacaccacagccacca

SEQ ID NO: 1934 - DNA, 105 bp, Homo sapiens
gcagctctccagcgcagccatgttcagttcgcagccccaagatcgttaagcccaatgcgagaagcgcacgcgcttcgcactccgccatctcccagcctcttctgg

SEQ ID NO: 1935 - DNA, 256 bp, Homo sapiens
ttggaattgaagtctggcttaaatcttcagaaagttatatatctattttattttattttttttgagacagagtctcgctgtgtcacccaggctggagtacagtgccacaatcttggctcactgcaacctctgagtccaggttcaggcgatactcatgcctcagcctcctgagtagctgggactacaggcgtgcaccaccacacctcgctaattttttgtatttttagtagagacggggtttcgccattgttgccca

SEQ ID NO: 1936 - DNA, 108 bp, Homo sapiens
cctcccgcaataaagcctgccgtccaagattaaaaacaactcgaacctcgacaattaaccagccccattaatcctaccaatcaaccccaccaggcaataattacccct

SEQ ID NO: 1937 - DNA, 145 bp, Homo sapiens
cctccgcataagcctgcgtcagattaaaacactgaactgacaattaacagcccaatatctacaatcaaccaacaagtcattattaccctcactgtcaacccaacacaggcatgctcataaggaaaggttaaaaaaaaaaaaaaaa

SEQ ID NO: 1938 - DNA, 206 bp, Homo sapiens
caaggaagggaggggcaaacgatgctgggccttctaaattatattaccgagtttatccttcattttaagagcaatgggtaactattgtgtggttttaaacagagcaacaacataatcagacctgttctttagagagatcacgctgggatgctatttagaagttggggaggggtgagactggatttagaaagacccctcacagaaat

SEQ ID NO: 1939 - DNA, 207 bp, Homo sapiens
gggctaatgcctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaaaaaaaaaaaaaaaaaactcgggggtcttttggggcggccggg

SEQ ID NO: 1940 - DNA, 300 bp, Homo sapiens
attacattcatcttctcatttaatcctcacaacaatctgaagaaggtaggtattacaattcccacttcatagaaacagaaactgaggttcagagaggttaagtcatttgcccaaatggctgagcaaagcctaccatgtacctaacctttattttctttcccgaacataccaggctgtctcctcataacttccagcatgcacttaaaactccacatgaatacaaggttcatgggacttggtattcatagaaagggaggcagaaagctggtcttttcctgataggcttgtaatttaatatca

SEQ ID NO: 1941 - DNA, 362 bp, Homo sapiens
tcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttcccccaacccggaaacagacaagcaacccaaactgaccccctcaaaagccaaaaaatgggagacaatttcacatggactttggaaatatttttttcctttgcattcatctctcaaacttagtttttatctttgaccaccgacatgaccaaaaccaaagtgcattcaccttcca

SEQ ID NO: 1942 - DNA, 296 bp, Homo sapiens
ccaccgtagataagtggaggacttcatcaacaacattaacagtgtcttggagtcctcgtatattgagataaagagaggagtcacggaagatgatgggagacccatttatgcgttggtgaatcttgctacaacttcaatttccaaaatggctacggattttgcagagattgacctggatttgtttagaaaggctctggacctgattattgactcagaaaccggctttgcgtcttccacaaaccatattgaaccctggttgatcaacctaaagggcagaggatgaggagaggaggcgc

SEQ ID NO: 1943 - DNA, 280 bp, Homo sapiens
taaacacatccgctattactcgcatcaggagtatcaatcacctgagctcaccatagtctaatagaaaacacccgaatccaaataattcaagcactgcttattacaattttactgggcctctattttaccctcctccaagcctcagagtacttcgagtctccttcaaccttttccgacggcatctacggctcaacattttttgtagccacaggcttccacggacttcacgcattattggctcaccttcctaactatctggtccatccgccacctaatattt

SEQ ID NO: 1944 - DNA, 114 bp, Homo sapiens
agacacagttgtctaaggctgcctgtcaccactgtggcctctccaagcgtcctgaacgtgtccgccgtagctttaccatttaagtgagggaagccagccagggggtgggaaggg

SEQ ID NO: 1945 - DNA, 234 bp, Homo sapiens
ggagaaaactgcatcataactttacagaattgaatctagagtcttcccgaaaagcccagaaacttctcttcaagtatctggcttgtccaatctggtctaaggtggcttcttcttccccagccatgagtcagtttgtgcccatgaataatccacgccctgttatttccatgcctgctttactgtattttaagggcattatactgtacatttgataataaaataatattctccaaa

SEQ ID NO: 1946 - DNA, 186 bp, Homo sapiens
ctggccaacttttccctggaaagagccatattcatgaggctagtccacgcactgggagccggattgctgccaattctctttcctgcttcccacttctatgacctcggcttggttatttccatttcctggcttggttatttggactcatagcttcctttaagagtagttaccacacataaaggttta

SEQ ID NO: 1947 - DNA, 319 bp, Homo sapiens
ctcgtgccgcacttttgccctgggaaaagagccatattccatggaggctaagaccacgcactggggagccggaatggctgcaattctgctctccttgcttcccagctctatgaccttgggctggttatttcccatttcctcgcctagttatgtggactgataggctccctataaagagtagttaacacacataaaaggattagaaaaaagcctcggacagcatagtgtctaatacatgttgactattcattaagttaactatgtgcatgaagccattctcccaggaacttaagctttaaaaaaaaaaaaaaaaaaaaaa

SEQ ID NO: 1948 - DNA, 166 bp, Homo sapiens
caacggtgtgttcaccccgacttccaggagtttgtcaataaatgcctcatcaagacccagcggcgggccgggacctgaaagatgctcacaaacccacacctccatcaagcggcccgaggtggaagaagtggatttcccgcctggttgtgtaaacccatcggctgcc

SEQ ID NO: 1949 - DNA, 340 bp, Homo sapiens
cttgtccaaacctgagtgacagcattaagcagaccagtattttcaagattctaagctgtagcaagtcccacttcttcaaaaggttagacaaggcattctcacttagaaaggaggatccccagggcccaaggcacacacactgcctttatccaccacgaagcttacaagcccacagaattaaacccctatgttggacgttgctcattgttgcaaatttgatttttggaagaattttcccacgccaatcttcattaggtgtttcaccacttttttacaaggtttttgtagtccctagttttaggtaggatgtttatactcactggtggtcggatgaggagct

SEQ ID NO: 1950 - DNA, 653 bp, Homo sapiens
cttgtccaaaaactgagtgacagcattaagcagaacagtattttcaagattctaagctgtagcaagtccactgcttcaaaaggtagacaaggcattcttactcagaaaggaggatacccaggggccaaggaacacaaactgcctttatcaccacgaagctgacaagaccacagaattcaaaccctgatgtgggacgttgttcattgttgtcaaatatggaatgttggaaagaaatgtttccaggccatatctccatgtagtgtgtgacaccatctgtttaaacaagttttttcgttaggtgacctagtgttttaggttagggatgtgttatgatctcaactggctggcttgggcatgaagcaagtctcctgagccagagatctgtgctttccttgggcactttatacccaagatattctgccctttgtccctccctgaaatctccataactcccttctcttcctgagccagacgaggggcccttccattgggaagctctctcaatctggactgttccaagagtatgccaatagatggcccactttcaaagcataaactaggtacttaaacagtatgatcaattaaattactaactcatatgaaaggtcacacatgtagcctcaaaactaaaagacttgaaaaaaaaaaaaaac

SEQ ID NO: 1951 - DNA, 360 bp, Homo sapiens
gccacccggaagccgcggttcctaccaaccgttcttattgctggcggcctgaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatattcaggtggatttggctgtaacttcttcgttgacaaaatggtccagatacttcacgcatctatgtggccctggatatggtttttcctggagtt

SEQ ID NO: 1952 - DNA, 102 bp, Homo sapiens
ggctctagggacttgcaggctgtttcagccaggaaggccaaatcaagagtgagatgtaggaagtcgtaaattagaaaaagtggagttgtgaatcggttgttc

SEQ ID NO: 1953 - DNA, 160 bp, Homo sapiens
gccaggtgtcttcatggggcttcagaccactcccaccttctcccttcctttgccggggacgccgaactctctcaatggtatcaacaaggctcctgtggccctctggctcctggtcaagttccagtattggggagccccaccagaagaatggagaggagga

SEQ ID NO: 1954 - DNA, 130 bp, Homo sapiens
gtggccacaaggcattcgtggcgataagggagagcccgtgaaaaggggcccagaggtcttcctggcttaaagggacacaatggattcaaggtctgcctcgtatcgctggtcaccatggtgatcaagctcg

SEQ ID NO: 1955 - DNA, 108 bp, Homo sapiens
ttcggcagtccagatcaaaaattgcggtagttggtgtgtcctcggtttctcggctgctgggtcggtcccgcccacagcttgggcggcctatgtcgagttgcgcccatg

SEQ ID NO: 1956 - DNA, 126 bp, Homo sapiens
ggcttactttcccatcaacgttgttatccaggagaatggctctcttgttgaaatccgtaaatttcttggcgtgaaaaaattacactctccagctcttccgccagtgagcaccacggctcttgcgct

SEQ ID NO: 1957 - DNA, 104 bp, Homo sapiens
cggcacgaggcctatcaagctctggttattctttctgccacacacatgccctgactaactatgctgtgccactgtcgccacccctgtacattgccttgtgacgt

SEQ ID NO: 1958 - DNA, 103 bp, Homo sapiens
ggatttttgggtaccgcacgctactgctactgactcaccgctgttcagttcatagcagacgaacaaacgtaggtcaacgaacgcaacacacgaaacaacaaat

SEQ ID NO: 1959 - DNA, 505 bp, Homo sapiens
ggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcacaattgcagatgcttaagtcaactatttaataaattgatgaccaagttgttaaaaaaaaaaaaaaaaaaac

SEQ ID NO: 1960 - DNA, 108 bp, Homo sapiens
gctggggctgccacctcgctattcccgcataagcatctgcccccaacccctttgaccttcatctgatggacatttttatacagaaacacattaaagatttccctctca

SEQ ID NO: 1961 - DNA, 240 bp, Homo sapiens
caaacttttacccttaaaatctctgactctggaaaaactagagaaaatgcatcaagcagcacagaatacaattcgccaacaagaaatggcagaaaaggatcaacggcaaataacccactgaatgataactgagcactttagggacaacctgccttatctactatttacaataactagaaaatatgcttctgtgtctgaaagtagtatgtgttatcaataaaattgatagtattcatagga

SEQ ID NO: 1962 - DNA, 251 bp, Homo sapiens
taccacatttgcaaaatgaaatataaaaatcatatgagcatctcaacagaggcagaaaaagcatttaacaaaattcaacattttttcataataaaagctgtcaacaagttgggtatagatgtatacctcaacataataaaggtcatatataacaagcccacctctaacatttactcaatagtggggagctgaattctttttctctaagatcaggaacaacacaagggtgccccctctcaccccttcttttc

SEQ ID NO: 1963 - DNA, 266 bp, Homo sapiens
ctcagtcctagctctggcttgagctatcccattctctgagttttggctcatttttaggactcagctggaaggtcattaacttttgcttcttcaccttgatagattaactttgtgattaatttggcttatgatagtgtttcctgtggttccatcagggctttctggcaggcaaacatggatgagcagaccaaggactttgttttaattccgtttagcccgacttttattgattccccacaaacaaccaccttcccacttcttaaagk

SEQ ID NO: 1964 - DNA, 576 bp, Homo sapiens
ctcagtcctagctctggcttgagctatcccattctctgagttttggctcatttttagaactcagctggaaggtcattaacttttgcttcttcaccttgatagattaactttgtgattaatttggcttatgatagtgtttcctgtggttcccatcagggactttctggcaggcaaacatggatgagcagaccaaggactttgttttaattccgtttagcccgacttttattgattccccacaaacaccaccttcccacttcttaaagtctgctacagattccattatgcagaacctgctgtccctggccactgcaggtgtgttgctgcctgatcctccccctctccactggaaccttcctgtcctggtgctcaccccttcagggtcacatccttcctgcctttcaaggtgaaaactatattaaagcagtagccagaggcaatctccagggtcttctctcccactccagggttacagcatcttaacactgacttcctgaagtctctttcccttttttatgaaaaccagaagaatgattttcataaaatcagagggataaataagacaaacaacaacaa

SEQ ID NO: 1965 - DNA, 303 bp, Homo sapiens
ttcctgtgcagtagctcccgttgcggcggcacccgtggcagccctggcggacgaggagcaatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgggggggggccagccacccacacacagcggggtgttcccgat

SEQ ID NO: 1966 - DNA, 302 bp, Homo sapiens
attaaccaaccttgtttaatagatttgggtcatttagaagcctgacaactcattttcatattgtaatctatgtttataatactactactgttatcagtaatgctaaatgtgtaataatgtaacatgatttccctccagagaaagcacaatttaaaacaatccttactaagtaggtgatgagtttgacagtttttgacatttatattaaataacatgtttctctataaagtatgggaatagctttagtgaattaaatttagtcgagcatagaggacaaagtaaaagtagtgttttcccggaag

SEQ ID NO: 1967 - DNA, 108 bp, Homo sapiens
caccgacgcatacacctagcaacatgccatgagagagctagtataggaacggtcgtagatagatagaccaggtaatgtaaagagaccacagagagcaggcgacccgag

SEQ ID NO: 1968 - DNA, 728 bp, Homo sapiens
actccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattagaaagcgttcaagctcaacaaccactacctaaaaaatcccaaacatataactggaactcctcaacacccaatttgggccaatctatcaaccctatagaaggaactaaatgttaggtataagttaccatggaaaaacaatttctcctccgcaataaagcctggcgtcagatttaaaacactggaactggacaatttaacaagcccaattatctacaatcaaacca

SEQ ID NO: 1969 - DNA, 114 bp, Homo sapiens
ctcaacttcttctgaaacaaggcccttcacacatttcatgggtgagattgagcagaacagggcttcccaagttgccagaaagattcttggtagaagcattgcagagcttttcca

SEQ ID NO: 1970 - DNA, 156 bp, Homo sapiens
ctcgtgcaattcggcagttgggaccactttggttagcttttttgcgtgtggcagtttcaagttattagtttttaaagttcagtactttataatggaacaacttgaccaaaaatttgtcacagaattttgagacccattaaaaaggttaaatgagga

SEQ ID NO: 1971 - DNA, 206 bp, Homo sapiens
acggcatcctgtgctgtgggggctacgaggaaagatctaattatcatggacctgcgacagtttcttatgtgcctgtccctgtgcacagcctttggcttgaggaaacccacagaaaagagggacgtgtacatcatgaggcctcagctcagtgacaaggttcacaatgatgctcagaggttggattatgaccatgatgccttcttcgg

SEQ ID NO: 1972 - DNA, 245 bp, Homo sapiens
ctcgatttcttcttggtgagtccatgggaacagccccactgcaaacaacccattcctgctctcctcttttcctctaaacctcaacctcctcctacctggcagtccacaggcctacagcttctcctcagttggaaagacatcagcttggaaaaccacttggaaagccaacgttatcctagaaaagctttttaaatgacccagcaggacaagtctccggatggccttgcaacccggtgcttccctct

SEQ ID NO: 1973 - DNA, 185 bp, Homo sapiens
tcggccacctaaacatccagccagactgttggactcaggcagaacacgttgctggagaacttcaatgctgcagccagtttaatatatgtagaggggtgacttccaggaatggctacccacttgccttcatgcgcctgctggccaactatgcctctcagaacatcacctaccactgcaaggacagc

SEQ ID NO: 1974 - DNA, 353 bp, Homo sapiens
cggcacatcaggtagccagatggtgcatacagtacatccagggctgtggagaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatatagggttcgtgttcgccgtggtggccgaaaacgcccagttcctaagggtgcaacttacggcaaggcctgtccataatggtgttaaccagcctaaaggtttgctcgaggccttcagtcccttccaggggagcgcgctggacgccactttggggt

SEQ ID NO: 1975 - DNA, 239 bp, Homo sapiens
tctgtaagatggatggccagtgcaagcgtgacttgaagtgttgcatgggcatgtgtgggaaatcctgcgtttcccctgtgaaagcttgattcctgccatatggaggaggctctggagtcctcctctgtgtggtccaggtcctttccaccctagagacttggctccaccactcatatcctcctttggggaaaggcttggcacacagcagggttttcaaggggttccaccttgatcaatga

SEQ ID NO: 1976 - DNA, 129 bp, Homo sapiens
tatttacttagagagagctcgagccagaacagaggtagattttgcacagaaagagaatttggttcgggcagccaagattactagaagcttgacttcaaatttcaaaactaagcgtttcttagcctaggc

SEQ ID NO: 1977 - DNA, 282 bp, Homo sapiens
tgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaatagctgactacaaaaaaaaaaaaaaaaaaaa

SEQ ID NO: 1978 - DNA, 268 bp, Homo sapiens
cgctwgtttcakgaagaagtgaatwttstttcagatattgagcctagagctactgatgttacctgaatcaagatgttcttttcacawttttttaaagggctagtatgttccagagtrggcaagtagtcattcaagccaaatgaaagagttaactggtccttgaggagtgttagcaaaagtcaaattttgaccctggccatttgttctacagagtgattatggggttaaagaatacataatacagggtttggggttgggctcttttttt

SEQ ID NO: 1979 - DNA, 335 bp, Homo sapiens
tttggtcgatggaccttgcactcaagtgaggagacaggccatgctttcaagtgcatgcagctcactgatttcattctcaaggtttccgcacagtgcccaccagaagtatgtcccacaagcctggcagaaggcagacatcaatacaaaattggcagccacacggttgggccaagaagatttaagccagagaaaggaaagccaagatgacagattttgatcgttttaaagttatttaaggcaaagaaattgagggacagataatcaaggatgagtcagagctcaaaggcagctctctgaaagctctcccaaaaagcaccycgtctaagggactctgc

SEQ ID NO: 1980 - DNA, 111 bp, Homo sapiens
caaccaagaccagtacttccatctcagtcactctaggactctgcactgaatggctgacctgacctgatgtccattcatcccaccctctcacagttcggacttttcctcccc

SEQ ID NO: 1981 - DNA, 233 bp, Homo sapiens
taacactgaagttctagcttaagtgttgaaacttttgttggaaaaaaaatcacttttgaaactcagacttcagtgtatacccaataatttaaaattatgtgaaatgttttaaatttgtgaactcgtaattactgttttaatgattcaggttctccagagtggtaaattgtataaaattgctattgcagctttatattcaatatgatgtgccyctaaaccaaggggttttcccc

SEQ ID NO: 1982 - DNA, 118 bp, Homo sapiens
aaggcaagatccagataggaggcatcctccttatcagcagagttgatcttgctgggaaacagctggagatggacgaccctgtcttactacaacatccagatagagtcactctgcactt

SEQ ID NO: 1983 - DNA, 165 bp, Homo sapiens
atcaactggcttgataagaatcagactgctgagaaggaagaagtggaacagcaacagaaagagctggtagaaagtttgcaacctcatcatcaccaagctgtaccagagtgcaggaggcagtgtcagtgaggattgcctcggggagtttctcgtggtcgagctcct

SEQ ID NO: 1984 - DNA, 133 bp, Homo sapiens
tcttggaccatactcaacaaaggaaaacaatggtcaatagataaaacgtcctagcaaaaaaccaccctcaccagtggagtactcgtgaaacaaacgggaataccggggtaaaaacaaccaggagggcggccag

SEQ ID NO: 1985 - DNA, 500 bp, Homo sapiens
cagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacaagacacggtagaagacccgcccattttggaatgtgaccgtctgtccttcaggagaaggacaccaagggtgggggtgaaggagacactactggccccaacccctgacaggccccaaccccatggcttccatccttttgcaatcaacaacca

SEQ ID NO: 1986 - DNA, 152 bp, Homo sapiens
aggaggccaagatagcaacttccttcggtcgtcccgaatccggattcatccgacaacaagccggcctccaccatgccgccgaagttcgaccccaaccgagatcaaagtcgtataccttaggtgcaccgccaggccggtcgggtgccacttct

SEQ ID NO: 1987 - DNA, 305 bp, Homo sapiens
ttgtgggaaggagcatggggaacaaatgctaaagggtatgtgatttctttttgtggtgatgagaatgttctaaaattaggtagtggtgatggttatacaactctgtactagaaaccacggaccttatccttttaggataaattttatggcgtgggcattatatctgaataaagctgctactaaaataaaaaggaaaaatacacctaatagtagcataaattacctagttaagtcattttcagaatggagtttatgtagtaaaagtacgtcgcattctggcttctgtattggcgcatactgtagag

SEQ ID NO: 1988 - DNA, 235 bp, Homo sapiens
aaatagaagtaaaaaagaaacaactccaaaacctagaagatgcttgtgatgacatcatgcttgcagatgatgattgcttaatgataccttatcaaattggtgatgtcttcattagccattctcaagaagaaacgcaagacatgttagaagaagcaaagaaaaatttgcaagaggaaatttgacgccttagaatccagagtggattcaattcagcgagttttagcagatttcaaag

SEQ ID NO: 1989 - DNA, 235 bp, Homo sapiens
tgggtgagagaggacatccctgtcttgtgccagttttcaaagggaatgcttccagttttttgcccattcagtatgatattggctgtggggttgtcatagatacctcttattattttgagatacggcccatcaataccaaatttattgagagtttttagcatgaagcgttgttgaattttgtacaaggccttttctgcatctattgagataatcatgtggttttgtcttgggtccc

SEQ ID NO: 1990 - DNA, 300 bp, Homo sapiens
ggaaagggaccctcccatcattcatggggggctgctacctgacccttgggcctgagaaggctttgggggggtggggtttgtccacagagctgctggagcagacccaagagccagtcttgaccgggatgaggcccacagacaggttgtcatcagcttgtcccattcaggccaccgagctcaccacagacacagtggagccgcgctcttctccagttacacgtggacaaatgcgggctcatcagcccccccagagagggtaaggccgaacccagttctcctcctcttaggtattttcagcaa

SEQ ID NO: 1991 - DNA, 107 bp, Homo sapiens
agatgaactaagaggaatatataagataaaggatagagataggagaggaaaaaaattaataagcgtattagatgctaagcctaaacgagactggaagaagttactta

SEQ ID NO: 1992 - DNA, 500 bp, Homo sapiens
agactggcaacctcaagaaggccctgctcctccagggctccaacgagatcgagatccgcgccgagggcaacagccgcttcacctacagcgtcactgtcgatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttaccaaaaaaaaaaaaaaaaaa

SEQ ID NO: 1993 - DNA, 179 bp, Homo sapiens
gtcgccccaagtggcccagagtcgtgacagtccggagggctggtgtggccggtgggcgctgcctcttcatctgatggagccaggaggtccgccagtgggggaaaggcttcttccgaggcttctgcactcgcctggggagaggcccagtcactacaggaccctgagatgtccagaccctt

SEQ ID NO: 1994 - DNA, 129 bp, Homo sapiens
gtttctttttcctaaaacggttttatttaactcaatgtgtcaaagtttttttttaataatcccaagagggatgaagccgtgtccacagggatatatacatcattatggttcccatctttcatacatgaa

SEQ ID NO: 1995 - DNA, 167 bp, Homo sapiens
cctggacgaccacacgcagaccctctttcaggcgaacctcttcccggccgctctggtgcacttgggagccgaggagccggcaggtgtctacctggagcctggccttctggagcatgccatctccccatctgcggccgatgttcttgtggccaggtacatgtcccagg

SEQ ID NO: 1996 - DNA, 133 bp, Homo sapiens
gtcaactataagattttggatcgggagaaccgaagatatctatcatcatcaactcttctgctccaccccacactatactgaatgaacttaggccagaacaaggtagaacagctaaagcttatcatgagcaaac

SEQ ID NO: 1997 - DNA, 103 bp, Homo sapiens
gggaactgtgtaagaaacgtgtcagacttctgccatcagccagctaaggctttgtgatgtactttgaaagaatattgatgcttcacagatatggaaatagggt

SEQ ID NO: 1998 - DNA, 215 bp, Homo sapiens
ttctcccagggcctggatgactatggagcgcggtccatgagcagtggcagcggcacgtggttgttcacagtgtgaggacgctgaccccgggcagccgctgctctgaagagcttccgcgccttccccctggtctcgtccgttttcctcctcagctctcgctggtttgttcttgggatgttttccttttccccctagccatgccttttggttggtac

SEQ ID NO: 1999 - DNA, 140 bp, Homo sapiens
gttaggatgttgctttctttttccattagttaaacatttttttctctttggaggaagggaatgaaacatttatggcctcaagatactatacatttaaagcaccccaatgtctctctttttttttttttactccccttgct

SEQ ID NO: 2000 - DNA, 110 bp, Homo sapiens
ggcaccctctggatggaccagctctgcaccggctgcatgaagaccccttccttggtgacatggcccacatacgctgagggcacctttattgtctggggacaggacctcag

SEQ ID NO: 2001 - DNA, 230 bp, Homo sapiens
  misc_feature 35: n = A,T,C or G
tcgtccaattcggcaggggttctattttatatgtnatcatccttttaatcttaaaaaaaaatctcatgagatagtacttatgaataccattttacagatgagaaaactaagacaaagaaggggcttaataacttgcacagggtcacacaacccagtaggtattgattatgatgctcagtaaatgatgcaaggatgataacgatttgagacaattagaaaggtacccattc

SEQ ID NO: 2002 - DNA, 449 bp, Homo sapiens
ctcgtgccgaattcggcacgaggttctattttatatgtaatcatccttttaatcttaaaaaaaaatctcatgagataggtattatgaataccattttacagatgagaaaactaagacaaagaaggggcttaataacttgcacagggtcacacaaccaagtagatattgattatgaatgctcagtaaatgatgcaaggatgataacgattggagacaattagaaagtgtacctattcagagtatttgattgtggaaggttggaagtgaataacatatctgagaaaataagcatcactccccgacaatgtcaggtaaatgaggtcttgactttgactccacagaaatttatctagcagccaaattggctgttaattgaaaatggatctgggaagagggcgtcaaaggcatagagaataacaatttatcacataaaaaaaaaaaaaaaaaaa

SEQ ID NO: 2003 - DNA, 221 bp, Homo sapiens
cggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctttggggatcttgcactttggttcccgcattaagacaaaagctggccgg

SEQ ID NO: 2004 - DNA, 186 bp, Homo sapiens
aagaggaccacacatctttttggtcacagagttcatgtcacaccagtgctagaagtttcatgattttatttcccagcagttctgatgacaagacttaatgttaccttttctttctgacagattttaaaaattgatattataaagcacaacttctataggttcttcctgagacccctcataggaggg

SEQ ID NO: 2005 - DNA, 180 bp, Homo sapiens
  misc_feature 44: n = A,T,C or G
cacgagctgtgacgggcaccagcggcctgattccagggaagagntcctggagggtgttggctgtttttgttagctcagtttttttctgggctccaccattccttactccaggtagacaagatagatgtcacacacaacaattttaaaggatttttgcttagggcatttggtttaatgatt

SEQ ID NO: 2006 - DNA, 200 bp, Homo sapiens
tttcctacctgaggcttcacttgcctcactgtgtttcttacctcagcgttcctagtagcacagtttggaaagggatgaggtagaaaagctaccctttttggcattctttgctgtaatcctgtgtgggtgtttcaaagagggccgtctgcctttttggagggaggggggtcccaaccaatttggatgcttctttggctaat

SEQ ID NO: 2007 - DNA, 380 bp, Homo sapiens
gtttcctacctgaggcttcacttgcctcactgtgtttcttacctcagcgttcctagtagcacagtttggaaagggatgaggtagaaaaagctaccctttttggcattctttgctgtaatcctgtgtgggtgtttcaaagagggccgtctgccttttggagggaggggggtcccagccatgtgggatgcttctttggctattttgcctctgggagttggagcccagagaggagagcttgaggggaccaaagcctcccgcgctgcgtccgctctgccaaactcctgccaaattccaagatctgaggaaagtttattcatcttgctttctcaggggagccctgatttctcttatcccaggtcctagcatcctcatctgggggc

SEQ ID NO: 2008 - DNA, 170 bp, Homo sapiens
gattctgagaatgaacctctcatggatgtgatgagaattcagaccatgttatggagaaatggattcgtgagagatgagcgactcaggcattaactcttgaaaccatattgaattggctgatggcaagtcaggaagatccttttctacagcagttacagaaaacttcagct

SEQ ID NO: 2009 - DNA, 104 bp, Homo sapiens
ggggggacgggtcagaccgcgaaggtgaaaatgacgagggtcagaccgtgagctaccggctagcagatcgagcaacgaggtgaagtgttgcaagagcaagtggt

SEQ ID NO: 2010 - DNA, 470 bp, Homo sapiens
ctctttttgacctgtgcataccttctaattgtaaaatatatttcagaccgtgagtaccttgagatctgagcaactgtgttaatgaagtaatagcaatggtccacagtgaaagatgtgttggggtttgcaaaacaagcattccgtcacctctttaataatgtcacagactttttaaaagagaggctatcaagttgtaatataatctgtcatgttttatttaggaaggaaggtaaatttgtgcttgcacggggatcattttgtattatttttgctaatacccagttgaagctaaaaagcaactatttgaatcctgtgaattaatttataaggaatgttaaacagctttggaaatacatgcatcctatgaatcatagccttatttagcaagatcaatgttaaagtgttgttatatggcaagtatttaacacattcacagtgtttgtttgatttcaactgtgaattgtcttaca

SEQ ID NO: 2011 - DNA, 155 bp, Homo sapiens
ttttaatctaagcattttcccccgtttctcatattttaaccatatgttcgtgtagataactaaacagtatgatctggttggcattttctttcctgatgatgggagcgtcattcttttgtcttcattggtacttgtgtgaatataacatacatctg

SEQ ID NO: 2012 - DNA, 201 bp, Homo sapiens
aggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcactctaactt

SEQ ID NO: 2013 - DNA, 315 bp, Homo sapiens
actcctgacctcaggtcatccgcctgcctcggcctcccaaagtcctgggattacaggcataagccaccgtgcccagccttgttcttgtgatacaaaattttgtgtcacagaattctatttttaacactattactttctagaaggtaccaaacatactataaaataagcatttattgagtgtgtactaaatttaggacaccatattgggtgctcctggaaatgtaaaacacaatgatttgggccctaacctcaattgtttgcatgctattaagaggacagatggacatttgtgatgtgtcagacaatttgaatctg

SEQ ID NO: 2014 - DNA, 270 bp, Homo sapiens
gtaaccagggattttcccattatgttcccttttataccatttaggtgtgagttccttagcttctgcctataggaacataagtaatgaaaggtcatctaggtgtgtgtttggaattttttccttttgttttttggaaaatggaaagaacaaggcaaggaaggaaaattaatggggagctgaagggaggaaatgttacagtaatccactgagatgtagtttagtcaaacataggtatatgacgctgttaatctggggggatccgtgggattt

SEQ ID NO: 2015 - DNA, 240 bp, Homo sapiens
cggcggccgttgcgattgattgcgctggttgcctgcggcgtccacttccttggccggccttgctacaatggctgattgttgtgcagccggcgccatgtctttaagccagatcttcgtggagctgcagggctttttggctgccgagcaggacatccgagaggaaatcagaaaagttgtacagagtttagcacaaacagctcgagagattttaactctctgcaaggtgtccatcaggctgct

SEQ ID NO: 2016 - DNA, 100 bp, Homo sapiens
gaagctagctcgttgggtagcctacttcatcggcgactgaccgcgtcggcagcgcagcctcactgccgcgccatggcctctgtccgagctgcctcatcta

SEQ ID NO: 2017 - DNA, 440 bp, Homo sapiens
ggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggccttggtctttttgactaaacctc

SEQ ID NO: 2018 - DNA, 342 bp, Homo sapiens
agcagccccacctcagagactgcacaagagaaagactcctggccccatgttcccttcctccagccctatgtggggtctgcaggtcacaccctgagatctcggccacctcccccaggcccctgttggaccagtgctgctccggaatctccatctctgtcctctcagagggggagctttggtgatttctgaacctattcttgtttaatggagcatttttagtgttactactagattcacacttgagagcatgtctaaaaggcttttacaagaggctcagaccacaccgaaagatcttccttggaggcagttcaaagaggcagattaacaacacgacggtaccaa

SEQ ID NO: 2019 - DNA, 192 bp, Homo sapiens
cacgagcatatttcacctccgctaccataatcatcggtatccccaccggcgtcaaagtatttagctgactcggcacactccacggaagcaatatgaaatgatctgctggcagtgctctgagccctaggattgcatctttcttttgaaccgtggggccctgaactggcattgtattagcaaactcatcactgg

SEQ ID NO: 2020 - DNA, 299 bp, Homo sapiens
gacactagtggatccaaagaattcggcacgaggttcaagaagctcagaggtcaccaagcaggatgaaagcaagatgaacacatgaaaacccactcgggtgcataccggtcagaactcctgcaaaccgagcacagaggaggttttggaggtggccagaagaagatgcatcaggtacaaaaagaaagatgtyagccgcaaggttctcgtcagaaagcctagaacaaacagggtttttcttcggtgctgtaattaagaagtcaccaggagtaaaaggaaacataaccttgtcaagagaggcg

SEQ ID NO: 2021 - DNA, 288 bp, Homo sapiens
gttcaagaagctcagaggtcaccaagcaggatgaaagcaagatgaacacatgaaaacccactcgggtgcataccggtcagaactcctgcaaaccgagcacagaggaagtgttggaggtggccagaagaagatgcatcaggtacaaaaagaaagatgtcagccgcaaggttctcgtcagaaagcctagaacaaacagggtttttcttcggtgctgtaattaagaagtcaacaggaagtaaaaggaaaacataaaccttgtcaagagaaggcgaaaaaaaaaaaaaaaaa

SEQ ID NO: 2022 - DNA, 295 bp, Homo sapiens
gtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgcaaggacattaagaaatggaaggtcactatgttcatgctgggcacatcattgcacacagcgccatttccgctggcacccaggtcccatgtggttttgggagattaatttctttatgcctggagagggatactccctcatagggggtttacg

SEQ ID NO: 2023 - DNA, 250 bp, Homo sapiens
gtcctgctagagaaactgcagatggaagctgagcagttaccaactgctaatgtgccaagtataccaagcacagcatgtgtcctgtagaggggcattattttaaacaatgttctactatcatctaccaaaataattgtggtaaaggtgtagtattttattttttccttttatgtcagcaatattttaaaatattgatctgtttatcttatatttttagggataaatgtggtatttgcctcagaattgtggg

SEQ ID NO: 2024 - DNA, 280 bp, Homo sapiens
cagaagcggcgtcaacggcaccctcggaggagccgccccagcacagcccactgagaagagcttccaggacgaacccaggacgctaagcccaggagcctgcaggctgacgtgcatccacccagacggtgtcctcttcttgtcgctttttgtaatataaggaatcccattaaggagggaaaaaataaatcccacatttgtgtatgcacccactcacccttccaaatcagcaaaccgcatctaatttgtccgccgatgccaagcaaggaaactttttataccc

SEQ ID NO: 2025 - DNA, 102 bp, Homo sapiens
cagcaaaaaggaaagttaactaaaaaaaaggccgcgtgacctattcacctccacttcccgtctgcagaatgctgaaacgtgcgtcaccttgcgagtagagag

SEQ ID NO: 2026 - DNA, 105 bp, Homo sapiens
ccattttttgaacctctgcgccatgagagccaagtggaggaagaagccgattcgctaggctgaagcgcaaaaggtaggctaggatgaggcagaggttcaagttaa

SEQ ID NO: 2027 - DNA, 175 bp, Homo sapiens
ggcggcaggcgccatgtccggccgcgaaggtggcaagaagaagccactgaaacatgcccaagaagcaggccaaggagatggacgaggaagataaggctttcaagcagaaacaaaaagaggagcagaagaaactcgaggagctaaaagcgaaggcccgcggggaaggggccctcgc

SEQ ID NO: 2028 - DNA, 180 bp, Homo sapiens
tatgcatatacgaaaagccacgaagtatctgaaagatgtcactttacagaaacagtgtgtaccattccgacgttacaatggtggagttggcaggtgtgcgcaggccaagcaatgggggctggacacaaggtcggtggcccaaaaagagtgctgaatttttgctgcacatrcttaaaaacg

SEQ ID NO: 2029 - DNA, 180 bp, Homo sapiens
tcgcatcaggagtatcaatcacctgagctcaccatagtctaatagaaaacaaccgaaaaccaaaataattcaagcactgcttattacaattttactgggtctctattttaccctcctacaagcctcagagtacttcgagtctcccttcaccatttccgacggcatctacggctcaacata

SEQ ID NO: 2030 - DNA, 175 bp, Homo sapiens
tcgtgccgaatcctcacagccgtgactccttatattgctactgctgggttgggaccttggcttgtcaagactaagtagtcagcccgcaccaccccaaaaacaaaaccaagcaaagaccacatacagattccatttataggaaatgtcccaaataggcaaatctatatagacagaa

SEQ ID NO: 2031 - DNA, 117 bp, Homo sapiens
gagtggctatatccaggagcagtgttcggacgattcaagtacataattagcatagactaaacgggagatgaggtagcgagcataatatgtattattattcagatgggaaaagttagt

SEQ ID NO: 2032 - DNA, 430 bp, Homo sapiens
tggctatatgtaggcacagagctgggccatccaagtccgactttgccaaagcctcacggtagatgggggcaggccttattagttctgctttgtagatgggaaagtgagtctgggagctgggaagggactggccagaactgcccaggtgaccgcagtgcctggaggcgagccaggtgctgccggggtctgcatgcctgccccggggagccacgtcctcacacctgcccccttggcctgcaccccaggggaccggctgaacgagcgcgtggcctaccaccggctggccgccctgcaacaccgactgggccatggcgagctggcagagcacttctacctcaaggccctgtcgctctgcaactcgccgctggagtttgacgaggagaccctctactacgtgaaggtgtaccttggtgctcggtgacatcatctt

SEQ ID NO: 2033 - DNA, 176 bp, Homo sapiens
agggctacaggccccatgcaagtttgaaatccaatagggcagtcattaaaggagatccaaaatcatctcctttgactccatgtctcacgtccatgtcacgctgatgcaagagggggggtctcacagctttgagacagctctgccctgtcgctttgcagtttacaggcccccctccc

SEQ ID NO: 2034 - DNA, 111 bp, Homo sapiens
tgtcacactagcatagagaatgtgttgaaatttaactttgtaagcttgtatgtggttgttgatcttttttttccttacagacacccataataaaatatcatattaaaattc

SEQ ID NO: 2035 - DNA, 176 bp, Homo sapiens
gcctaatgaaggttgagaaccgtaggagaggctctcatgctgtaaataatgttgcaggctaataaccttttcatcacttccttttgtgcgcttcctgccttaagtgacaagtagcaacatggcttgggttccctgtgcagcatcagcttatgctgccacaagtcaagtttgcaccc

SEQ ID NO: 2036 - DNA, 197 bp, Homo sapiens
tttttctaaaggtgctatttaacatgggaggagagcgtgtgcggctccagcccagcccgctgctcactttccaccctctcttcacctgcctctggcttctcaggcctctgtctctccgaacctctcttctctaaaaacccttctcacaggctgaaggcccattctcccggctcccttcatgtctgttctgcgttcct

SEQ ID NO: 2037 - DNA, 184 bp, Homo sapiens
aaaaaggatagtctcttttcttactctggcaaaccttgttgagttgattccacaaagatacagtattacttaggctatctgaattattgatagaaaagggtcctgttaggttcctatataaaggcattttggagatgaccttggtgcccttgaaccttgaaaatagggattctgggggttagga

SEQ ID NO: 2038 - DNA, 187 bp, Homo sapiens
ccactgtggaagtccctcagaggccttggggcatgacccagttgaagatgcaggtttgaccagggaagcagcgctaggttggagggtttgaggaggaagttaaggattgaggggttcatcattcctcccctgccttaaagggaggctaaaggcattgcccttctgtccccttcccttccttcaacca

SEQ ID NO: 2039 - DNA, 110 bp, Homo sapiens
ccggaggggctctgccgttctgtagtggcgctgcttgggcccgtgcgattgtaagctgcttggtttgccggctggaagaccgccagagagggttccggcaatttttcgtc

SEQ ID NO: 2040 - DNA, 163 bp, Homo sapiens
ttttggtccagggtaaaaggattgagagttcctttccacacttgttggccttcgggttgttgggattaacttgttggtggggcctcactctaggtcaatccacttggtcaaggttggtccaaggttcttggcctagagacaagggccaaggcttgaagcaggc

SEQ ID NO: 2041 - DNA, 580 bp, Homo sapiens
aaaaaggatagtctcttttcttactctggcaaacctgtgagtgattccacaaagatacagtattacttagctatctgaattatgatagaaaaggtcctagttaggttcctatataaagcatttggaagatgaccttgttgcccttgaaacttgaaaatagggattctggggtgaggatacaaagacattgtcttgcatatccataagcaggtcttagagcattattccaaactctagctgtttcagtagttctatgaggattgcaagtcataggtgtgtgtggcatatcagtccatctccctcatctccattctcaagtttcttccccacaaaatttggaatcaaagcttttatgacgtttgccaattgcagaacttcttcagctaaggttaatttgacgctatgataaaactgagagatgtcaaaaagcctcctagaaattttaatcttgaaaagacttttcagggtatctcattttttaggtgggggtggcaggtgtatttcctttttaacaaataaaaaggcatttaagtaaaactaaaatgaaaaaggtaggccttctgacattgtgtacttggtg

SEQ ID NO: 2042 - DNA, 137 bp, Homo sapiens
ccgagctgacgcaaacatgcagatctttgtgaagaccctcaatggcaaaaccatcaaccttgaggtcgagcccagttgcaaccattaggatgtcaaagccaaaattcaaggcaaggagggtattccaacttacccgc

SEQ ID NO: 2043 - DNA, 201 bp, Homo sapiens
atgagtctctttctccaggaaacattttctgatttctgctctcccatttgactgcttatttatgccttcttagcatttatcaaatcatattgaaaacaagtttcaaggattgtctgcctcagtagccaatacattgttagagagttctcaatttctctcacatgatagctcaataaatgtgttcctaaatgggtgaactca

SEQ ID NO: 2044 - DNA, 470 bp, Homo sapiens
atgagtctctttctccaggaaacattttctgatttctgctctcccatttgactgcttatttatgccttcttagcatttatcaaatcatattgaaaacatgttcaaggattgtctgcctcagtagccaatacattgttagaggttctcattttctatcacatgatagctcaataaatgtttcctaaatggttgaactcaactggttttcattatggatctgttagcttctaatatgggtaggcaaagggacagaaagaaaataaggctgctgctgttataattagtgttgactcatattagaccttgataggtgtatcttaaaaccttaaaaacagattaaattgggctattaaagtatctatgtctgtggtgggggcaggggtagtagtagtgttagaggagatgagatagtgattgatggctgatgggagaaatgtggtaggaagcacaagatcacactaaaattatcc

SEQ ID NO: 2045 - DNA, 204 bp, Homo sapiens
caggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtgtgtgtgccaggcagacttcgagggggttcgtcttttaagacctaaagttctta

SEQ ID NO: 2046 - DNA, 110 bp, Homo sapiens
cagatttctatttttttttcttataagttcgttgtgtctagagattgttaatattgtaatttaatgtagacttactttgaataaaattagtttaattggccttaaaaaaa

SEQ ID NO: 2047 - DNA, 190 bp, Homo sapiens
gacagctcttcagcccagtagcagttggagcaggccgtgtcctgccctcccagcaataaccacctcctggaggccagctgagatgccttgctacttggcaccagggacttcctgacacacagtcaatttaattctcaaggggcctgtggctgagaaaaggtgccagcccaacacactctaagctgccccc

SEQ ID NO: 2048 - DNA, 180 bp, Homo sapiens
gaaaggatgtattcctaaacacatataacctactaagactaaatcataaaggaaaaggaaatctgggccggcaatggtggctcatgcctttaaatcccaggactttgggaaggccaagccacgcagagatgacctaaggtaagagtgttcaaaacccagcctggcccaatatggatagaa

SEQ ID NO: 2049 - DNA, 200 bp, Homo sapiens
aaatatttgaatgtgccaggctctgaggtgggtgctggaaatgctgccagcagcaccacccatcctctcctcgagggaaatttcagtgcaaccaaatatttgaaaccacacagtaagcccaggttgccctgaccacacaagggagggcactggtattggttcattctcatactcctataaggagctatctgacactggga

SEQ ID NO: 2050 - DNA, 510 bp, Homo sapiens
aaatatttgaatgtgccaggctctgaggtgggtgctggaaatgctgccagcagcaccacccatcctctccctcgaggaaatttcagtgcaacaaatatttgaaaaccacagtaagcccaggatgccctgaccacacaaaggaaggcacttgtattagttcattctcatacttctataaagagctatctgaaactgggaaatttataaagaaaagaggtttaattggctcacagttcctcagactgtgcaggaagcatggctaggaggcctcaggaaatttacgatcatggcagaaggtgaaggggaagcaggcatgtcctacatggctggagcaggaagaagagagccaagagggaggggccacacatttttaaacaaccagatctcatgagaactcacacactatcacaagaatagcaaaggggaagtccacccccatgatccagtcacctccaaccaggccccttctccaacaatggggattacagttccacattgagattttgagca

SEQ ID NO: 2051 - DNA, 115 bp, Homo sapiens
ccggcgagttcgtggacctgtacgtgccgcggaatgctccgctagcaatcgcatcatcggtgccaaggaccacggcatccatccagtgaaccgtggccgaggtagttcagatgat

SEQ ID NO: 2052 - DNA, 190 bp, Homo sapiens
tccaaccccccagcactgaggaagaacggggctcttctcatttcacccctccctttcttcccctgcccccaggacttggccacttcttggttggggcagttgggtcccaagatttggctcacacttagagaattgtaaggacctcaaaccaaaaatttctatttaaattaaattttgtgcttcaaaaaaa

SEQ ID NO: 2053 - DNA, 150 bp, Homo sapiens
aaagtttctcagctgctaagaatttccccactgtttacttctttcacttatgttgtattgcattaaggttaccaaattttaagggtttattttgtatcaattacccaaaccattaaattggctcttaattcaatgtgtgtccttggaggg

SEQ ID NO: 2054 - DNA, 115 bp, Homo sapiens
aataaatgagttggtcttagcacaatgtttctttttttgaaataggttctttgaaggtttaatgttggcctaaatcttatattccctacggtaatatattaattactcttctcga

SEQ ID NO: 2055 - DNA, 270 bp, Homo sapiens
aataaatgagtggtctgagcacatgtttctttttttgaaatagtttctttgaagttttattgtggacttaaatctaatatccctgacgtaatatttattgactttctaggcatcattcattcattcaacaaatgtttctgagtgcttgtcagattctaccactaaggttgctgtactgaacatgacttataaggtgcctgtgctcagcaagcttaccttctagtgaggactaaacagaaaccagacaagtgaacagggtttaaatttatg

SEQ ID NO: 2056 - DNA, 231 bp, Homo sapiens
caataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatttcgggtagatgacaaggtgaatttccattttattctgtttaacaaccgtggatggcacctctattaacttgatga

SEQ ID NO: 2057 - DNA, 185 bp, Homo sapiens
ctcgggggtgggctccggcacccacatcctggagtcaggactttcctcagtgacttgtgtgtagggggggtttcagggctgaaccccaacttccctccacctttcttccaacttaactgttggaaccacctgtgaaaggttgggattatggtggtctccttggcttagggctcctgctctccaag

SEQ ID NO: 2058 - DNA, 151 bp, Homo sapiens
ttcctttgtcctttttcaggagaattagatttctataggattttctttaggagatttatttttttggacttcaaagcaagcttggtattttcatacaaaattcttctaattgctgtgtgcaggttccgatgtaattagatgttacagttta

SEQ ID NO: 2059 - DNA, 146 bp, Homo sapiens
agatggcggactgccgcgtgctccgtagctggtcaagaggggtcatccgactacggccgtgaaggatccgaggtgaaggcctgacaaggacccggtgttggtcaacggatgggtgttaaggcacttccaatgaacccccttcctgt

SEQ ID NO: 2060 - DNA, 610 bp, Homo sapiens
cggcacgagagatggcggagctgcgcgtgctcgtagctgtcaagagggtcatcgactacgccgtgaagatccgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggagacgattcgtaccgccctggccatgggtgcagaccgaggtatccacgtggaggtgcccccagcagaagcagaacgcttgggtcccctgcaggtggctcgggtcctggccaagctggcagagaaggagaaggtggacctggtgctgctgggcaaacaggccatcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgcctgcccaacatcatga

SEQ ID NO: 2061 - DNA, 230 bp, Homo sapiens
caaaactatttaatgaatgttagttctgtttagcaaccattagttgctgacaatagatttaggttttgaggccaaatcttttgtcatctagacaagattcctaagtcaggctcttccggtcacataaaataatatttgctgacaaacaccaaaacacaatttactttttgacatcaggaatcatattcagtgttctggaggcctatgcttacatgtctacccaattacct

SEQ ID NO: 2062 - DNA, 480 bp, Homo sapiens
caaaactatttaatgaatgttagttctgtttagcaaccattagttgctgacaatagatttaggttttgaggccaaatcttttgtcatctagacatgattcctaagtcaggctcttccggtcacataaaataatatttttgaaaaaaaccaaaacacaatttactttttaacatcaagaatcatattcagtgttctggaggcctatgcttacatgcctacccaaattacctaacaaaaccatggggacccactaggtgcctttgaattagcttagttaggttacatctgggaagaaaatcattaaaagctgttctattgatatgcagattttaataattagcaaaagtctgttactttaaatagtgaaaaatttttgggtggagttgtatgttttaagattgagacagtggtaatattattgaaataatttgaagaatatgaacattagttttcttcaggaaatgaatgctcatatttctc

SEQ ID NO: 2063 - DNA, 300 bp, Homo sapiens
gctctgcagcactcttatctacataaggatgaaggtaatcccgagtgagcaatggagtgctgccatggaaggaaggaaagctgccaattcccttctggacactgagagggcaatctttgcctttatctctgaggctatggagggtcctcctccatctttctacagagattactttgctgccttaatgacattcccctcccacctctccttttgaggcttctccttctccttcccatttctctacactaagggggatgttccctcttgtcccttccctacccttatatttggggccttttt

SEQ ID NO: 2064 - DNA, 285 bp, Homo sapiens
cgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagttgttatggtgggcaaactaagccgattttccggaaaaaggctaaactacaaagaagattgtgctaaggcttgagtgcgttgagcccaactgcagatctaagagaattctggctattaaagatgcaagcattttg

SEQ ID NO: 2065 - DNA, 245 bp, Homo sapiens
ctggcacatatggtcaccttggagggcagacctaggagcccctctgaccacttgaattccgtctccacaccccttctgccaagggaagccccttcaggaaggaccccccaaagctgaggggcttgaatttagccttttcaacagagaaggctccacttgagagcagcctctaccttaccccctggaccacagagagccactcttaccctcagccccctcgctcttcagctaaactcaaaggtttg

SEQ ID NO: 2066 - DNA, 186 bp, Homo sapiens
cacctccaaactgtgccctcaaaggttgtgtataagtacctctagaacaatccccttttttccatcaagctgtagcctgcagagaatggaaacgtgggaaaggaatggtatgtggggaaatgcatcccctcagaggactgaggcatagtctctcatctgctattgaataaagaccttctatcttgt

SEQ ID NO: 2067 - DNA, 310 bp, Homo sapiens
cgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggttggaagtcacattgcagatcttaggcact

SEQ ID NO: 2068 - DNA, 205 bp, Homo sapiens
gtgaacttgaaaacttgcagactcaggggggtccctgatgcagtgcttcagatgaagaatgtggacttgaaaatacagactgggctagtccagtgtctatatttaaacttgttcttttcttttaataaagttagggtaacatctcctgaaaagctttgtagcacaaaggctcagctggggatggtgtttgacttcggaggaaaaa

SEQ ID NO: 2069 - DNA, 161 bp, Homo sapiens
aaaaatacaaaaattagctggtcgtggtggtggcacctgtaatcccagctactcgggagactgaggcaggattgcttgaacctgggcagcggaggtttcagtgagctgagatcccgccactgcattccagcctgggctacacagtgaaacatcatctcaga

SEQ ID NO: 2070 - DNA, 186 bp, Homo sapiens
ttaaaaagaaaagtgtaatgcaagaatttaaagaaatatttttaaagccacaattattttaatattggatatcaactgcttgtaaaggtgctcctcttttttcttgtcattgctggtcaagattactaatatttggggaggctttaaagacgcattgttattggtgctaatgtactttacactttw

SEQ ID NO: 2071 - DNA, 270 bp, Homo sapiens
caggctgactgtgctgtcctgattgttgctgctggtgttggtgaatttgaagctggtatctccaagaatgggaagacccagagcatgcccttctggcttacacactgggtgtgaaacactaattgtcggtgttacaaaatggattccactgagccacctacagccagaggagatatgaggaaattgttaaggaagtcagcacttacattaagacaattggctacaccccgacacagtagcatttgtgccaatttctggttggagtggtga

SEQ ID NO: 2072 - DNA, 280 bp, Homo sapiens
cttagcagaatcttgaaaagcccagagatccaaagagcccttcgagcaccacgcaagaagatccatcgcagagtcctaaagaagaacccactgaaaaacttgagaatcatgttgagctaaacccatatgcaaagaccatgcgccggaacaccattcttcgccaggccaggattcacagctccgggtggataaggcagctgctgcagcagcgccactacaagccatatcagatgagaaggcgcgttgcagacaagaagcctgtggtaggtaagaaaggaaa

SEQ ID NO: 2073 - DNA, 160 bp, Homo sapiens
ggcccgcgccccctttgtctgccttcacctcagttgatagacgcagttcacaccgcataggtggatagctctcatatttctgcataaaaatacttacttgggcgccattgccttctacttggaggagattttcagagccaaagtctcgattgaaccagcc

SEQ ID NO: 2074 - DNA, 360 bp, Homo sapiens
ggcccgcgcccccttgtctgccttcacctcagttgatagaagcagttccacaccgcataggtggaatagctctcatatttctgcataaaaatacttactgggcgccatgccttctacttggagagattttcagagccaaagtctcgattgaaaccagcctcgtgcctgcatcgcaccctaccccgcgcgggccccccgcgccggccccactgcctgagtctggggcggatcctacctggggggcctcccccgactctcagcccggctcaggctgtttctggcttgacgatgatgtgagtgtccagccgtaaattctccagcacaaaagatatttcccttgggaaaaaaaaaaaaaaaaaa

SEQ ID NO: 2075 - DNA, 145 bp, Homo sapiens
gcaaggcctgagaatctggaaagatgaaggtgatatttactgaaatggcctacactcttgaatgaatagattaggaagtcaaattgacagtcttgttattggttttataagttgagacggctatcaaacaatcaaaggaatattt

SEQ ID NO: 2076 - DNA, 404 bp, Homo sapiens
gaaaggcctgagaatctggaaagatgaaggtgatatttactgaaatggcctacactcttgaatgaatagattaggaagtaaaattgaaagtctggttatgggttttataagtttgagacgcctataaaacattcaaagaaattattaaatagtgaactggatatatgagcctgtagttcaagaaagaggtctggattaaagttatgatttggacaacatcatcatatatgtggcattagtgtcatgattccaaatgagataatccagggaataactatagagaaaagaggagaggaggataatttctggtgatatttcaatgctaagtggttgggaaaatgaagagaacacagtgaagttgaccaggatgaagtacttactgaggtggaagaatcaatggagaa

SEQ ID NO: 2077 - DNA, 200 bp, Homo sapiens
gaaaggcctgagaatctggaaagatgaaggtgatatttactgaaatggcctacactcttgaatgaatagattaggaagtaaaattgacagtctggttatgggtttataagtttgagacgcctataaaacattcaaagacattattaaatagtgaacttggatatatgagcctctaggtcaagaaagaggtcttgattaaa

SEQ ID NO: 2078 - DNA, 512 bp, Homo sapiens
aaaaaagtggcattggagactccattgtcccacatctgtaacctggggcccttagctcaagtcatcagcaaggatgagagaaggatgctgggagcagaggagaggagaaaggaaggggaccctgccagcacctgaggtgccaggctccaggccaggagctttccttgggtcatctcatctgagtctccatcatcccaagaggcagatcttacttttgccgttttgcagatgagcaaactgaggctcagaagtttaaacaaccttcccaaagtcacacagcttggaagtggtagagacagaaagaaggccagtagagagagtgactagggatgtgaggcagaggagaagtgatgggatttggcactagtctgtctccccagggggagaacctctgaggttcctccagagtacttctagagcggccgcgggcccatcgattttccacccgggtggggtaccaagtaagtgtacccaattcgccctatagtgagtcgtattacaattcactgggg

SEQ ID NO: 2079 - DNA, 170 bp, Homo sapiens
aaaaagtggcattggagactccattgtcccacatctgtaacctggggcccttagctcaagtcatcagcaaggatgagagaaggatgcttggagcagaggagaggagaaaggaaggggaccctgccagcaccttaggtgccaggcttcacggccaggagcttttcttgggt

SEQ ID NO: 2080 - DNA, 287 bp, Homo sapiens
gaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaaaaaaaaaaaaaaaa

SEQ ID NO: 2081 - DNA, 140 bp, Homo sapiens
aggctctgagctgcaggtacaagtctccagaagctcagaggctaagaaatttcctatacctgcacccactctaatagtggggaggacggttagactgttgttcaattgcattaggttagtgtaagctggtaatatacaat

SEQ ID NO: 2082 - DNA, 105 bp, Homo sapiens
cttacctagaatgcgcattatgagaccgccattatggctcatcttgcagcagacatccctctgagcaggcttctctggattcacgggctctgggactctacacac

SEQ ID NO: 2083 - DNA, 590 bp, Homo sapiens
ctgaccctcagaatggcgcatgatgaagaaccggccattcatgggctccatctcgcagcagaacatccgctcggagcagcgtcctcggatccaggagctgggggacctgtacacgcccgcccccgggagagctgagtcagggtgggccttcggtagatccccggtctgatgtttcctcaacgctcttgggaatccctccctccatcctcccacactgggtgatgtcctggggccctgggcactgagagagggaggagagagaactcctgactgggaaggcgtcctgaggccaatagggctggttggagggagaaaagggacagcacgccaggcaaagacctggcagctgtgctcagccctggaccttgttcctcctcaggcctgaaaagcctcacctgaacctgtggctggaagcccccgacctcctcttggccgaagttgacctccccaaactggatggagccctggggctgtcgctggagatcggggagaaccgcctggtgatggggggccccagcagctgtatcatctagacgcttatatcccgctgcagatcaactctcaatgagagcaaggcaagccttccaacc

SEQ ID NO: 2084 - DNA, 105 bp, Homo sapiens
gctaggtgacctcggctgctcaggatctcagacttcagccatggggccaacttgccgccgtacttggcgatgctcggttggagccaccccttcagatgccacctc

SEQ ID NO: 2085 - DNA, 425 bp, Homo sapiens
gctaggtgaccctcggctgctgcagggatctgcagcgactgcagccatgggggcccacctggtccggcgctacctgggcgatgcctcggtggagcccgaccccctgcagatgccaaccttcccgccagactacggcttccccgaacgcaaggagcgcgagatggtggccacacagcaggagatgatggacgcgcagctgaggctccagctgcgggactactgcgcccaccacctcatccggctgctcaagtgcaagcgtgacagcttccccaacttcctggcctgcaagcaggagcggcacgactgggactactgcgagcaccgcgactatgtgatgcgcatgaaggagtttgagcgggagcggaggctgctccagcggaagaagcggcgggaagaagaaggcggcagagtttggccaaaaggcc

SEQ ID NO: 2086 - DNA, 140 bp, Homo sapiens
cggcagagacaagagtgtctacctggcacttggttatgttcactgcattctctagtccactttgaggtaagccataagtgaggaccattgtgagaggccttaagagacagactagacacagacacgtgtacattgtgcat

SEQ ID NO: 2087 - DNA, 590 bp, Homo sapiens
cggcacgagacaaggaggtggtctaacatgggccaacttggtttgatggtttccatctggcattgctgctcatgtccttacttgtgagttcagagcattcagttgaagaaaccatggatagaaaggacctttaaaagaagacaagaactgagaacacagaacaagtggtcatctcttgtttcatctactctctagaccggtagatttatgtgaaaccctttgattccttttgcttctgttatccagcctgtaagatagtaatagtcgtcatatctttcatctactctagaagaatattttgataattcatctagcaaatacattttgattatggggtatgctttgtgatctagagtttgtcttaaattcatcatctgtgaattcagataccattcatatttaaattcctgataataatcccaatctgttatttttatcattggggacattagatatgtcagggtcagtgtacatttcacagtctataattttgcctctttcaatgagataaacaatttattactcctctggattttttcacccctgagatcatgttttattcagctctcctacctgcattttctctgtgt

SEQ ID NO: 2088 - DNA, 120 bp, Homo sapiens
cggaatatgccaagccagttgaaggtttacaagagttcacaaaagaagctctgtgcgaaagagatgtataaatcgcaatactcgtcgtaatatgcccacacgtgtcacagtgtcgctcct

SEQ ID NO: 2089 - DNA, 617 bp, Homo sapiens
ccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtcctagacacaatttcatttccagcattttataaactaccaaattagtggaccaaaaatagaaattagatttgtgcaaacatggagaaatctactgaattggcttccagattttaaatttatgtcatagaaatatgactcaaaccatattttttatgatggagcaactgaaaggtgatgcagctttgggtaatatgtctttttttcctttccagtgtc

SEQ ID NO: 2090 - DNA, 130 bp, Homo sapiens
ggcggctgggctgtttggttgagcgctcggcgctcttttgcgcacaggcgcacggagaggtctctccggcgcgccgcgctctcgcgtgtgggaatctcagactctctcacacagactctgtgtgcgcgcc

SEQ ID NO: 2091 - DNA, 568 bp, Homo sapiens
ggcggctgggctgtttggtttgagcgctcgccgtcttttggcggcagcggcgacgcgagggctcccggccgcccgcgtccgctgggaatctagcttctccaggactgtggtcgccccgtccgctgtggcgggaaagcggcccccagaaccgaccacaccgtggcaagaggacccagaacccgaggacgaaaacttgtatgagaagaacccagactcccatggttatgacaaggaccccgttttggacgtctggaacatgcgacttgtcttcctccttggcgtctccatcatcctggtccttggcagcacctttgtggctatctgcctgactacaggatgaaagagtggtcccgccgcgaagctgagaggcttgtgaaataccgagaggcaatggccttccatcatgggatcaactgcttcgacccagcagatcagctgcagaggatgagtgaccagttgctaagtggggctcaagaagcacgctttcccaacccctggctggcaattctggactccttctcaagagcacctaattaaagggggctgaaagtcctgaaaaaaaaaaaaa

SEQ ID NO: 2092 - DNA, 190 bp, Homo sapiens
gagchmgcgcgcctscaggctttgggtacgtgcagcactacggccttggcagtcctttgacacgtagagcgcgttcttaagagatgttgcttttaagcttgggaagacgcagaaaggtgaaggtgctcacagggcacacggtatacgtgatacgcttatttcagagctctctatactgcggcagcacgtg

SEQ ID NO: 2093 - DNA, 460 bp, Homo sapiens
ctttgggtacgtgcagcactacggcctgggcagtgcctgtgacaacgtagagcgcgtgctgaagagtgtggctgtgaagctggggaagacgcagaaggtgaaggtgctcacgggcacgggtaacgtgaacgttattcagcctaactatcctgcggcagcccgtgacttcctgcagactttccgccgtgggctgctgggttccgtgatgctggacctcgacgtcctgcggggccaccccccggctgagactttgccctgaacttgtccgggtagggagggccggaggcatgtggcctcccagacctcctgacctgggtggttgaggctcaagacagctcaaccggtccagaagctccatgctggtcactagggtgctgtgctctctggcgccccacagcctggccagctccagggacccagttgcaggggccaagcaggtgggagttggacaccaggcttc

SEQ ID NO: 2094 - DNA, 225 bp, Homo sapiens
catccagcaggtgttcgacaatggcagcatctacaaccctgaagtgcttgatatcacagaggaaactcttgcattcttcgctttccttggaggggttgttccgcaatttttgccaggtgtcttgtcttgcagatttggctacccaacctgttgcaatcaagtaccccattctattcaatcaaccggggacaaaacgagtcctggcctttgtcttgttgagacgga

SEQ ID NO: 2095 - DNA, 221 bp, Homo sapiens
ctagaacataaacttaatcagggcacagattttcattcactactgtatcctccagcacctagataaggcctagcaatgtagtaggtgctcaaatattttgcaaataatggaatgttaaagaaggagcagggcatcactcaagggcacttctaaaatacttagtccccttttgctcttgcaagcccttcagccccctcctctcatcctaggcatcaggtcag

SEQ ID NO: 2096 - DNA, 127 bp, Homo sapiens
cttgcgtccccaggtttgcagcttttcccttgggccactaaccatcctggcccgggctgcctgtcttgacctccggtgcctagtcgtgggctctccaatcttgtcttcctcccagtgttccccaatg

SEQ ID NO: 2097 - DNA, 174 bp, Homo sapiens
tcgacactagtggatcaaagaattcggcacgagacagaataaaacttattatacatctctttcttaaattaatatctttacacattttcaacttgctccccaagtcttgataagggaggatttaaaagggaaaaaggaaatgtaattagtttgggtgcccaaggagtgttcctt

SEQ ID NO: 2098 - DNA, 100 bp, Homo sapiens
tcgtccaattcggcacgattctccttcttgccatcctggccctgccctgcgctaacccccgaacccgttcagattccgctaaaacgccccgcccttgtgg

SEQ ID NO: 2099 - DNA, 439 bp, Homo sapiens
ctcgtgccgaattcggcacgagtgctcctgctggccatcctggccgtggccctggccgtgagccccgcgaccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaag

SEQ ID NO: 2100 - DNA, 105 bp, Homo sapiens
ctttggcaggatgtcttggggccttaccagccaggagccgcgttcaaagcgggcaagcggttccacctagaacccacaaagccccttggggagcaaccccaccct

SEQ ID NO: 2101 - DNA, 99 bp, Homo sapiens
acacgccgccgcttgttctgcagccatgtcttctaggttatcccttgaaagttccagcatattttgccggagtactttaacacccaacatcggtttggc

SEQ ID NO: 2102 - DNA, 160 bp, Homo sapiens
ggcagtgcgtggactcgtactgctaggaagctcgtagtcaccgcgagacagaagttgcatgataaacagtataagaaagctcattttggcacaaccctaaaaggccaacccttttggagggtgcttctcatccaaaaggatcctgctgaaaaaatgagga

SEQ ID NO: 2103 - DNA, 165 bp, Homo sapiens
tgaggataagctctttaaaggcaaagctttattttcatctctcatctttgtcctccttagcacaatgtaaaaaaggatagtaatatcagagacagggaggagggatggctttcttgggagcccatccaggacacattgggagcacatagagggttcacccactct

SEQ ID NO: 2104 - DNA, 120 bp, Homo sapiens
caagatagttctggagcccagccagacgtcttggatagcaaggtaagtagtcggatagagaaaagagctccctactccagccttcggtggaaagagcgagactctctctcaaaaaaaaaa

SEQ ID NO: 2105 - DNA, 110 bp, Homo sapiens
acggaaatatatgctatatacacagcatgctcttttttaaggcttcatttatagagtgatcagttgggatctaagctgtttgccagctgaagtacaagtgtgtaatcatt

SEQ ID NO: 2106 - DNA, 472 bp, Homo sapiens
aaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaaccctgtgttactactcctactcttggagatgataatattctatgtggtcaaatatttggactcatttaggacttagatatttcagtgtacttgattttttaaattaactc

SEQ ID NO: 2107 - DNA, 236 bp, Homo sapiens
ggctcatgcctgcaatcccagcactttgggaggccgaggtgggtggatcacgaggtcaggagatcgagaccatcctggctaacacagtgaaaccacatctctactaaaaaaatacaaaaaaaattagccagacgtggtggcaggtgcctgtagtcccagctactcaggaggctgaggcaggagaatggcatgaaacctgggaggcggactttgcagtgagctgagatcacgccact

SEQ ID NO: 2108 - DNA, 155 bp, Homo sapiens
gccgcctgccatgccccagccagtccccacagcataacagggtctccttggcagctgtatttctgggaggtctgggatgtttgctctctaaagaccttttaataaaatttttgtacaaagacaaaaaaaaaaaaaaaaaaaaaaaaaaaaaaaaa

SEQ ID NO: 2109 - DNA, 106 bp, Homo sapiens
gagctgagcagtaagatgtgtgacttaaccgcaggacagaccgcagagttcaaggagggccttccagctgtttaaccgcaccaggtaattggcaggatcctgtcaa

SEQ ID NO: 2110 - DNA, 145 bp, Homo sapiens
cccaatgatttcttacgtaatgtattggtttccctcttcacttgaacttttgttgaactgtatgtactttaccccaaacccgttaatattttgagcgcttctatgtgaaagcaaagaaataattttgatactctggcatcataaa

SEQ ID NO: 2111 - DNA, 187 bp, Homo sapiens
gtttgaggctttaatgcaaccctttagcccttggttctttttggtgcaagaattctggctgtttacctcagactcagacccctgaaatgttgccaaattcttcaaataactttttggggggtggggggagatgaaagagagtcgcgttttgtttacagttaaagacatacaatatcttaaaaaggag

SEQ ID NO: 2112 - DNA, 175 bp, Homo sapiens
tcatgctgccacacactcctgggtctttttacaccctgcaccctgcctgaacccgtctatcctaccttgctcccatggcaaaccgttctgtgttcttccaggagtatcacctgctctgtgaaggcttccaggcttcctacttttcttacaatgagcttcacacaagtgtactctg

SEQ ID NO: 2113 - DNA, 371 bp, Homo sapiens
tcatgctgccacacactcctgggtctttttacaccctgcaccctgcctgaacccgtctatcctaccttgctcccatggcaaaccgttctgtgtcctcccaggagtatcacctgctctgtgaagcctcccaggctccctactctcctcacaatgagctgcacacaagtgactgtacagacctttagtccatccctctctcacatggactgcaactatttatcagcatacctgccaccctcatttgacaaagagcaacacctcgagagtacttctagagcggccgcgggcccatcgattttccacccgggtggggtaccaggtaagtgtacccaattcgccctatagtgagtcgtattacaattcactggccg

SEQ ID NO: 2114 - DNA, 144 bp, Homo sapiens
cggaggctggggcaggagaatcgcttgaacccgggaggcagaggttgcagttagctgagatcacaccacttcaccccagcctgggcaacagagttagactcgctctcaaaaaaaaaataaataaccggggaggggggattacca

SEQ ID NO: 2115 - DNA, 460 bp, Homo sapiens
ggaccgccgttcagtcgccaatatgcagctctttgtccgcgcccaggagctacacaccttcgaggtgaccggccaggaaacggtcgcccagatcaaggctcatgtagcctcactggagggcattgcccggaagatcaagtcgtgctcctggcaggcgcgcccctgaggatgaggccactctcggacagtgcggggtggaggccctcactaccctcgaagtagcaggccgcatgcttagaggtaaagtccatgttccctggccgtgctgaaaagtgagaggtcagactcctaaggtggcaaacaggagagagaagaagaagacaggtcggctaagcggcgatgcagtacaaccgcgctttgtcaacgttgtgccacctttggcaagagaggggcccaatgccactctaagtcttgtattctggcttctctataaaaagcacttagttcagtcaaaaaaaaa

SEQ ID NO: 2116 - DNA, 365 bp, Homo sapiens
cccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctgggcagccccatccaacgaggaggacgacagcacgatgacgatgtgctggctccttcaggggccaccgcagctggtgctggtgacgatggggacgggcagacgaccggagcacatagcggccgggagcccggctgcacaccaggctctgctttgtcgtctat

SEQ ID NO: 2117 - DNA, 105 bp, Homo sapiens
ctccaggagaggcaggtcgacctgcctgccaggcccgatgggctgccgggcttctggtggaacctgccggcctgccttgggagcttcgggcctatgcctctgccc

SEQ ID NO: 2118 - DNA, 150 bp, Homo sapiens
tgctcggtccttccgaggaagctaaggctgcgttgggggtgaggcctcacttcatccggcgactagcaccgcgtcccggcagcgccaggccttacactcgcccgcgccatggcctctgtctccgagctcggcctgcatctactgggccct

SEQ ID NO: 2119 - DNA, 200 bp, Homo sapiens
gagagaactagtctcttttataaatgatgttgagaaaatatatatccacatgcaaaataataaaatcagaccttcatctcacaccatatataaaattacctcaaattagatacttaatacgagacctgaaaatctaaacctaagatgaggaaatatagatgaatgcctcataccattgtctggcaagtacctcttggttc

SEQ ID NO: 2120 - DNA, 300 bp, Homo sapiens
gggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtgggacatcatcaacgccctgtgcttcagccctaaccgctactcgctgtgtgctgccacaggccccagcatcaagatcttggatttagagggaaagatcattgtagatgaact

SEQ ID NO: 2121 - DNA, 400 bp, Homo sapiens
aaaacatgaggaccctgtttgtcctcatggaatttacagtcacaaaaagttgaacagtcatataaatacaatgcttgttataaaaagaaaggacaggatgcaagagaaatgtaaaccagggtcatccacccattctagaaaaccagatgagatcgccctaaaatagcttttcaactaagacccataggaaggaaagaacttgttaaaccaatgggcaggagaagaggaaagatactttggtgagagggtagatgtcaggatcatctctcagattatgtgaatagaaatgataattttataattctcattctccatgtaaataaccccttgtgtatgattaaagataaaatgaaagcctcaatatattggttttctacttatataactggcacatgtcact

SEQ ID NO: 2122 - DNA, 506 bp, Homo sapiens
aaaacatgaggaccctgtttgtcctcatggaatttacagtcacaaaaagttgaacagtcatataaatacaatgcttgttataaaaagaaaggacaggatgcaagagaaatgtaaaccagggtcatccaacccattctagaaaaccagatgagatcgccctaaaatagcttttcaactaagacccataggaaggaaagaacttgttaaaccaatgggcaggagaagaggaaagatactttggtgagagggtagaatgtcaggaatcatctgtcagattatgtgaatagaaatgataattttataattcttattcttcatgtaaataaccctttgtgtatgattaaagataaaatgaaagcctcaatatattggttttctacttatataactggaacatgtcacttgaacttattttggttattttggcgacgtttttttttctttccatcactccagcctggatgacaagagtgaaactccatctcaaaaaaaaaaaaaaaaaaaaa

SEQ ID NO: 2123 - DNA, 495 bp, Homo sapiens
cggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtgagccggagtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacgagaaaactcctcgtggtgaagggtctaagacgtgggatcgtttccagatgagaatcacaagcgactcattgacttgcacagtcctctgagattgttaagcagattacttccatcagtatgagccaggagttgaggtggagtcaccatccagatgcttaagtcactattttataaattgatgacagttgttaaaaa

SEQ ID NO: 2124 - DNA, 300 bp, Homo sapiens
cattttaaaatgtgatttttcaaaactcagtggaaagagaaataaagggaagaaatagtgaatagagaacaatagtctttaagattaattctaggaatggaaaatcagataacatagtgaactaaacaagacatgtgaagagtaagtagaataaaaggaaaatcagtgcacaaaaattgtcaggactttatcagagacagggtttagattagagagggataacaggctccagattctccacctgtcaagtatatattacattggtagggatactcattagtccatatactttcggttgga

SEQ ID NO: 2125 - DNA, 511 bp, Homo sapiens
ggcattttaaaatgtgatttttcaaaactcagtggaaagagaaataaagggaagaaatagtgaatagagaacaatagtctttaagattaattctaggaatggaaaatcagataacatagtgaactaaacaagacatgtgaagagtaagtagaataaaaagaaaaatcagtgcacaaaaattgtcaggactttatcagagacagggtttagattagagagggataacagggtccagattctccaactgtcaagtataaattacattggtaggatactcattagtccatatacttccggttggacttctctcttttccattccactcatcatgaaaataaatttaggatgtcaaaagttacctatatttaaagaacagacttataacccaagctgtaatatccctatcacatcacagacataaatgcacaagcagaagtatgaaactgggtgggagtaaaagtcattttccacttctctggattgggttcatcactctatcctggctccgttg

SEQ ID NO: 2126 - DNA, 110 bp, Homo sapiens
acggcgggtgcggaggacgtacggactgagtgcggatagctatcagatgacacctccaaagcacgagacttcgtggcagagccatggggagaagccagtgggagcctggt

SEQ ID NO: 2127 - DNA, 259 bp, Homo sapiens
aggtgtggagctcgtgttccagacctttgaggtggaggaggagacccgacttcggctattactacatggagctcttcgacggctacgacagcacaacccccaggctgtggcgctatctgtgtgcgtctagggccttctgaggaggtgttctctggcgcggagagtatctgttccttgtgaagttcactctggatgtacaccatctaccacaaaaggtgttccacctctcgatatacaagcaccacgttgctcacggcga

SEQ ID NO: 2128 - DNA, 157 bp, Homo sapiens
aatcaaagaagccgaggcagttgttgaaaccaaaatggagaacaaacccacctccttcaagaatttcaggaaggtgcaagggaaacaaggaactgtatcaaagagccaggctcgggagtgcctctttgttcttattacaacccttcttggttatttc

SEQ ID NO: 2129 - DNA, 155 bp, Homo sapiens
cgagatgacgaagggaacgtcatcgtttggaaagcgtcgcaataagacgcacacggttgtgcccgccgcttgtggcttctaagggcctaccacccttcagaaggtcgaccctgtgggcaaatgttggctacccctgccaaaggcgcaagaagaaa

SEQ ID NO: 2130 - DNA, 140 bp, Homo sapiens
cgcgggtctgtstcttgcttcaacagtgtttggacgagacacagatccgcgcggacttcttcttccaacctccgaccgcccttccgatttgcctctcccgctttccaacctcccgggaccatcttcttcggccatacttc

SEQ ID NO: 2131 - DNA, 237 bp, Homo sapiens
ctcgtgccgaattcggcacgagccgacatcagtttggtcaagaaaaggatgtgtttgcacccagatttagtaataacatcattaggcacctttccaggaatttatatcgtgtgtccctgtgggatgacacagagtaaaatagttagagtactctaaactctattggcagagagaattaatgtatttaagagtgtagattattcagccccttttggttatagcagccggggttcgcgc

SEQ ID NO: 2132 - DNA, 212 bp, Homo sapiens
ctcacacctgttatcccagcactttggaaggccaagacaagaggatcacttgagcccaggagttcaagactagccttggcaacgcagcaagaccttcaatgtctactaaaaagaacaaaggaaaagtatgagattgccccaaaaatataagacaaacacggcttccattaagagacacagcacgagaaaggcccagggcaaccacatgttgg

SEQ ID NO: 2133 - DNA, 150 bp, Homo sapiens
cggctcctgagagctgcagcggttagcgtgggagctccgcgggaccgcgaggacaggcaggcgccgcttcatcggctgtccgcggcgctgctcgccgtgtgtcgtcaagggtgccgcgggatgtgtgtcagtttacgctcttagatcaca

SEQ ID NO: 2134 - DNA, 458 bp, Homo sapiens
ctcccctcgagaggctggccaagcgggtgtagccgttgggggaggctcccgccgggggaacccggcgaggacaagagcagggcggccgccttccactcgggctgtccggcggcggctgcctccgcccgtgtgtccgtcaagggtgccgcgggatgtgtgtcagtttacgcctctgagatcacacagctgcctgggggccgtgtgatgcccaaggcaagtcttggttttaattattattattatcattattgttacgcttggctttcgggaaatactcgtgatatttgtaggataaaggaaatgacactttgaggaactggagagaacatatatgcgttttgtttttaagaggaaaaccgtgttctcttcccggcttgttccctctttgctgatttcaggagctactctcctcctggtgaggtggaaattccagcaagaatagaggtgaagacaagcca

SEQ ID NO: 2135 - DNA, 210 bp, Homo sapiens
ctataaagaaacggtatgacttaattttagaaagaaaattatattctgtttattatgacaaatgaaagagaaaatatatatttttcatggaaagtttgtagcatttttctaataggtactgccatatttttctgtgtggagtatttttataattttatctgtataagctgtaatatcattttatagaaaatgcattttttggcaattgtt

SEQ ID NO: 2136 - DNA, 235 bp, Homo sapiens
cacacgtacactgaaaatatatacatctatttattaatttaaaaattctaaatggaaagaaaatttcatcctcactttttaaaatttcagtaaagtgatgtcttatattttatctagtgaatgctgtgttcatagataatgcaaaataaaatgtgttttaggctatatcagattttgaatgaatcattactttttgactctcgttaaaaggtttttaaaggatatttggggtata

SEQ ID NO: 2137 - DNA, 200 bp, Homo sapiens
cgcagagccggcgggcggccacgtcgcggcctggctgggataggagagggcggtcccagtccagttgggtgaactacccgttgcacactggagtttctggtgtcttttccttggaactgacctagctcgtggcagggggaactcggctagcggcccacagaccctctgactcaaaacaactcagttgtaagacgttcatc

SEQ ID NO: 2138 - DNA, 125 bp, Homo sapiens
ccgtgccggcccagcgcaccaggttcaaggcattttgttgctatcggggactacaatggccacgtcggtcttgggtgttaagtctccaaggagggtggccacccccatcccgtggggccattcat

SEQ ID NO: 2139 - DNA, 100 bp, Homo sapiens
tgggctggaacttctggcagtctgcccgccttggcctcccataatgctgggtttacaggcgtgagctttccgcctggcagcgtagtggtttttttttttc

SEQ ID NO: 2140 - DNA, 180 bp, Homo sapiens
gccacatccagcctggatgacctgggaccccagaaactgccgttttggaggcagcaacagcaacgtgcccaggcaggcagttattcccacagaggtgagccaaaattgtagcagggcactttaatcagagctgatgatttgaaaccaacggtcacccaacttgtcaaaaatggcacttac

SEQ ID NO: 2141 - DNA, 150 bp, Homo sapiens
ctcgtgccgaattcggcacgaggtcatgctggtggtggtaattcatcttgttccgcctgtgtatgcttacggtcagactctagataacacaatattcgctatgttttaataacctctagttgtactctggggaaaacatgctatagctga

SEQ ID NO: 2142 - DNA, 510 bp, Homo sapiens
ctcgtgccgaattcggcacgaggtcatgctggtggtggtaattcatcttgttccgcctgtgtgatgcttacggtcagactctagataacacaatattgctatgttttaataacctctagttgtactctggggaaaacatgctatagctgaataatatttttaactgttaaattttgtttaagaatacttaatatattttttctccctcgatttttataccaccatgtaagcaacttgacttgtatttcattgtcccaaagaggaatgcacagggtgaaatggattagttggctagaagtcctgggatttttaccccataaagtattcttattaaaagaactgaatttatgggacaaaggaaaggcttttttgagggtggaaacaaagccctggatagaagagacagacgtcatgctgagtctagaaggagtatgcctctgttccttcttcctggtgcacttttcagaagagtttatgataccttgtgcagaaaatatctgataacagaag

SEQ ID NO: 2143 - DNA, 110 bp, Homo sapiens
agaaaaaagaagagaagaaaccaaatgaaacagggttcccataaacaaaggaatgttcttgtgaaaagggaacctgtattacactagagaacccaaaggtaattgggatt

SEQ ID NO: 2144 - DNA, 168 bp, Homo sapiens
gtgaaatggttcgtattcacttgaccggagacccacgaatcatgcaatcagaggtccatctcgtgtcactttaggacacttgtgaacttgctcaggcattcagggattgcatatccgaaggccccgagattctaaggtgtacctttaaagaacggtgtgtaccttccg

SEQ ID NO: 2145 - DNA, 520 bp, Homo sapiens
gtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaagggacagattgttcctaaaccagagaggaggttgcccagaagaaaaagatatccca

SEQ ID NO: 2146 - DNA, 134 bp, Homo sapiens
aagaaggaaaaggaaaatgttgtggtttttcttttctactttccttcagaaacaacatgatttaagggtttgcttgttcctctaaggtaaaatgcaaccattcttggacaatggttggctgtccacagattaag

SEQ ID NO: 2147 - DNA, 560 bp, Homo sapiens
aagaaggaaaaagaaaatgttgtggtttttcttttctactttccttcagaaacaacatgattgaagggtttgcttgtttctcttaagtaaatgacagcattgcttgacatggttggctgatcagcagagtgagacagcagtgacagcttgcatttatgggaagttcagcctgcagaccagaatattttatttccagattgcccgaggaatttctgacgttcaaaatggatgacagtagagattcaccaagggaaatttatcatgtaattcaatatttgtagaacattttttattacaatgatttttgacctaagtatgaaaaaaatactctagtaagatagcatttaaaagaaaaattaaatagatcagctggggcccttggaaaggattagtgaactaaagttaaggttgattttgacacaagaaatagaactctaggaagtttttctttgttttctgcaagaaaataatggttcggttgagaacaagtgcttatgcttggaaattaatcataattgtacttacaggtgcacagccacggagctactatgtaaaccaga

SEQ ID NO: 2148 - DNA, 183 bp, Homo sapiens
gggagttccaggcatcgatggcatcgacggtgaccgaggtctaagggccccccgggccccccgggttccctgcaggttgaaccggggaaagccaaggagctccaggcaagccttggcaacacctggcgttgatggattaccaggacctgatggatcccttggttccattggtcaaaggggaca

SEQ ID NO: 2149 - DNA, 179 bp, Homo sapiens
ccataatgagatgtgagcccttgtgcaatgtggggggaggagggagagagatgtactttttaaatcattgttccccttaaacatggctgtaaccccactgcatgcagaaccttggattgtcaactgcctgacaattcaacttccaggagaggcctatatccaaatgtgtgggaattgac

SEQ ID NO: 2150 - DNA, 115 bp, Homo sapiens
tggcggcttgtgcagcaatggccaagatcaagggctcgagatcttcgcgggaagaagaaggaaggacctgcttgaaacagctggaccgacctaagggttgaagctgtcccagctg

SEQ ID NO: 2151 - DNA, 137 bp, Homo sapiens
aagtgggcaagacttttatcgagtaccgttacagaagacctcacgcctccccatcaattgacatttgcaccattggacataggaggcccgagcaggatttcggtgtgacaatagggccgtcctgcttctgtaaaaac

SEQ ID NO: 2152 - DNA, 111 bp, Homo sapiens
caatttgggattacaggcgtgaaccaccacgcccggctgaccagacctctacttttaaaatgcccaattaattattgaattccagttggttgacacttaaatacttttatc

SEQ ID NO: 2153 - DNA, 140 bp, Homo sapiens
gatgatgagggcgcggcagtatccttggggcactgtgcaggttgaaaacgaggcccacttgcgacttttgtgaaggctgcgggaagatgcttgatcggggtcaacattggaggatcttccgggagcggaacccacacacc

SEQ ID NO: 2154 - DNA, 140 bp, Homo sapiens
tcgtgccgaattcggcacgagggtttggaattggtgacaacatgctggagccaagtgctaacatgccctggtcaagggattggaagccaaccctaaggattgcaattgccattggaaccacgttcttgagctcttggact

SEQ ID NO: 2155 - DNA, 115 bp, Homo sapiens
gaatgaactgcaagattagaactggactgtagaggctagagtggctctgagtgagacagagacactgaccggttcaagagaaagtcaagcttctgttcagcctcggtagaccaat

SEQ ID NO: 2156 - DNA, 450 bp, Homo sapiens
gagatataggattacctggcccaaagggatctgcaggtaatcctggggaacctggcttgagagggcctgagggaagtcgggggcttcctggagtggaaggaccaagaggaccacctggaccccggggtgtgcagggagaacagggtgccaccggcctgcctggtgtccagggccctccgggtagagcaccgacagatcagcacattaagcaggtttgcatgagagtcatacaagaacattttgctgagatggctgccagtcttaagcgtccagactcaggtgccactgggcttcctggaaggcctggccctcctggtccccccggccctcctggagagaatggtttcccaggccagatgggaattcgtggcttccgggcattaaggggccccctggtgctcttggtttgagggggacctaaaggtgacttgggagaaaaagggggagcgt

SEQ ID NO: 2157 - DNA, 228 bp, Homo sapiens
ctttggaaagccccagggcactgtggccagggttcacattggccaagttatcatgtccatccgccaccaagctgcagaacaaggagcatgtgattgaggccctccgcagggccaagttcaagtttcctttgccgccagaagagtccacaatctcaaaagaagttgggctttaccaagttcaatgctgatgaatttgtagacatggtgtctgtaaagcggctaatccca

SEQ ID NO: 2158 - DNA, 125 bp, Homo sapiens
ctttataacatggagttgagttgtttctataagactattattcaaatgtaatactacttggagaaaggagagccagatttttgatttgacaaatttcaatccccccacccccccacttcttgggg

SEQ ID NO: 2159 - DNA, 114 bp, Homo sapiens
gagcttttgtcattcaattcacagcgcggcaggctcttgggtgagcacatcctgtccactgtcttcattttgtggggcaccaccctcccctgccaagggtggggtttttttttt

SEQ ID NO: 2160 - DNA, 113 bp, Homo sapiens
cggcacgagagtacttctagagcggccgcgggcccatcgattttacacccgggttgggtaccacagtaagtgtacccattcgccctatatgttagttgtatatacacacacac

SEQ ID NO: 2161 - DNA, 117 bp, Homo sapiens
actgaattcacatatgtatgtttttttttactatttaaaatacccaacatgtattatgaaatacctcaaaagtaatttagttacaattcttaaacaatgacaattgtcggaagacag

SEQ ID NO: 2162 - DNA, 201 bp, Homo sapiens
taaacaagatttgctgcatttccggcaatgccctgtgcatgccatggtccctagacacctcagttcattgtggtccttgtggcttctctctctagcagcacctcctgtcccttgaccttaactcttatgggtcttcacctcctgccaaccaccccaacccaagttcctttagagggtataatatcacattggacgcagaga

SEQ ID NO: 2163 - DNA, 137 bp, Homo sapiens
ccaggatgctccccgcgtacgtgtagatcttttgttgcaggaagcggtgcttgaggttcttcaggaggttgccctcggttagctcggggaggttacacaggtcatcaaagtccccctttcttcccttgcaagaggcc

SEQ ID NO: 2164 - DNA, 149 bp, Homo sapiens
ggacgaagcagctggcaacctcaagaaggccctgctcatccagggctccaatgacgtggagatccgggcagagggcaatagcaggttcacgtacacttcccttaaggatggcttcacggaacataacccgtaagttgggcaagactttt

SEQ ID NO: 2165 - DNA, 129 bp, Homo sapiens
agctgccgcaagacagcaattacagtcaccttccgaccatatttcctcataatgaagatccacacggccatcctcatcccctgtttccaaaagggggggggcaccttttctgataggcgtgcaaagatt

SEQ ID NO: 2166 - DNA, 260 bp, Homo sapiens
agctgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgaggtagttcatgaaaatgctgtgcactcattccatggaataaatgttggaaagctgaaaaaaaaaaaaaaaaa

SEQ ID NO: 2167 - DNA, 242 bp, Homo sapiens
ataacctttctagaatgcctaggagcagaaaacaataatagcatgctaaatcacaaatgatgctatgtatgggtatgtaaatatcagtgctgtctgcatttctgggtttattgaagacctcttgttgtatatatcctcaaaaaataaatgtaattgacatcttcaagaatgtttctattgtcttccattcataatcagagatgtaatttgtatggactaaataaaaactttattatgtaaaa

SEQ ID NO: 2168 - DNA, 117 bp, Homo sapiens
cggaggtcctttttccttgcctaacgcagccattgctcgttgtccaagaagcattttaagcgggtttgcagcttcaaagcatttgattgcttggtaaattttacccggttttttttt

SEQ ID NO: 2169 - DNA, 209 bp, Homo sapiens
tcttaatcagtggtggaagaaccggtctcagaactgtttgtttcaattggccatttaagtttagtagtaaaagaccttgttaatgataacaatgcatcgtaaaaccttcagaagggaaaggagaatttttttttgggccccttttggttttctttttttgcgtgtgggcaattttaagttattagtttttaaaaatcagtactttttta

SEQ ID NO: 2170 - DNA, 114 bp, Homo sapiens
tcgtcccgcaataggagttgaagagattaacctgactttgttttggctgtttttttagttctgtatgtattttagcaatctgaatttcacctaactgagatgtgttcaaatata

SEQ ID NO: 2171 - DNA, 200 bp, Homo sapiens
ggacttggctcccccatcctcagaactcacaagccattgctccccagctggggaacctcaacctccccccctgcctcggttggtgacagaagggggtgggacaggggcgggggggttcccctgttacataaccctgccataaccaaccccaggtattaattctcgctgggtttgtttttattttaaattttttgttttga

SEQ ID NO: 2172 - DNA, 165 bp, Homo sapiens
tggcagcgcagaaggaccagcagaaagatgccgaggcggaagggctgagcggcacgaccctgcttgccgaagctgattccctcccgtggcaggcccgggagttgcttggagcggcgccgcgcgacccattccggcccttggagcaaccttcgttggccaacagcg

SEQ ID NO: 2173 - DNA, 150 bp, Homo sapiens
ctttcctttcaccctagcctgactggaagcagaaaatgaccaaatcagtattttttttaatgaaatattattgctggaggcgtcccaggcaagcctggctgtagtagcgagtgatctggcggggggcgtctcaacaccctccccaggggg

SEQ ID NO: 2174 - DNA, 147 bp, Homo sapiens
gtgaacctcacaggcaggctaaacaagtgtgggggtgatcagccccagatttgacgtgcaactcaaagacctggaaaaatggcagaataatcttccttccatcccgccagtttgggtttcattgtacttacaacctcagctgggcat

SEQ ID NO: 2175 - DNA, 169 bp, Homo sapiens
gccaccggcaagcccccccagtacatcgcggtgcacgtggtcccggaccagctcatggccttcggcggctccagcgagccgtgcgcgttctgcagcctgcacagcatcggcaagatcggcggccgcaggaacccttcctacagcaagcttcttttgcggccttcttggc

SEQ ID NO: 2176 - DNA, 130 bp, Homo sapiens
tgatagctggttgtccaagatagaatcttagttcaactttaaatttgcccacagaaccctctaaattcccttgtaaatttaactgttaggtccaaagagggacagcctcttttggacactaggaaaaaac

SEQ ID NO: 2177 - DNA, 150 bp, Homo sapiens
gttgtcaccacctgaacaccaaggcattgtattttcatgcccagttaacttatttacaatatttaaggtctcctgcttctgcattgggtggtttcctgaaggccagccctgttaatacaaggtggctttcattggtgtctctctggcaga

SEQ ID NO: 2178 - DNA, 160 bp, Homo sapiens
ccaatctatcaccctatagaagaactaatgttagtataagtaacatgaaaacattcttctccgcattaagcctgcgtcagattaaaaccactgaaccttacaaatttacacagcccaatattctatcacatcacccaacaagggtcattattaaccctca

SEQ ID NO: 2179 - DNA, 160 bp, Homo sapiens
agaatgtttttgtggaccactttgggttttcttttttgccgtgtcgcagtttaagtattaggtttttaaaatcaagtacttttttattggaacaacctgaaccaaaattttgtcacacgattttgagagcccattaaaaggttaataggaaaaaaaaaaa

SEQ ID NO: 2180 - DNA, 160 bp, Homo sapiens
gtggatcaaagattcggcacgagctcgtgcgaattcggcacgagcctggaaccgtctgaggttatcaataagctcctagtccagacgccatggtcaatttcacaagaggaggacaaggctactattcacaaggcttgtgggcaaggtgtgatgtgtggag

SEQ ID NO: 2181 - DNA, 150 bp, Homo sapiens
cggcacgagctgattcttccctaacacgggttctctattcaaccctaaatacattgaaattgtacctttcaaattttgcaggatcaccattacttcagtcaaggtaggccttaagaagtaagagaaaaggagatccgtgggtcctaaccc

SEQ ID NO: 2182 - DNA, 537 bp, Homo sapiens
cggcacgagctgattcttccctaacacgggttctctattcaaccctaaatacattgaaattgtactttcaaattttgcagaatcaccattactcagtcagataggcttaagaagtaagaaaaaggaatcggtggtcctaaccagccttcaagagggactccagtgattctcacttctggatattcacattcttctatgggcccctctcatatcaaataagataacctgtgtagctgagattaggccatagaagacactgggctatctgccttgcacttagattattctctctggaggaagccagtgatcatgtcatgaggacacaaaagcagccctatgaagtctacttagtgaagaactgaggcctcctgccaacaaccagcaccaacttgctatccaaatgctggcaccatcttagaagagggtgctccagcttcagtcaaccttcaggtgactgtgccttcagccagcactctaaccacaacctcacaaaagactctgagcctgaaccatccagctaagacactcctgaattcc

SEQ ID NO: 2183 - DNA, 210 bp, Homo sapiens
ctgacttcctagtaactgttgcagtttacaacctgccctccagggacacgtcttcatggttttcctacaaatgaattccaagaaattgcttattagcaccataatttaaggttgcgtattcaagtaggtagatttagtcattaaccaacccggtctttgtgtaatgtgtaaggcctcccttcagagtatagtccctattttatatatgtc

SEQ ID NO: 2184 - DNA, 140 bp, Homo sapiens
gacttccagtttgaatgcaaagtgtgtggtccaaagttgaattcttttgaacccaagtacatgcctgcgggttggagggacaatttaaaggttgaggcaaggttcggaggagaagtgttaactgaacttacagagagttg

SEQ ID NO: 2185 - DNA, 155 bp, Homo sapiens
ggcacgagcttagaagtaaggaatacttctacttgcattcaaaagaaatataatgtgagccacaaatgttgagttgcatgtattgattttaaatcaagtagcacatgaaaaaggtaaaaataatccagtgaccattaattttaataatataggtt

SEQ ID NO: 2186 - DNA, 470 bp, Homo sapiens
cggcacgagcttagaagtaaggaatactgctacttgcattcaaaagaaatataatgtgagccacaaatgtgagttgcatgtatgattttaaatcaagtagccacatgaaaaaggtaaaaataatcaagtgacattaattttaataatatagtttacttaacccactgtgtgcaaaagatcatttcatcatgtaatagacacaaaaattattaatgaactattttacattttttcatatcaagtctttaaaatccaggtgtgtttgatccttagttcatctccatttggcctcatcacatttcagctctcaataggcacctgtggctggaggctaccatggtgcacggtgcagctctactgatggaaatgggggttagagacactgaggtctctttctgcttttaatttccatgaaaacccaagtccaaggaagggatcttattatcatcatcatcatgatcatcaccaat

SEQ ID NO: 2187 - DNA, 295 bp, Homo sapiens
ggaaaagctgggaaccttggtggaggggtggtgaccatcgaaaggagcaagagcaagatcaccgtgacatccgaggtgcctttctccaaaaggtatttgaaatatctcaccaaaaatatttgaagaaggataatctacgtgactggttgcgcgtagttgctaacagcaaagagagttacgattacgttacttcagattaaccaggacgaggaggaggaggagacgaggattaaatttcatttatctcgaaaattttgtatgagttcttgaataaaccttgggaccaaaaaaaaaa

SEQ ID NO: 2188 - DNA, 210 bp, Homo sapiens
ctcgtgccgaattcggcacgagcccgcccctcggccgatccgctccctggcgtgactcggcactgagagtcccgggagaagactcgaacggtcgccacctcttctgtcgcaggcctcggcctttctgagtatcctcgtgccgaattcggcacgagagcagctccagccctcaccagccatctgctcagaccctgacaccctgagccccag

SEQ ID NO: 2189 - DNA, 415 bp, Homo sapiens
caccgccgaggaaaaccgtgtactattagccatggtcaaccccaccgtgttcttcgacattgccgtcgacggcgagcccttggccgcgtctcctttgagctgtttgcagacaaggtcccaaagacagcagaaaattttcgtgctctgagcactggagagaaaggatttggttataagggttctgctttcacagagattattccagggtttatgtgtcagggtggtgacttcacacgccataatggcactcgtggcacgtgcatctatggggagagatttgaggatgagagcttcatcctaaagcatacgggtgctggcatcttgtccatggcaaatgctggacccacacaaatggttccagtttttcatctcactgccaagacttagtggttggatggcagcatgtggtgtttgc

SEQ ID NO: 2190 - DNA, 170 bp, Homo sapiens
gttattttttcacatcaatttgcttacctctactctgaatctgtgactcactcagatatgtattcccgcaagaatgctgggttctccaaaatggaaactcttgattttcaatataaatagagctatctcctttagggttcattatattgttctcattttcaggaaaaaaa

SEQ ID NO: 2191 - DNA, 170 bp, Homo sapiens
ggtcgacactagtggatccaaagaattcggcacgaggaaaacccaggcagccagcgttggaggctgttaagatgctggatgagatcctcctgcagctgagcgcctcagtgcccgtggacgtgatgccaggcgagtttgtatccaccaattacacgttccccaagcaagcc

SEQ ID NO: 2192 - DNA, 160 bp, Homo sapiens
ctcgtgccgaattcggcacgaggaaaagtcccaatgtacgtccctggtgtaagaaagacaaatcactaggctagtcccgtgtcattctaaatttagccaaggatggccaacctctttcaggaataggaagggggacccgctacagccctaaacaaactta

SEQ ID NO: 2193 - DNA, 200 bp, Homo sapiens
ggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggataattttatagaaaaataaagcttctgtgtctaaggcaaaaaaaaaaa

SEQ ID NO: 2194 - DNA, 370 bp, Homo sapiens
agaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccactctctcaccctatagagagctaatgttagtataagtaacatgaaaacattctcctccgcataagcctgcgtcagattaaaacactgactgacaattaacagcccactatctacaatcaaccaccag

SEQ ID NO: 2195 - DNA, 160 bp, Homo sapiens
ccgtctctattctdcagccatgtctctagtgatccctgaaaagttccagcatattttgcgagtactcaacaccaacatcgatgggcggcggaaaatagcctttgccatcactgccattaaggatgtgggccgaagatatgctcatcgtggagttgaggta

SEQ ID NO: 2196 - DNA, 250 bp, Homo sapiens
aaaacatccctgagttcaccaccttggccagaagttgttctgccagacccagttgaggagaccagacaccatgcagaggtcgtgaagaaggtgaatgagatgatcgtcacggggcagtatggcaggctctttgccgtggtgcactttgccagccgccagtggaaggtgacctctgaagagctgatcttaattggagatgaactagagccttgcgtgtgagagagaattcgactcgagaagggtgctcctg

SEQ ID NO: 2197 - DNA, 240 bp, Homo sapiens
gaagaacggtctcagaactgtttgtttcaattggccatttaagtttagtagtaaaagactggttaatgataacaattgcatcgttaaaacctttcagaaggaaaggagaattgtttgttggaccacttttggttttctttttttgcgtgttggcagttttaagttattagtttttaaaatcagtactttttcattgaaacaactttaccacaaatttttcacagaatttttagacccatt

SEQ ID NO: 2198 - DNA, 340 bp, Homo sapiens
actagtggatccaaagaattcggcacgagctaaagcttaatgtcactaagtttcatgtctgtacagmttatttaaatcatggaaatgaaaaaaatgttctctgcttgctaccaaaggacaaactcttggaaatgaacactttctgctttccttcctccaaagaattaataggcaacagtgggagaaaaaaaaggcataatggcaaatccttcaagcagggataaaagtcgatcttcaaacattaacttaagcagaccacaaattctgatgaccgcatctagagtatttttttataaaaatgattttcactatagctatgttacgctaagctactctccaa

SEQ ID NO: 2199 - DNA, 305 bp, Homo sapiens
gcttgatggggatggcattgaatctgtaaattaccttgggcagtatggccattttgacgatattgattcttcctacccatgagcatggaatgttcttccatttgtgtgtgtcctcttatttccttgagcagtggtttgtagttctccttgaagaggtccttcacatcccttgtaagttggattcctaggtatttgatcatctttgaagcaattatgaataggagtcactcataatttcgctctctatttgtctattaatgagagtataagaatactttgattatgtacaatagaatttgtatcct

SEQ ID NO: 2200 - DNA, 265 bp, Homo sapiens
ttttaaagtataaagtaatattttagcatgtaaacttaaaagtgagaattacaacagaatcaggaagtcttagagtttcaggagggaaaaactttttttcctcaaaatgcagtagattgtataattattattctaattatgacagtcatatgtttgatcataaaaccttcagccagttcagcaaagtgagaattgcctgtagcttaacactcaactattaacattttgatgtatagtattattattttcatagagattgatatga

SEQ ID NO: 2201 - DNA, 220 bp, Homo sapiens
aggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggcaaaaaaaaaaaaaaaaaaaaaaaaaaaaa

SEQ ID NO: 2202 - DNA, 160 bp, Homo sapiens
cagaagtgacccccagaaagggagggccaccgctttgcccctgcttttacccttccttcttggtgctctacacctcaggttaccaggcttgaggcatcttcagccaagcttgtttcctgctcttgaggcttgttgggttggagccagagttgaaggtcgg

SEQ ID NO: 2203 - DNA, 150 bp, Homo sapiens
gtttcaagaaagtttacctttgctttaggtcataagttccttatttgattgccgtatatggatacatgggctgttcgtgacattctttatgtgcaaatttgtgatttccaaaatgttcctgccagtttaagggtacacatgtaggagccc

SEQ ID NO: 2204 - DNA, 215 bp, Homo sapiens
ctgctgccctcaaggtcgtgcgtctgaagcctacaagaaagtttgcctatctggggcgcctggctcacgaggtggctggaagtaccaggcagtgacaaccaccctggaggagaagagggaagagaaagccaaggttccctaacggaggaggaacaactcaagaagttaaggaacagccgagagaggacctgtgagagaggaatttacacatacac

SEQ ID NO: 2205 - DNA, 110 bp, Homo sapiens
agtatgataggagtataaggatgtgttctccactgaacattttagaacctgaattcaagaaatacttgatgggtatctattcacctcactcctccaaaaaaaaaaaaaaa

SEQ ID NO: 2206 - DNA, 112 bp, Homo sapiens
agtatgataggagtataaggatgtgttctccactgaacattttagaacctgaattcaagaaatacttgatgggtatctattcacctcactcctccaaaaaaaaaaaaaaaaa

SEQ ID NO: 2207 - DNA, 130 bp, Homo sapiens
caccatctcgccaggccaggaattacaagcctcgggaggataggcagcgtcgtcagcagcggcactcaagccaaacagaagagaaggcggcggttcaggcaagaagccttgagggagaaaggaaagaagg

SEQ ID NO: 2208 - DNA, 106 bp, Homo sapiens
gttccttaactctaatgcactgtcaggtctgtgttcgaagagttagcctcacgtaattgaatattattcacataacacttcaataagacaaatgctgtcaaaaagg

SEQ ID NO: 2209 - DNA, 300 bp, Homo sapiens
gttctttaactcaaatgcactgtcaggtctctttgttcaaagagtttagccctcaccgtaatgaatatatcacataacactccaataagcacaaagccctccaaaaaagaatctgattttcaaaggaaatcctctcctgctggagcactgtgtgagtgaggaagagtgagaaagctgatgagcattctagggggatgcagagcagtgtacaactttaacaaaaaggaaagggcagctctgagtccttcagaacatgaagttcatgcagatttgcagggaaacatttgtctaaaacaagaa

SEQ ID NO: 2210 - DNA, 186 bp, Homo sapiens
gcccggcaggaccttacaagggatgagccagccaaggcagcgagaggcagcagagttacaggagcggcagaagttgaggtctctcttccaagtcttgggaggcttaagggaagagagtgtccccttgcgcgctgctcttggtctctccgtgtcctctctctcacagggctctgggcctctccgaga

SEQ ID NO: 2211 - DNA, 480 bp, Homo sapiens
gcccggcaggacctacaagggatgagccagccaaggcgggggaggcagcagagttgcaggacgcagaggtggagtcttctgccaagtctgggaagccttaaggaaaggagtgcccgtcggcgtcttggtcctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggctgcagaagcctcctggcctggctgtgtcttccccacccagctctcccctgcgcccctgtctttgtaaattgacccttctggagtggggggcggcgggcaagggctgcttttcttaatctgataccaaagcaagggcttttctgaataaattcatttgactttgaaaaaaaaaaaaaaaaaaaaaaaaaaaa

SEQ ID NO: 2212 - DNA, 146 bp, Homo sapiens
agcagcctggtatgatgtgtcatcaggaagttatgacagagcacttcgcttctctcggatcaaatgattgaggaggatgttcctattgacacatatattcctttattcaaacaatttattatatggtgttcgcgtcacgagaaagg

SEQ ID NO: 2213 - DNA, 137 bp, Homo sapiens
cgagaggtgcaggtcctggtgcttgatggtcgaggccatcttctcggccgtctgcgcgcattccgtggctaaacagagtacttcttggcccgaaggttggttgtcgtaccggtgttaaggcattcacaccattcttg

SEQ ID NO: 2214 - DNA, 161 bp, Homo sapiens
ctggggttggcaggggttgaggggtgagcaggtttcatattcaaggagttcttgctagtcttaggggttggggagcccttttagccctttaaataaagtttaacgaggtgaacaattggcttgctctgttccttaaggatgtctgtttattgggctgtaaa

SEQ ID NO: 2215 - DNA, 380 bp, Homo sapiens
ctggggttggcaggggttgaggggtgagcaggtttcatattcaaggagttctggctagtcttaggggtgggggagccctgttagccctgtaaataaagtttaacgaggtgaacaatggctggctctgtccctgaggatgctgtttatggggctgtaaatcacagtcagccctggactttggtctagtccctggtagaaggaggcaggagggtggggtggcagaggcccagggcttctgcattatcagtccagagctggggctctccaggcagtgggaaagacaggagcaaacaagagggcagcagctgaggagctcactgattgtgagttttcagagcttctgaggctctctctgtagaatgagatctcagattttccct

SEQ ID NO: 2216 - DNA, 175 bp, Homo sapiens
aacaaatgattgtaaccctacacactattcaataagtagtagaaggagcatcacacagatttcaggtctaatctgcccttcttgttggccataatataaacataaatgttgtgttattataaaaaggcattttcctcaaagaggctatcagcttggttcacatatgtgtagagag

SEQ ID NO: 2217 - DNA, 147 bp, Homo sapiens
actgtcctcaagagggaccaggaaggactaggctacagatcagcacccagcccgagtgacacattttccagctttggatacccgagctgttgcttggagggagagaaccccttcggttggcacacttagcttgagggaggagagaaa

SEQ ID NO: 2218 - DNA, 150 bp, Homo sapiens
cggcacgagcccttagctgctaagcctgccttgcccaggggtgggatggcacttaaggccagcagacaggcctaggcttgggcagggtcacggcttgcctttaaccttctctaaggccccatctcttgggtgttttggggtcaaggagca

SEQ ID NO: 2219 - DNA, 155 bp, Homo sapiens
ggactctgggtcagaggaagatgggaaagaaaggacagattttcaggaagaaaatcacatttttacctttaaacagactttaggaaacttacagggcttcaaattttcagtcttatgacttggacacatagacttaatgtagagcaaaggaaaag

SEQ ID NO: 2220 - DNA, 151 bp, Homo sapiens
acccaccttcatcactatggcattatatttagggagtagttcttggctggatttctggttgtggaagtgggcgccagaatagtgtgtctctatttaaggagcaggaagggcgttaggcaagaggagagacttgtggagggaagagcttctc

SEQ ID NO: 2221 - DNA, 170 bp, Homo sapiens
tgtagaactcagccttcttgggaaagaaaaaaaagaggctccgggttgacaaatgggtgggttaacagaaagggaacttgctacctgtgcggactatttttagggcatttacagaaacatggatcaaggggattaacaactcgggcttccctttaacaaggatggagggt

SEQ ID NO: 2222 - DNA, 266 bp, Homo sapiens
ctcgtgccgaattcggcacgaggttcgggacaagctcaataacttagtcttgtttgacaaagctacctatgataaactctgtaaggaagtcccaactataaacttatacacccagctgtggtctctgagagactggaagagttcgaggctccctcgccagggcagcccttcaggagctccttagtaaaggacttatcagactcgtttcaaagcacagagctcacgtaatatacaccagacataccacgggtggagatgctccacct

SEQ ID NO: 2223 - DNA, 108 bp, Homo sapiens
cggcacgggctccctcagcagggacggagggaggggctgctggcggccagggactgcactgttgtaagggggaagccttgcttgttgtggcctggagacaagtgccct

SEQ ID NO: 2224 - DNA, 120 bp, Homo sapiens
accatgggaggtggggcctcaatctaaggccttgcctgtcagaaggggttgtggcaaaagccacattgcgaggctgccatcccctgccccgtttggagtggacccggtggcgcagtgcgt

SEQ ID NO: 2225 - DNA, 117 bp, Homo sapiens
ccgaggtagagtctagagtagtcatgaccagaaggtcgttcagtgacgagttcgcaattgaagacgaggtttggcttgatcggtatacaaggcttaccacgttaggaaggaacctca

SEQ ID NO: 2226 - DNA, 359 bp, Homo sapiens
cggaggtagagtgtagagtagtgatgaccagaaggtgttagtgaagagtggcaatgaagagaggttggttgatgtatacaagcatacagttagaagaaactaattctagtgttcaatagcaaagtagggtgacgacagttaacaatgatttgttgtatattctaaaataactagaagaaaagatctgaaatgtttcaaacacaaagatatgataaatatgttaggtgatggctatcctaattactctgatttgatcattatatattgttttcgtggatcaaaataccacatggagcccataaatatgtaaaattattgggtattcataaaaataaatgatagggattggggataggagg

SEQ ID NO: 2227 - DNA, 129 bp, Homo sapiens
gtgttgttggccctagctattggcctaaattgggctctagggtctctgtccctgggcgcttgaaggttcaagaaggagctcttgtcccgccccttcagtattaaccctgtcttcctcttaaggggtagg

SEQ ID NO: 2228 - DNA, 539 bp, Homo sapiens
ctcgtgccgaattcggcacgaggtgttgtggccctagctatgggcctaaattgggctctaggtctctgtccctggcgcttgaggctcagaagagcctctgtccagcccctcagtattaccatgtctccctctcaggggtagcagagacagggttgcttataggaagctggcaccactcagctcttcctgctactccagtttcctcagcctctgcaaggcactcagggtgggggacagcaggatcaagacaacccgttggagcccctgtgttccagaggacctgatgccaaggggtaatgggcccagcagtgcctctggagcccaggccccaacacagccccatggcctctgccagatggctttgaaaaaggtgatccaagcaaggccctttatctgtacatagtgactgagtggggggtgctggcaatgtggcagctgctctgggctgagcacagcttgacccctctagccctgtaaatactgggtcaatgaatgataaaactctcctaagaatctcctgagaaaaaaaaaaaaaaaaa

SEQ ID NO: 2229 - DNA, 181 bp, Homo sapiens
gtggacggaaaggaacggacactgttagtacacaggaagggatccacccgcgctttccctcctcaccatcccctcattgctgttgattaccaactcactggacaaccagtatctcattgggtggcaacattgggaacctgtaggtatgttcttacttggcacttaaacaaggcatgactta

SEQ ID NO: 2230 - DNA, 121 bp, Homo sapiens
tcccatgctctctcttctctgctttcttctcacttcgagtccatgtgcagtgcttgatagaatcaccccacctggaggggcttgctcctgccctccggagctattggtgagccgtccctca

SEQ ID NO: 2231 - DNA, 206 bp, Homo sapiens
gtcagatcggcaacacggggcccaagggaaaacgttggagagaagggtgattccaggaggaagtgggaccgggggccacccggggatgcctgggcccccagggattcccaggaactccttggccggccctggcaaggcaattaaacgcaaaggatgggagatcgagagggtcccaaagggcttccagagagaggagtgtcgactct

SEQ ID NO: 2232 - DNA, 135 bp, Homo sapiens
agaagaggctgcagaatatgctaaacttttggccaagagatgaaggaggctaaggagaagcgccaggcaccaaattgccggaagagaacgcagcctttcctcctctgcgagagcttctacacttcctaagtctga

SEQ ID NO: 2233 - DNA, 190 bp, Homo sapiens
gcttaatcttcctttgcctcagtcttcctatctatcaaatggtaacaatatccttcttcataggggtttcctggagattaaatgagttaatttatttatagtattaaaaatagcaccctcacataggtaaccatcagtaagcattaactgttaattattcacaacctttagataggtatatataatataa

SEQ ID NO: 2234 - DNA, 420 bp, Homo sapiens
gcttaatcttcctttgcctcagtcttcctatctatcaaatggtaacaatatccttcttcatagggttttcctggagattaaatgagttaatttatttatagtattaaaaatagcacccatcacatagtaaacactcagtaagcattagctgttatttaattcaacaaactttaagatagatatataaaataaaaatgatatgaaatctaaccttttgagagtttaatttgggaagacagataatacaaaaatacttgagaacaattttaagacagattttaaggaattgcatggtggggtagtaaactatgaggccctttttttgcctctgcgttattatttacttgttaagatgacgtgaactctgagttgggcactgatctccaccggttgtatatcagggccagcttatgatagcac

SEQ ID NO: 2235 - DNA, 120 bp, Homo sapiens
tccaaactctatccacccctaacgttaggatgagtgtgagacttactacgattagagcccaatccaagggcttgcaacctagggactggcgatgaaaggctttccttgcaacaaagagac

SEQ ID NO: 2236 - DNA, 140 bp, Homo sapiens
cggcacgagcccaaacccactccaccctactaccagacaaccttagccaaaccatttacccaaataaagtataggcgatagaaattgaaacctggcgcaatagataattagtaccgcaaggaaaagatgagaaaattatt

SEQ ID NO: 2237 - DNA, 200 bp, Homo sapiens
gatcaacgcctcactgaaacatggctgtgtttgcagcctgctctagtgggacagcccagagcctggctgcccatcatgtggccccacccaattcaagggaaggaaggaggaatgcttggactctgaggccccttgagaccagatgtgcaagagggttacaacttccttttccgtgtgttactctgttccagcgttccctt

SEQ ID NO: 2238 - DNA, 120 bp, Homo sapiens
aagatcttgcccctctcctttaggtgggtctgcaaagcacaggcatttaccctcaggcctaggggccatcctggaggaggcctcctgaacacgacttagccggccactgtgtaaggacct

SEQ ID NO: 2239 - DNA, 310 bp, Homo sapiens
aagtacttcgcctcctcctttgagtggtgtcgcaaagcacaggtcattgacctgcaggctgagggctactgggaggagctgctggacacgactcagccggccatcgtggtgaaggactggtactcgggccgcagcgacgctggttgcctctacgagctcaccgttaagctactgtccgagcacgagaacgtgctggctgagttcagcagcgggcaggtggcagtgccccaagacagtgacggcgggggctggatggagatctcccacaacttcaacgactacggggccggcgtccgcttcgtccgcttcg

SEQ ID NO: 2240 - DNA, 448 bp, Homo sapiens
gctccaatgacgtggagatccgggcagagggcaatagcaggttcacgtacactgtcctgaaggattggctgcacgaaacatacccggtaagtggggcaagacttttatcgagtaccggtcacagaggacctcacgcctccccatcattgacattgcaccatggacataggagggccgagcaggattcggtgtggacatagggccggtctgcttcttgtaaaaacctgaacccagaaacacacaatccgttgcaaaccaaaggacccaagtactttccatctcagtcactctaggactctgcactgaatggctgacctgacctgatgtcattcatcccacctctaacagttcggactttctccctctctttctaagagacctgaactgggcagactgcaaaataaatctcggtgttctatttatttattgtctcccgtaagacctcggg

SEQ ID NO: 2241 - DNA, 349 bp, Homo sapiens
gaaattctaacccaagacatgacattcttagctgtaacttaactattaaggcttttacacacgcatttaatagttccattttttctcttgccatttgtaggctttgcccatttgttcttatttggcacatggggtagacacggatctgctgggctctgccttaaacacacattgcagcttcaacttttctcttaagtgttctgtttgaacctaatacttaccgagtcagactgtgtgttcatatcatttcagggtctcgctgcctgtggcttcccaggtcgcctcgaggtgggcaaagggagtacagacacacgttgttgtcaaggatggtttgggactagagctcagt

SEQ ID NO: 2242 - DNA, 398 bp, Homo sapiens
gctatgaaaagactgtcattgaaatcaatacaccaaaaattgatcaagtacctattgttgatgtcatgatcaatgacctttgggtgatcagaaatccgaggttcggatttgaggttggtcctgtttgttttcttggctaagattaggacaaggatcatatcaaatcaacaggaaaatataccttggtgccaccaacctattttgtgccacatgcaagttttgaatagggatggtatagaaaccaccgctgcatatacaggtccatttgggaaatccgcatgcctttgtgggggcagatcacatggcaaagctttgaaaatcataagatatagttggtgtgctagatggaacaggctgattcttgattcccatttctcaccttcttttctatttgaatt

SEQ ID NO: 2243 - DNA, 430 bp, Homo sapiens
gcccgccagaagaatatgaaaaagcagagcgactcggttaaggggaagcgccgagatgacgggctttctgctgccgcccgcaagcagaggggactcgggagatcatgcagcagaagcagaaaaaggcaaacgagaagaaggaggcacccaagtagctttgtggcttcgtgtccaaccctcttgcccttcgcctgtgtgcctagagcagtccaccacgctcgcgtttcctcctctagtgctcacaggtccagcaccgatggcattccctttgccctaagtcttcagcgggtcccttttgtgcttccttccctcaggtagctctctcccctgggccactcccgggggtaagggggttacccttccagtgttttttattcctgtggggatcacccaaagtattaaaagtagctttgtattcaaaaaaaaaaaa

SEQ ID NO: 2244 - DNA, 316 bp, Homo sapiens
ggagccgggagctatccctgcgtccctcccgcagcggggccaacagctcgaggaggaaggcccaatggaggaggaggagggcccagccaattgcggcgccagaaggggaaaccggagcctttctaaccgggccaacgcttggggagcagccaaggcaagttgcgggcgcagacttcgagagccaggacgagggccatggaattttatgacttggaggacgactaccactattcccaagaggagcagctcaattgtgtccgcctacagagtatcacccgctctctaagaggccacacgatttttctcagacacgaga

SEQ ID NO: 2245 - DNA, 274 bp, Homo sapiens
tatgtatcggatttcttcaaagaaagaacttcttttaaagaaagaaaagaggaggactctcatacaacctctgcatgaaacaccaacaactgggattcactatccgaggcattcaccagccttgaaaggcagcagggtgcccaggtgaagctggcctgtttcctaaaggaaaatgattcccacaggccaaggaggtatgcatctctctccctggatgtacaagcctttaaagacttctgctgctgatatgcctctgggatgcacactttgtgtg

SEQ ID NO: 2246 - DNA, 230 bp, Homo sapiens
tccaggttcccctggccctggcatcgacatgtccgcctttgctggcttaggccgagagagaagggccccgacccccttgcagtacatgcgggccgaccaggcagccggtggcctgagacagcatgacgccgaggtggatgccacattcaaggccctcaccacccagattgagagcatcccaagccccgagggttcccgcaagaaccctgctctgaacttgcagtcctgaa

SEQ ID NO: 2247 - DNA, 345 bp, Homo sapiens
gtagaaacgttgggttatggaagactagtttcttccataaccctgaattggagaccttaatgctaagtgtagattattgaggtttgttagtgaggaaaagaataagagttcagaagcctttgttatcagatagcgaaagtcagggcctagtgtaggagcacaggtcgactacataatggagtccattggcgaaccctattgcaatttggtgcaactatatcttctggtgaaggaaattaatgatgtaagaaaatgcaagaggctcaacttctctttcaaaaatcttctggcttctgaactcttctctgcctctctctaaataaataacacagaatttcaagtggt

SEQ ID NO: 2248 - DNA, 458 bp, Homo sapiens
ctaaggactcacccaagctgggtctgctcatggtgcttcttagcatcatcttcatgaatggaaatcggtccagtgaggctgtcatctgggaggtgctgcgcaagttggggctgcgcctgggatacatcattcactctttggggacgtgaagaagctcatcactgatgagtttgtgaagcagaagtacctcgactatgccagagtccccaatagcaatccccctgaaatatgagttcttctgggggctgcgctcttactatgagaccagcaagatgaaagtctcaagtttgcctgcaaggatacaaaagaagggatccaaggaatggacagctcagtaccgagaggcgatggaagcggatttaaggctacagctgaggctgcagctaaagacaaggatagggccgagattagagctcgaatggacatttggctcgcctcagaagaattctgccgggccc

SEQ ID NO: 2249 - DNA, 191 bp, Homo sapiens
gtcgcggcgacatggccaacgtaccaagaaagtcgggatcgtcggtaatacgggaccggctatggggcctccctccggaaaatggtgaagaaatttgaaatcagccagcacgccaagtacacttgctctttctgtggcaaaaccaagatgaagagacgagctgttgggatcttgcactgtggttcctgcat

SEQ ID NO: 2250 - DNA, 172 bp, Homo sapiens
aaaataccttagaatgggtaatttataaacaacagaaatttatttctcacagtttggggaggttgggaagttcaagatcaaggaaccagcagatttgggtgtctggcggagggcttgttcatcataaatgattgcctttcagcggtattcttacaatggaggcttgaaccgc

SEQ ID NO: 2251 - DNA, 198 bp, Homo sapiens
aaatccgggggcaaggccaaaaagaagaagtggtccaagaggcaaagttcgggacaagctcaataacttagtcttgtttgacaaagctacctatgataaactctgtaagggaaggttccaactataaacttataaccccaagctgtggtctctgagagcctaagatctcgagaggcctcccttggcaaggcaagccct

SEQ ID NO: 2252 - DNA, 238 bp, Homo sapiens
accatgttggccaggctggtctcgaactacctgacctcaggttgatcacctgcctttggcctcccaaagttgctgggatgacaggcatgaggcacctcacccaggccaaggtaattattcctgaaaggttgagtaccatgctattgagctagacacttggtgtggtttatcctgtcatcgcctcagatacctacaccaggtggacacgggataggattcctaatttcacagagaggag

SEQ ID NO: 2253 - DNA, 164 bp, Homo sapiens
tatctacccacgtccacgcggccacctcaccctctccgcacacctcttgctgtctttttgtactttttgttccagagctgcttctgtctgggttatttagggtttattcttccttttctttgagagttcgtaaagagggaagccaggattggggactctattga

SEQ ID NO: 2254 - DNA, 121 bp, Homo sapiens
ctacagagaattgcaccgaacagccatctcacaccgagctccagagcccgcaggtcgcagcgagtgcgggcttatctcaacacagtaactctacatgggaacacatctctcmrggttccca

SEQ ID NO: 2255 - DNA, 172 bp, Homo sapiens
agcggaggtctgcttctcggggacgtggctcccaactttgaggccaataccaccgtcggccgcatccgtttccacgactttctgggagacttatggggcattctcttcttccaccctcgggactttaccccaggtgttcaaccaaagagcgtttggagaacttcaaaggttg

SEQ ID NO: 2256 - DNA, 140 bp, Homo sapiens
ctacaggaagggaggggagaggacaagtgataaacacctggagggttgagggatacaggggaacaacacaacttgttggaccttagcgttgttttggaaaaggccaagcagtttgaacctgctgtgtgaggacggaaggc

SEQ ID NO: 2257 - DNA, 420 bp, Homo sapiens
ggaagggaggggagaggacaagtgataaacacctggagggttgagggatacaggggacaacacagctgtggacttagcgtgtttggaaaagccaggcagtttgaccctgctgtgtgaggacgaaggcatggaggaggaatgtcaggaacaagagatgatcaccaggtgtcagaacttggaagatttagagcaaaggacaataggaaaaaggactcacggagttactattcacaatgccagtaagagacacgaccgtcacccttctctattttcacaggccctaaagagctgaagggttacgccctgctgccaacgtgcttaaaaaaagaccgtttctgactctgtgccctgtccctgagctcgtgggagaaagatgacccgtgggaacacttgcctgggcccactcagaatccacgggtg

SEQ ID NO: 2258 - DNA, 276 bp, Homo sapiens
gttgctttttataagaccaagaaggagaaaatccgacaacctggaaagatttttgttttcactgcttgtatgatgtttcccattcatacacctataaatctctaacaagaggccctttgaactgtcttgtgttctgtgagaaacaaatatttacttagagtggaagggcagattgagaatgttccaatccaaatgaatgcatcacaccttacaatgctgctcaattgttgtgagtactatgagattcaaatttttctaacatatagagagcccttt

SEQ ID NO: 2259 - DNA, 303 bp, Homo sapiens
cacaagcatccttgtaagtggcaaagaggcagaggagacagcgccagagaggcagctgcatgagaaggatcaagatgttgctgactttgaagttggaagaagaaggccatgagcctcagtatgtgggcggcttctagaagctggaaggggcaaggagatggattttacccttcagactccaggggcagctgtacctctccatcactctattgtagcctctgtgagggctcttttttagacttctctacctcttagagctctaacataatacatatttgggtgttttcaaccactcaagtttgt

SEQ ID NO: 2260 - DNA, 272 bp, Homo sapiens
gcaaaagcagaatcaaccatctcagaggactgtgtagacaagacagatctcatccttttattaacataagtgcttcatgaaggcaggagatgtgaactggacattatggtgtgtgttgaatttggacagattaagatgggatttgggtaggagttaggcttttgacacagacaacagcatgggccaagatggagcagaggtggagatgtaggggatattttggaacagggaagcctgatttagggtgaagtataacttttatagaggagaat

SEQ ID NO: 2261 - DNA, 241 bp, Homo sapiens
cagaggtgacaaaggagaggctggagagcctggcgagagaggcctgaagggacaccgtggcttcactggtctgcagggtctgcccggccctcctggtccttctggagaccaaggtgcttctggtcctgctggtccttcttgccctagaggtcctccttgccccgtcggtccctctggcaaaaatggtgctaattgaatccctttgccccatttggctcctggtgccccttggacgataaag

SEQ ID NO: 2262 - DNA, 310 bp, Homo sapiens
ccgcacgaggtcgtctcagtttgcagctttaaaacagcaggagccaccagctagctcctccaggcagtctaaccattttccagatggttcccatcttcagaggtctttcttatgagtttcaaaacttgtgcccttgcagtttccactcaggcctattagttctgccctgtgggctacagagaacatgcctttcagatacttgaagacagcaattatgactctctccagctgtttactgcttttcaagataaacagacctctccttccatcattgctcaggcataatcctctggggtgacagaaagaacat

SEQ ID NO: 2263 - DNA, 420 bp, Homo sapiens
cggcacgaggtcgtctcagtttgcagctttaaaacagcaggagccaccagctagctcctccaggcagtctaaccattttccagatggttcccatcttcagaggtctttctgatgagtttcaaaacttgtgcccttgcagtttccactcaggcctattagttctgccctgtgggcctacagagaacatgcctttcagatacttgaagacagcaattatgactctctccagctgtttactgcttttcaagttaaacagacctctccttccatcattgctcaggcataatcctctgggatgacagaaagaacatgttatctggggacaggtaacccagatctgaatccagacctcactcatagtcactgtgtaaccctgagcacatcacacctgcctaacagggctcctgtgaggattccaag

SEQ ID NO: 2264 - DNA, 294 bp, Homo sapiens
cagaaatggcacctcgaaaggggaaggaaaagaaggaagaacaggtcatcagcctcggacctcaggtggctgaaggagagaatgtatttcgtgtctgccatatctttgcatccttcaatgacacttttgtccatgtcactgatctttctggcaaggaaaccatcttccgtgtgactctgtggggatgaaggtaaaggcagaccccgatgaatcctcaccatatgctgctatatttggctgccccaggatgtggcccccaggtgcaaagagctcggggatcacccccctacacat

SEQ ID NO: 2265 - DNA, 223 bp, Homo sapiens
aacaatcatgacagaaagggaagtaaacacgtccttcacatggcagcaagagagagaagtgccaagcaaagaggggaaaagtcccttataaaatcgtcagatctcgtgagaactcactcactatcaggagaacagcagcacgggcgtaaccccattggttgggacacagccaaaccatatcaattactatttaattccatttgtggggtcagagtatacatat

SEQ ID NO: 2266 - DNA, 168 bp, Homo sapiens
cagagactttatcaaaaacatgattacagggacatctcaggctgactgtgctgtcctgattgttgctgctggggttggggaatttgaagctgggatctccaagaatgggcagaccccagagcatgcccttctggcttacacactgggtttgaaacaactaattgtcgg

SEQ ID NO: 2267 - DNA, 141 bp, Homo sapiens
gttggttggtatcacagtcaccctggctttggttgttggctttctggtgtggatatcaacactcagcagagctttgaaggcttgtcggagagagctgttgcagttggtgttgattccattcagagttttaaaggaaagggt

SEQ ID NO: 2268 - DNA, 182 bp, Homo sapiens
agaagatgaaaaaaattttatacgttgataaaacttataaatttcattgattaatctcctggaagattggtttaaaaagaaaagtgtaatgcaaggatttaaaggaatatttttcaaggcacaattattttaatattgggtatcaactcgcttgtaaaggggcttcccttttttctttgtca

SEQ ID NO: 2269 - DNA, 188 bp, Homo sapiens
accaagttcaatgctgatgaatttgaagacatggtggctgaaaagcggctcatcccagatggctgtggggtcaagtacatccccagtcgtggccctctggacacgtggcgggccctgcactcatgagggcttcccattgtgctgcccccctcttaatactcaccaataaattctactccctgtcacct

SEQ ID NO: 2270 - DNA, 102 bp, Homo sapiens
gtggaatggaacagtcaggtagttgaaagtttttttttagagatgaaaagcttgtgaactcctgtaaaacatgctgtatttgaaatacatctgttaaaactt

SEQ ID NO: 2271 - DNA, 229 bp, Homo sapiens
atttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactttggtgaagacctccccagacagtcatcagagttctcaggtctgagctcaggtgccccgtgtgtcttt

SEQ ID NO: 2272 - DNA, 158 bp, Homo sapiens
gcagcctccccctggcaggggctcaaggccgacacgctcaaggagcggtaccagaagatcgggggacaccaaacgcgccacgcccatcgaggtcctctccgagaacttcccagaggagatggccacgtacctccgctatgtccgccgcctggaactct

SEQ ID NO: 2273 - DNA, 106 bp, Homo sapiens
gccaagggaaaagtataaactggccttcaaattgtccaattatagtttataaccagtctattaaagggtgtttgtttccaatggatatagttttaggattgtggga

SEQ ID NO: 2274 - DNA, 117 bp, Homo sapiens
  misc_feature 117: n = A,T,C or G
tgtggctctcagccatgccacatccctgttcacacacccagggcatccattcctaagccagacccggctcccctacacctgaggttacactgccagcagtttcccaggcctctcccn

SEQ ID NO: 2275 - DNA, 148 bp, Homo sapiens
acgatccctcccttaccatcaaatcaattggccaccaatggtactgaacctacgagtacaaccgactacggcggacttaattttaacttcttacatactttcccccaataattcctaggacccagggaacctcgagattccttaacgt

SEQ ID NO: 2276 - DNA, 125 bp, Homo sapiens
gccacacaggctatctgaacacgggtgactgtctctccagatggatccctctgtgcttcttgaggcaaggaatggcaaggcctgtttaatgggtctcaaccgaggcaaacaacctttacaacgta

SEQ ID NO: 2277 - DNA, 139 bp, Homo sapiens
gggaaaccgagagggaaaggacttggccgctggagacttcactcattccctagcaaggaaacaaaagcagttaaaaggttggccgagggacaaccctgaaggttcaattccttaaggaactttttgccggaaggcaact

SEQ ID NO: 2278 - DNA, 56 bp, Homo sapiens
tggcttggcgctgttgctttccttgataacttgaacatgcaaatacactatttaga

SEQ ID NO: 2279 - DNA, 460 bp, Homo sapiens
gttggcttggcgctgttgctttccttgataacttgaacatgcaaatacactatttagatagcagagaagagcaatcagatcctacacattccaatgtgtgatcatctttatcatattgcctaaaaacagccttaaacattttttggacttctttgtttgttttgcaagtctcatggccttctggctttaatcaaagtcttgtccattatgatgagaaaataaatgtcagaaacatttaaatttacctaaatgcaagacacataaaaggattatagtcctcctttggcttcagagaaattggcttttcaaaaaaagtttttaagttgactgcatttttgtgaacattaaaaactacattgcatcaaaaaattgcaaaattaagtatatgtaagcaaaatagtacttaaatataaagtttcattgaattttattaccaacattctaaaatttcacaagatat

SEQ ID NO: 2280 - DNA, 116 bp, Homo sapiens
tcaacagagctcatggtcggattacccatacatgagctctccctgccacattgagatgatccttacggaaarggacagattgttcctaaaccagagaggaggttgcccagaaggaa

SEQ ID NO: 2281 - DNA, 203 bp, Homo sapiens
cggggctgcactgccaccctgggcaacttcgccaaggccacctttgatgccatttctaagacctacagctacctgaccccgacctctggaaggagactgtattcaccaagtctccctatcaggagttcactgaccacctggtcaagacccacaccagagtttccgtgcagcgactcaggctccagctgtggctacaacatagg

SEQ ID NO: 2282 - DNA, 184 bp, Homo sapiens
tggaggtgggacccctttcaattttcaagttttgctcatctagggaaaataaggctttggtttccagtttaattgtttttgaccttctaaaatgttttttatgttagcactgataggttggcattactgttgttaagcactgtgttccagaccggtgtcttacttagggtaacctagggaattt

SEQ ID NO: 2283 - DNA, 126 bp, Homo sapiens
atcaagtccctggaggagatctatctcttctccctgcccattaaggaatcagagatcattgatttctycctgggggcctctctcaaggatgaggttttaagattatcccaatacagaagcagaccc

SEQ ID NO: 2284 - DNA, 110 bp, Homo sapiens
tttcacttttaaacctctagatcagaatttgttgactcgcattcagaacataaatgcacagaactctgtacatgtctcccatcaagagagattcattgggcatcccaagg

SEQ ID NO: 2285 - DNA, 102 bp, Homo sapiens
agaaacacttaagatacaaggttcttttgaattcaacagcaagatgcttgcgatgcagtgcggtaaggtaattctcacctcctgtggaatgggcttcaaccc

SEQ ID NO: 2286 - DNA, 102 bp, Homo sapiens
cttgagctttagtgtgctatacctatgtgtcttatcgtgggacactgtgccaataacacaaaaaaacaactgtttgggtttacctcagttcgcagtagttat

SEQ ID NO: 2287 - DNA, 106 bp, Homo sapiens
cttccccacccacggtgttcgtttggttttaaaggtcacctgtctcactcacccagccagcccttaaaggtgccttctacttccagyvacaaagcagaccactggg

SEQ ID NO: 2288 - DNA, 137 bp, Homo sapiens
gcgcctcggaggcgttcagctgcttcaagatgaagctgaacaactccttcccagccactggctgccagaaactcattgaagtggacgatgaacgcaaacttcgtactttctatgagaagcgtattgccacagaagtt

SEQ ID NO: 2289 - DNA, 149 bp, Homo sapiens
ggaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaa

SEQ ID NO: 2290 - DNA, 158 bp, Homo sapiens
cgacactagtggatccaaagaattcggcacgaggagaaaagaagaaacgctcgcgagaagaatgctggagataatgatgacacaaagggtgctatttgtgtcaagaacaaggtggctggagggaaaatgaagaagcggaaaggccgttaatcactttt

SEQ ID NO: 2291 - DNA, 233 bp, Homo sapiens
tggttccgaaaattggaataggtgccaaggatctggagatgacaacttgacttctctggggactctgaacttccctggtcgaacagttttttctaatggctattcaaggtaagatcagtgtttttctgtttcttaagaaatgggacaattaaggtagattaatagatgtaaatctctcattgatttatatgtgtgtctctaaagagatcatgtgctcttttatatataataag

SEQ ID NO: 2292 - DNA, 126 bp, Homo sapiens
atcacctaccactgcaagaacagcattgcctatctggacgaagcagctggcaacctcaagaaggcccttctcatccagggctccaattacgtggagatcccggcagagggcaatagcaggtttaag

SEQ ID NO: 2293 - DNA, 136 bp, Homo sapiens
atcgtgcgggaagtcgacaggccgggatccaaggtgaacaagaaggaggtggtggaggctgtgaccattgtagagacaccacccatggtggttgtgggcattgtgggctacgtggaaacccctcgaggctccgacc

SEQ ID NO: 2294 - DNA, 158 bp, Homo sapiens
ctcgtgccgaattcggcacgagggctttttaccaagcatactgcctgcaaacatattgttaacaaggcacatcctgcacagccctaattccattaaaccttgattcaatatagcacatgtttctgggggcacagagttggggctaaatttacagatta

SEQ ID NO: 2295 - DNA, 111 bp, Homo sapiens
atttttggtccgcacgctcctgctcctgactcaccgctgttcgctctcgccgaggaacaagtcggtcaggaaggcccgcgcgcaacagccattggtttttaaggataccgg

SEQ ID NO: 2296 - DNA, 140 bp, Homo sapiens
ggaatattctgttgaccataaaaccttgatatcattctgtgtatatagaatgtaaaaggaatattacagtgttaactgccatatatgtaatatacacaaactcaattagcattgtaatggccaaatgcattcccccatgc

SEQ ID NO: 2297 - DNA, 167 bp, Homo sapiens
cccaaacctgttaatattttgagcgcttctatgtgaaagcaaagaaataattttaatactctggcattcataaattttattgatgagattatttattttaaaggtttgaggtaacatctcttggttgtacccaagaagaaataaatatgggttcttaawctcttgca

SEQ ID NO: 2298 - DNA, 167 bp, Homo sapiens
gttgttctggatccgtcgtacttaagggaattttccaatgtcgggccttgtgtgctgcaatgggggggggtgtcctttgttccttgcgcggggcccctttggtggcgccatcttgtcttccggtgggcagagcctattttaagggggagtggtggctctttttcttt

SEQ ID NO: 2299 - DNA, 520 bp, Homo sapiens
gttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaacagcctctcacggaggcatcttatgttaacctaactacattgcgctgtgtaacacagattctcctctgcgctatgtggacattg

SEQ ID NO: 2300 - DNA, 181 bp, Homo sapiens
cttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgccctatcaaatgagtttttcccagttaaggaggggggtcttt

SEQ ID NO: 2301 - DNA, 268 bp, Homo sapiens
cggcacgaggcaaaaccaggattagaatccagagctattggcccatggtcttcccaccacaaactattgttattgaaaataggatcaggttcctttagatgtttaataacccttatgagttaaaatgctgcctaatattttggcatcaaacatttatagctcttaataaaacttacctctacaggtacttctcacttttattcttatgtctaaagggtgtggagacatatatcacactgtttttcacacgcagattatgactctcttg

SEQ ID NO: 2302 - DNA, 470 bp, Homo sapiens
acactagtggatccaaagaattcggcacgagcggcacgaggcaaaaccaggattagaatccagagctattggcccatggtcttcccaccacaaactatgttattgaaaatagatcaggttcctttagatgtttaataacctttatgagtgaaaatgctgcctaatatttggaaatcaaacatttatagctctaaataaaacttacctctacagttacttctcacttttattcttatgtctaaagggtgtggaaacatcattgaacattgtttttcacacgcagatgagactctgttgaagggagttttgtggtttaggggtttagggggttacaggtacctttgagaatctgatgacagctgtggacatggacaaacacgtgtatgcccagacccagcagttttactcgtggcatccgggcagttcaaagaccccatcatgaggatcctgatttggaggctctgcaccat

SEQ ID NO: 2303 - DNA, 241 bp, Homo sapiens
gcccagcctcgaaatgcagaacgacgccggcgagttcgtggactgtacgtgccgcggaaatgctccgttagcaatcggatcatcgggtgccaagggccacggatccatccaggtgacggtggccaagggttacaagggcacaagcagggtttattgccagtttaaaccttttgcttttttcggggccaattggtggattggtagagaaagatgtcccaatccccagttgccaaagccagtg

SEQ ID NO: 2304 - DNA, 404 bp, Homo sapiens
gctgatccgagtccactcggctccccgctccggggctccggctgcagagagcacggagatcgtgcgcggctacacgtgggctgagtaccatgcggacatctacgccaaagtgtcgggcgacatgcagaggcaaggctgcgactgtgagtctctggccggcgggcgcatctcccaccagagtcaggacaagaagattcacgtgtacggctattccatggcctatggccctcccagcacgacatttcatctgagaaaatcaaggccaggtaccccgtctacgaggatcacctggtctaacgacgtctactgcagcacttccagcccggggtctgctgcctcagcagcactcagagccccgcctttgcctcactctctagagggctggccttcctctctgcgcagct

SEQ ID NO: 2305 - DNA, 145 bp, Homo sapiens
gcgcagtagtgctagcggcttcgcggttcggtcctcgcaccccgcagccgcactggtgctgagctgctaggaaggccctatcgccgagctcgttggagcttgaacccaatttcaacccctccgactcaaccgccccaaaaaaaaa

SEQ ID NO: 2306 - DNA, 200 bp, Homo sapiens
tggagttactgaaggtctccaaggacaaacgggccctcaaatttatcaagaaaagggtggggacgsacatccccgccaagaggaagcgggaggagctgagcaacgtacttgccgccatgaggaaagctgctgccaagaaagactgagcccctcccctgccctctccctgaaataaagaacagctttacagagaaaaaaaa

SEQ ID NO: 2307 - DNA, 212 bp, Homo sapiens
aaaatttgatttagcattcatattttccatcttattcccaattaaaagtatgcagattatttgcccaaatcttcttcagattcagcatttgttcttttgccagtctcattttcatcttcttccatgggtccacagaagctttttttctttgggcaagcaggaaaattaaattgtacccatttttgtatatagtgagatgtttaaataaattg

SEQ ID NO: 2308 - DNA, 458 bp, Homo sapiens
cctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtgtggctcatgccttaatcccaccactttttttttaaggcaggcggatcacctgaggtcaggagtttaagaccagcctaccaacatggagaaacctcgtctctactaaaaatacaaaaattagccaggcatggtggcacacgcctatagtccagctactcaggaggctgaggcaggagaatcactttaccc

SEQ ID NO: 2309 - DNA, 380 bp, Homo sapiens
ggaaaattaattttacttttttttttgttctggccgaaatttttatgagatatctctcacttgtcttccactttgaacccggttaaagctcatagctktcagctctgaatggaggaggggagaagcccctggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccggtgccctctgtccccactgccggcccatgttctctctccggaggtcaccaaggaatgcacagttttcgactaccagaaaggggagtccttggttct

SEQ ID NO: 2310 - DNA, 245 bp, Homo sapiens
cttccctcccatctgggcagtgtagtccctcctcgtgcttcccttctctcccctgacccctggaacgagggatgcttatcatgtttaagaactcattggcctctaccctaccttagagcttcacttcatcttcagtagcaaatggattggtagctattctcaccattgacatggatagcctgtcccagcatgattgggggggtatcaggcagggggagtcgacatctcttggaacagagcatcta

SEQ ID NO: 2311 - DNA, 250 bp, Homo sapiens
cccgagttcaagtgattttcctgcctcagctccccagtagctgggactacaggcgcccgccaccacgcccagctaattttttgtattttcattagagatggggtttcaccacgttggccaggatggtctcgatctcttgacctcgtgatccatctccctcggcctccaaccggtctggaataccaggcataagccaccatgcctggccaggctttggtttaaataatatatatggatctatgcgctcatc

SEQ ID NO: 2312 - DNA, 335 bp, Homo sapiens
gcctcaccaaggtgacacattacaaagccaccctaccatgaatccgctcccaagggtctcactgctcacctgaggataactcaatataactatgttgctgaaaatgcaaagctgaagaccatggatttcatggtgattccagcaagtacagagattctatgaagcccacccagaaaaaacttgctggtgctcggctatttttgtgtcatttattcaagtattgagaacctcggcctgtggtaggcactgtactctaatactaggatacagagatgcaaaagatacgggcccatgcaattttattaaatgcatcaatatgtattacaaaaaaaaaa

SEQ ID NO: 2313 - DNA, 290 bp, Homo sapiens
cgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctgttttaaaaataaaaaaaa

SEQ ID NO: 2314 - DNA, 260 bp, Homo sapiens
gttgattgtgattatctcaaagccaaaatattcagtaaattcagttttttaagagccttgctttattaccagcacaaattaccagcatttgtgattgtatagtgcccaaaatgcaaggactgagacttgaacttttttttatgccccccagcacacttagcccagtgtgaggcatataatgggcccttagtaaaatacctgttcatcaattgttatagaaataacaatttgttaattcatttagcaggtaattattgagc

SEQ ID NO: 2315 - DNA, 290 bp, Homo sapiens
cgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatgggaaatcccatcaccatcttca

SEQ ID NO: 2316 - DNA, 360 bp, Homo sapiens
cgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgacccttcattgacctcaactacatggtttacatgttccaatatgattccacccatggcaaattccatggcaccgtcaaggctgagaacgggagcttttcatcaatggaaatcccatcaccatctttcaggggcgagatccctccaaaatcaagtggggcgatctggcgctgagtacgtcgtggagtccactgcggtcttc

SEQ ID NO: 2317 - DNA, 135 bp, Homo sapiens
ccgcggcgggagaggaacgcgcagcagcctttgggaagccaggcccggcagccatggcgttggaggaggattaatttgttagttcttgctctacgtgcctctgctggcttttgcgctgtccagttgggactgatt

SEQ ID NO: 2318 - DNA, 220 bp, Homo sapiens
cccgcaagaagctcctggctgaccaggctgaggcccgcaggtctaagaccaaggaagcacgcaagcgccgtgaagagcgcctccaggccaagaaggaggagatcatcaagactttatccaaggaggaaggagaccaagaaataaaaccttccactttgtctgtacatactggctctgtgattacatagatcagccattaaattaaacaggcttcatctgc

SEQ ID NO: 2319 - DNA, 125 bp, Homo sapiens
cttttatctaaaatttccttaccaggcttaaatcattgccttttaaaaaatgtgtactataagtactttttgttaggtgagctctctagtattaacttggtgagactgatttgtaggaccacatc

SEQ ID NO: 2320 - DNA, 136 bp, Homo sapiens
cttttatctaaaatttccttaccaggcttaaatcattgccttttaaaaaatgtgtactataagtactttttgttaggtgagctctctagtattaacttggtgagactgatttgtagtaccaaatcttttttttttt

SEQ ID NO: 2321 - DNA, 205 bp, Homo sapiens
ctcgtgcgaacagtttgccagctaaattcaaaaaactcctggtgccaggaaaaattcagcacattctctgcacaggaaacctttgcaccagagcagagttatgactatctcaagactctggctggtgatgttcatattgtgagaggagactccgatgagaatctgaattatccagagcagaagttgtactgttggccagttcaac

SEQ ID NO: 2322 - DNA, 186 bp, Homo sapiens
ttgtataattggacatttaggattttaactttagatgatcatttggttccatttttatttcatttttatttttgttaatgcaaacaggacttaaatgaactttgatctctgttttaaagattattaaaaaacattgtgtatctatacatatggctcttggggccttagctttcactacactacagg

SEQ ID NO: 2323 - DNA, 204 bp, Homo sapiens
cttgacgaggctgcggtgtctgctgctattctccgagcttcgcaatgtcgcctaagggacggacaagaggaagaagggacggttggaaaggtcggccaagaaagacaaagaccccagtgcacaaataccgggggcaggacaaaaaggaggagttgttccacagccaagttcgggacaagttcattaacttagtctgtttttaca

SEQ ID NO: 2324 - DNA, 200 bp, Homo sapiens
aagacgtgaaccagcaggagttcgtcagagctctggcagccttcctcaaaaagtcccggaagctgaaagttcccgaattggtggataccctcaagctggacacagcacaaagagctttcttccctacgatgagaacttgttctacacgggagctgactttcacagcgcggcacctattaccttccgggtgagcgcttggg

SEQ ID NO: 2325 - DNA, 190 bp, Homo sapiens
ctagagcttgtctcaatggatctagaacttcatcgccctctgatcgccgatcacactctgagacccaccctttgctcataaacaaaatgcccatgtttggtgccctgcccttggacctgtgacaatctggcctatttctgtgtttatatggtgggcgcagtgtaacaaacatataataaatcaccctttt

SEQ ID NO: 2326 - DNA, 196 bp, Homo sapiens
cccaattggaccaatctatcaccctatagaagaactaatgttagtataagtaacatgaaaacattctcctccgcataaggcctgcgtcagattaaacacttgactacaattaccagcccactatctccagtcaaccaccaggtcattattaccctcactgtcaacccaccacaggcatgctcatagggaagggtaa

SEQ ID NO: 2327 - DNA, 239 bp, Homo sapiens
ataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaccccaagtcaaggcacatggcagaggatgctgacattcttgggat

SEQ ID NO: 2328 - DNA, 207 bp, Homo sapiens
gttcactctacttagcatgtccctaccgagtctcttctccactggatggaggaaaaccaagccgtggcttcccgctcagccctccctgcccctcccttcaaccattccccctgggaaatgtcaacaagtatgaataaaggcacctactgaggtacatttccatggggaatggtttctcgtgccgaattcggcaggggcgtaagtcgg

SEQ ID NO: 2329 - DNA, 169 bp, Homo sapiens
ctcgtgcaattcggcacggaagaacatgaggaccctctggattaatcgaattacagctgctagccaggaacatggactgtaagtatccagcgctcatttggaattagttaagtgccaagtggagctcaacaggaaagtcctagcggatctggccatctacgagccaaag

SEQ ID NO: 2330 - DNA, 215 bp, Homo sapiens
gagaaatcgcttggacttcggggcggcctcggacggccatggctttaccctgtactcactgctgcaggcagccctgctctgcgtcaacgccatcgcagttctgcacgaggagcgattcctcaagaacattggctggggaacagaccagggaattggtggatttggagaagagccgggaattaaatcacagctattgaacctattcgatctgtaga

SEQ ID NO: 2331 - DNA, 250 bp, Homo sapiens
atcgatctgggtatcaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatcctatcctggcaaataaattcccgtttctatccaaaagagccataaagagttttcagtgaaatgtg

SEQ ID NO: 2332 - DNA, 186 bp, Homo sapiens
cttcggcccacttgctcacacggtgaagcagaagctcttcaccgaggtggaggggacctccacagggaagtatggctttgtaattgctgtcaccaccattgacaatattggtgctggtgtgatccagccaggccgaggctttgtcctttatccagttaagtacaaggccattgatttccggccatt

SEQ ID NO: 2333 - DNA, 250 bp, Homo sapiens
gcggagactgcgggcccgtagctgggctctgcgaggtgcaagaaagcctttgaggtgaaggtgtatgaaagtcatcataacagatgttttccaaaaacttgtaggaggttgtgaaaaacctactagggtcacgcggcatgtattgagcatataggttgctgtagatgaatgttcttagctgtctatgtttaaaaatacttcctgcttcgtaccccaagtaagggatttgtcaagcaaccatgtctccgac

SEQ ID NO: 2334 - DNA, 195 bp, Homo sapiens
gaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctg

SEQ ID NO: 2335 - DNA, 245 bp, Homo sapiens
cggcacgagttatggttcccgatgatcctctgggaagaagtggacctcgattagaggagtttcttcagaaggaagtctgtcttagagatatgcagcccctactcagttccctgccaaatgtgggcatgtttgaccccagcttcagagtccctggcacccaggcagccagcaccagccaccagtcttcgaccggattcagggagccccttcaagccacttgcttccgtaagaagcccactttgcca

SEQ ID NO: 2336 - DNA, 210 bp, Homo sapiens
ctcgtgccgaattcggcacgagccggggcagagggcaatagcaggttcacgtacactgccctgaaggatggctgcacgaaacataccgtaagtggggcaagacttttatcgagtaccggtcacagaagacctcacgcctcccatcattgacattgcacccatggacataggggggccccagcaggattcggtgtggacatagggccgtct

SEQ ID NO: 2337 - DNA, 180 bp, Homo sapiens
gtgcgaattcggcagagcgggagaaggtgcgccgcatcatggagtcctacttccgcctggatacgcccctctacttttcctactctcatctggtgtcccgcactgccatcggacgaggtccaaggcagagaggaaggtatgttagtcatccagttcacgtggacaactgcatcctgattg

SEQ ID NO: 2338 - DNA, 219 bp, Homo sapiens
cagtacaagatccagactggttcttgaacagacagaaggatgtaaaggatggaaatacagccaggtcctcgccaatggtctggacaacaagctccgtgaaggacctcgagcacctaaggaggattcgggcccctagggggcttcgtcacttcttggggcctctgtgtcccaggcaggacaacaagacaccttgccgccgtggccgaaccctgggttttt

SEQ ID NO: 2339 - DNA, 258 bp, Homo sapiens
gcagtacagatccagactggttcttgacagacagaaggatgtaaggatggaaatacagccaggtcctagccaatggtctggacaacaagctccgtgaagacctggggcgacttaggaggattcgggcccatagagggctgcgtcacttctggggccttcgtgtccgaggccagcacaccaagaccactggccgccgtggccgcaccgtgggtgtgtcaagaggaatatgtctgtaggccttgtctgttaataagtagt

SEQ ID NO: 2340 - DNA, 141 bp, Homo sapiens
tgaagtctttctattgcaccgaggttgttttttgtaatagtatttgtggaaatggaattttagccagatgctgtccaggtacactggggcagatttttatttacatccaataaaaatcacactacctcactatatgtaagc

SEQ ID NO: 2341 - DNA, 178 bp, Homo sapiens
tgaagtctttctattgcaccgaggttgttttttgtaatagtatttgtggaaatggaatttgagccagatgctgtccaggtacactgggcagattttatttacatccaataaaaatcacactacctcactatatgtaagcaaaaaaaaaaaaaaaaaaaaaaaaaaaaaaaaaaaaaaa

SEQ ID NO: 2342 - DNA, 147 bp, Homo sapiens
tgaagtctttctattgcaccgaggttgttttttgtaatagtatttgtggaaatggaatttgagccagatgctgtccaggtacactgggcagattttatttacatccaataaaatcacactacctcactatatgtaagcaaaagaaaa

SEQ ID NO: 2343 - DNA, 204 bp, Homo sapiens
ccgtcatctactctaccatctttgcaggcacactcatcacagcgctaagctcgcactgattttttactgagtagggctagaaataaaccatgctagcgtttattccagtggtaaccaaaaaataaaccctcgttccacaggaggtggccatcaagtatttcctcacggaaggaaccggatccataatccttctaatagctatcc

SEQ ID NO: 2344 - DNA, 158 bp, Homo sapiens
ccgtcatctactctaccatctttgcaggcacactcatcacagcgctaagctcgcactgattttttacctgagtaggcctagaaataaacatgctagcttttattccagttctaacccaaaaaataaaccctcgttccacagagagctgccatcaagta

SEQ ID NO: 2345 - DNA, 188 bp, Homo sapiens
cttcgccacgtgctggccacgctgggtgagaggctgacagaagacggagtggagaagttgatggcttggcaagaggactccaattgctgcatcaactatgaagcatttgtgaagcacatcatgtccagctaaacctcggtgcccagggagcccagggaaaggctgtgcagggagcgtctcatctccca

SEQ ID NO: 2346 - DNA, 154 bp, Homo sapiens
cttagccaaaccatttacccaaataaagtataggcgatagagattgaaacctggcgcaatagatatagtaccgcaagggaaagatgaaaaattataacccagcataatatagcaaggactaacccctataccctctgcataatgaattaactag

SEQ ID NO: 2347 - DNA, 117 bp, Homo sapiens
cggcacgagagtacttctagagcggccgcgggcccatcgattttccacccgggtggggtaccaggtaagtgtacccaattcgccctatagtgagtcgtattacaattcactggssvg

SEQ ID NO: 2348 - DNA, 185 bp, Homo sapiens
ttaggatcacagctctggaggcagatagcctgaattttccaattctgactgccttactagtgcctgtgtaaccctgagcaaattactttactctgtgcctccactctcctcaattaaaaaataaaatgtggttaataatagtaactggcctcaaaggggttgctgtgaggattaaattagtatgt

SEQ ID NO: 2349 - DNA, 194 bp, Homo sapiens
cccgtatggggctcttaaagccgctgcctcccagagaccttccggtgttgcgccgccccggccaagcctcagcctttctgggccttagcttcttcacgtgtaggtggggagggaggacttgaccacctgttgcggctttggagcccgcacgccctaggtatatcctgaggtgcaccgcgaggtgtgagtcggtg

SEQ ID NO: 2350 - DNA, 177 bp, Homo sapiens
gttttgacaaatgtacatacacggcaatctattttttatttcaccaccccagaaggttccttcatgcccttttcccagtcaatacctcctcatccccaagggtacttttcctttccccatagcttagttctctgttctagaatttcctggaaatggaatyacacagtatgaactttt

SEQ ID NO: 2351 - DNA, 551 bp, Homo sapiens
gttttgacaaatgtacatacacggcaatctatttttatttcaccaccccagaaggttccttcatgccctttcccagtcaatacctcctcatccccaagggtacttttcctctccccatagcttagttctctgttctagaatttcctggaaatggaatcacacagtatgaactcttttgtgtttggcttctctctcccaacacgatgtttttgagtcatcaggttgttgcctgtaccaggttaaataggatatcactaacagcgagatagtgttaagaaggggacaatttttaccccgttggcctccaggctagatactacctatatcctggtaagtggccctccttgcccttccaagtgagtctctctccagggccatgcaagttcctctcccagaaccgctcaggcggcctcgggcaccacccagatggctgcggggccatcaccaggtcgcctccccagaacagctgccccctgcttccccccagccccattaaaactcaaaagggaactctggccctctgccgatcagaattcagactcgcttaattc

SEQ ID NO: 2352 - DNA, 224 bp, Homo sapiens
tgctgactacatagaatggggttgagagaagatcagtttgggcttcacagtgtcatttgaaacgttttttgttttgttttgtaattattgtgggaaacctttcaagtgaaccggagggtggtgtccaccttttggttgaggggttggaccaaggggttggctttgatcccattggggctcgggggggttcccccgaagcttttcctttggcgggttttttaaat

SEQ ID NO: 2353 - DNA, 184 bp, Homo sapiens
agataaagaaatcaaggagatgagacccaaggtcagcagccacctcaacgtcggtaccgcgcaacttcaattaccgacgcagacgcccagaaaacccttaaccacaagatggcaaagagacaaaagcagccgttcccccacctgaggatttcgtccgttcccgagcttatccgggcggggcttt

SEQ ID NO: 2354 - DNA, 107 bp, Homo sapiens
gcgaggtgcctttggaaagccccagggcactttggccaaggttcaattgtgacaaggttttcatgtccatccgcaccaagctgcagaaccaaggagcaatgtatgtt

SEQ ID NO: 2355 - DNA, 214 bp, Homo sapiens
ctcaccacctgcatcagcgcccattgtccgcggagaagcccgacggccccctgaactactctctcggtggctgcgccgggagccttgactctggggagcacgaacggacaaactacggggtttggcgccgccgcctgcgttatactttggcatagcgcgcctccctggtcacgattgggccgccttgggggtctgggaggtgtttacaaaaccc

SEQ ID NO: 2356 - DNA, 129 bp, Homo sapiens
cggcacgagcagaatggaaagtatttctatttgtcctttttttgttttctgttctaattgtcagggacatatgtagtggctataggtttacttaaaaggaataaatttggcatgctcaaaaaaaaaaaa

SEQ ID NO: 2357 - DNA, 140 bp, Homo sapiens
gaagttttgctttcactgaagccccaagatcttctgctagccgtggtaaatgaagctggctacagttgagtagcttggtgaagcaaaggtagagagcaaatcgagatacgctgattagtaaggtgaggtgaattccaccg

SEQ ID NO: 2358 - DNA, 540 bp, Homo sapiens
gaagttttgctttcactgaagccccaagatctcctgctagccgtggtaaatgaagctggctacagttgagtagcttgggaagcaaaggtagagagcaaatcgagatacgctaataaggaaggtagtagaagccacgtggaagagaagaagaaaattcataattaaaaatgagctgctcaagttaggacccaaattataatttttaaaatgtaattttctttgtgtctaacaatttgcaatttttcatagcataagcacattcattaatatgacccattcacagcaatatttagctgtcttttatgtaagtttatatgtgtgtgtatatatatgacgaaggtttatatatacacacacacacatatggcatgatttactcacaagttaacattttaacaattcaatatgaaatgtaattatacaagatgctattttaaagagtacttctagagcggccgcgggcccatcgattttccacccgggtggggtaccaggtaagtgtacccaattcgccctatagtgagtcgtattacaattcac

SEQ ID NO: 2359 - DNA, 106 bp, Homo sapiens
gcctgaatttcttggaccatactccaactttcttccgccgactacgtaagatttccgcaatcccaattccaggatttccccgataaacgacggcccaaaaaaaccc

SEQ ID NO: 2360 - DNA, 554 bp, Homo sapiens
gcaggatgagatgatcgacgtcatcggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaa

SEQ ID NO: 2361 - DNA, 103 bp, Homo sapiens
ggtcgcaattgttcggccatgaacttcccttggccaaatcgctggagttaaaccttggggcgtcaatatggtcccgccgggttttcaccacagggcttacctg

SEQ ID NO: 2362 - DNA, 163 bp, Homo sapiens
tagtcgcctgaatttcttggaccatactccaaacaccctagaaaacttaaaaataaagatgccctatccaaaggaaaaatgcggagtcagcgaggaaacccccccaatcatccaaagaaaaggaaaggccttcgagcaacgtccccgacagcccccgccccct

SEQ ID NO: 2363 - DNA, 553 bp, Homo sapiens
gcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtc

SEQ ID NO: 2364 - DNA, 215 bp, Homo sapiens
ctatagtcgcctgaatttcttggaccatactcagatcgcaacttgtatcttactcatcttcaatctaatcaaaagtagtaatacgatatccaagcctccccctcttaaactctcaggtaagaaggcaataaaaaaatttaggtaggtaagggagaggctaagttaggggtgtcctgagcaacgcgatggtggggtctcccctggtgccctctccc

SEQ ID NO: 2365 - DNA, 219 bp, Homo sapiens
ctcgtgccgaattcggcacgagcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgcttttttttttttttt

SEQ ID NO: 2366 - DNA, 216 bp, Homo sapiens
gcttgctgtgcggagggcctgctatggtgtgctgcggttcatcatggagagtggggccaaaggctgccgaggttgtggtgtctgggaaactccgaggacagagggctaaatccatgaagtttgtggatggacattatgatccacagcggagcacaatgttaacatacatacagttgacaaatcatgttcagccaaagtgtttgcattaaacaagag

SEQ ID NO: 2367 - DNA, 280 bp, Homo sapiens
gctaaatcccctagaagtcccactcctaaacacatccgtattactcgcatcaggagtatcaatcacctgagctcaccatagtctaatagaaaacaaccgagaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcact

SEQ ID NO: 2368 - DNA, 279 bp, Homo sapiens
gtgcaatgttcccttcgccttcgatggggcacatcgtctggatgctgaatttcatctgcgtcttcggcactgaaaagaaaaaacacgccaggtagcatcaccagagcagccctgagggaagtactcgcacagtggggaaggggacagtcaccaaacaccacagactgatgacatgggaaagggtgttttcaggaggaccatcacattttcagtctgtctctaggatgcttactactgaaaagggtttaagtgcaaactatgttaaaaaggtaaccaaag

SEQ ID NO: 2369 - DNA, 268 bp, Homo sapiens
ctcgtgccgaattcggcacgaggtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcagattacattgcagtgaagggggagtatgccaagtacctccctcacggtgcagggcgttttgccgccaaacgttccgcaaggctcagtgtcccat

SEQ ID NO: 2370 - DNA, 163 bp, Homo sapiens
attctagcacccctaatgatttcttcatgatagactcaacttcgagccctaatccctggaaaccacaaaaagtttcactatcattaaagctttacctatatcagtatatcaagtgaatggaatcatacagtatataaccattttgagtctgtcatctttcact

SEQ ID NO: 2371 - DNA, 186 bp, Homo sapiens
gagaatgaagactattctcagcaatcagactgtcgacattccagaaaatgtcgacattactctgaagggacgcacagttatcgtgaaggggccccagagggaccctgccggagggaccttcaattcacatcattgtaggacctcagcctccttggaaaggaaaaaaaggagctccgggttgcaaaa

SEQ ID NO: 2372 - DNA, 186 bp, Homo sapiens
attgagctcataaggtacttacattactacctataaatgtttcctgtacttgttagttgttgagaaacattttaggcagtaaataaaatagtaaatattatgtgtcctataatttgaccctaagctgtgtgcctttggattcagctctaggccagggccccctgggggtcatgttaggaaccacgt

SEQ ID NO: 2373 - DNA, 233 bp, Homo sapiens
ggagaatgaaatgatattagttgagaatgaatgacagactacttaggataacatgtatgccaagtgagttgaatcagctgatgtagtagtatgactgacagtttttgttgaatatttatgaatctattaaattaggaaatgaaatggtctctaaatatcctcatattgtggccatcctctgggttttaatcctaccatacctctattatttgtggccaccctcattctctgcm

SEQ ID NO: 2374 - DNA, 550 bp, Homo sapiens
ggagaatgaaatgatattagttgagaatgaatgacagactacttaggataacatgtatgccaagtgagttgaatcagctgatgtagtagtatgactgacagtttttgttgaatattttatgaatctattaaattaagaaatgaaatggtctctaaatatccttataatgtggacattctctgagtttttattctaacataactctaataatttggacaacctcaatatctgacagcatatttcccttgtgatataaagtcagtctcagacatggtctcctctagggaaccttccctaaatgccactacaactgtccatgcccaaatctgaagcttctcctggctccttctctttttctccttgacactgtgcttatattactactacaaaggccccaaaacacagcagagaataatttgttaaatgagttaagtccatttgagacctgtaaagtgactttcactgttaacaatagtccccctctgtgggtagaagcaagaatgagtttccaaacttgggaggttgaggttctggcatcacaggaatactc

SEQ ID NO: 2375 - DNA, 151 bp, Homo sapiens
gacacttcgagttcagacttttagcttccagaactgtgagactatacggttttgttgtttaagacccccggtttgtagtactttgttacagcagttctaggcaattaatacaggtatattattagggctttaggcttttaccttctttttt

SEQ ID NO: 2376 - DNA, 135 bp, Homo sapiens
gagagttgcggtgggtgtcatcaaagcagtggacaagaaggctgctggagctggcaaggtcaacaagtcttgccaggaaggttaggaggctaaattaatatatatatccctataaacctcgcccacccacactct

SEQ ID NO: 2377 - DNA, 190 bp, Homo sapiens
atgatgtgggaggcctacttggacgctgacttttgccctggaccctgacaaggccaccaaccttcaaccaaacccccgtgtattccaacaactcttacaaatggggggtccattgcaaggtcgccactcccttggccagcacgggacgagaagcgagaacctccttggcccggggcccttaaggacgaga

SEQ ID NO: 2378 - DNA, 108 bp, Homo sapiens
cggcacgagagtacttctagagcggccgcgggcccatcgattttacacccgggtagggtaacaggtaagtgtaacccaattcggcctatagtgagtcgtaatacaaaa

SEQ ID NO: 2379 - DNA, 157 bp, Homo sapiens
aagtcaatgtcctctacgaccgacaaggcatcggcaggagaatgcgcgggctctttttctgatgagggtacttgaagggctgatgggacaaggggtcaaggcaactattcccaaagggggaggggcactacaatttccctggagaagaaacccctgt

SEQ ID NO: 2380 - DNA, 216 bp, Homo sapiens
cagccatgagtatgctcaggcttcagaagaggctcgcctctagtgtcctccgctgtgcgcaagaagaaggtctggttagaccccaatgagaccaatgaaatcgccaatgccaactcccgtcagcagatccggagctcatcaaagatgggctgatcatccgcaagcctgtaccggtccattcccgggctcgatgccggaaaaacactttggccgccg

SEQ ID NO: 2381 - DNA, 142 bp, Homo sapiens
tggcctggtcacccaccgtgttcttcgacttgccgtcgacgcgagcctttggccgcgtctcctttgagctgtttgcgggcaaggtccaaagacagcggaaaattttcgtgctcttagccctggtgagaaaggttttggtttt

SEQ ID NO: 2382 - DNA, 197 bp, Homo sapiens
agcaaaacttgtttgggagtaggaaagtgagagggcttaatgcttgccttaatttctgttaactctttattttgttttttgggggacggggtctcactttgtagcccaggctggatggagtccaagtggtgccgatctgggcttaactgcaaccctctgcctccctaggctaaggcgattcgcccccctaagtctct

SEQ ID NO: 2383 - DNA, 289 bp, Homo sapiens
ccatggcgcaggggcagcgcaagtttcaggcgcacaaacccgcaaagagtaagacggcagcggcagcctctgtaaaagaatcggggcccaagaaaaggcgggtcggtgtttatcgcttcccaagaaggcgcgcgtcgtgcagcagcaaaagctcaagaggaccccagaagtcggattccggaagagatcgacattacgtggtgatgaaagccagcagcagcctgcccaagaagctggcacttctgaagggcccagccaagaagaaaggggcagcttcgccacctctcta

SEQ ID NO: 2384 - DNA, 169 bp, Homo sapiens
ggctccacgagggttcagctgtctcttacttttaaccagttaaattgacctgcccgtgaagaggcgggcataacacagcaagacgggaaggccctattggggctttaatttattaatgcaaacagtatccttacaaacccacaggggctaaacttaccaaacctgcatt

SEQ ID NO: 2385 - DNA, 238 bp, Homo sapiens
gagcgacttcttcaacattgagccttccaatcatgattttcaattcatttaggtcttctgtaatgtttcttaatataattgtatttgttgctatgcagaagtttcactgatcttttattatatctctatatatatttgatatttctgacactattgtaaatagkatctttttaatatttcattttccttttttgttgcttaaatatatataaaataagctaatttgcccactaatttt

SEQ ID NO: 2386 - DNA, 323 bp, Homo sapiens
gacattcagacttagcgtgcctaccaaaagcagccgaccatctttcaaaacaagaagagggtcctgctgggagaaacttggcaaggagaagctcccgcggtactacaagaacatcggtcttgggcttcaagacacccaaggaggctatttgagggcacctacattgacaagaaatgccccttcactggtaatgtgtccattcgagggcggatcctctcttgcgtggtgaccaagatgaagatgcagaggaccattttcatccgccgagactatcttcactacatacgcaagtacaaccgcttcgagaggcgccacaagaacat

SEQ ID NO: 2387 - DNA, 185 bp, Homo sapiens
aaaaatgtgccaagagttttaccttaaatcatacttggttgttgatttttatcaaatgtcttttctgcatgtgagataatatggttgttcccattttatttgtttatatggccaagtacgtggtatgaactattcttgaattcctgggataaactcaagttgtttatggggtgttatatatttaa

SEQ ID NO: 2388 - DNA, 125 bp, Homo sapiens
tcgtgccgaattcggcacgaggctgatgaaagagagcttgcagaccggagaccttctgagcaccttccacaccattctcggcttcagttccaacttaaggcttcttccttccttcctttccttta

SEQ ID NO: 2389 - DNA, 104 bp, Homo sapiens
gagaaaatgttgttatgtggtttgtatgctacttttggggacagagctcattcagcagcctaatctcctcctttggataattgttaatataataatgatggtga

SEQ ID NO: 2390 - DNA, 105 bp, Homo sapiens
cgaagaggagatattttttaagaagcgtaaattattttcagttgttttctgatcctgcctttttcttttcccacaacttcaaggcagtgtattcggtcaacaaca

SEQ ID NO: 2391 - DNA, 212 bp, Homo sapiens
caaacaacaaagcataatatttcgcccactaagccaatcactttattgactcctagccgcagacctcctcattctaacctgaatcggaggacaaccagtaagctacccttttaccatcattggacaagtagcatccgtactatactacacaacaatcctaatcctaataccaactatctccctaattgaaaacaaaatactcaaatgggcct

SEQ ID NO: 2392 - DNA, 313 bp, Homo sapiens
tgagaagccatgagcagcaaagtctctcgcgacaccctgtacgaggcggtgcgggaagtcctgcacgggaaccagcgcaagcgccgcaagttcctggagacggtggagttgcagatcagcttgaagaactatgatccccagaaggacaagcgtttctcgggcaccgtcaggcttaagtccactccccgccctaagttctctgtgtgtgtcctgggggaccagcagctactttagacgagtgctaaggccgtggatatcccccacatggacatcgaggctgctagaaaaattctcaacaagtataaaaattctg

SEQ ID NO: 2393 - DNA, 157 bp, Homo sapiens
agagtaagataggattcagtgcgcaaaatttgcttttgatgcttattaagagtaaacccatgaatttgaatttttatattatgcttggtacttggaattgatatataccctattaaagcttgaaaacaattagcatttgaatagtaagtttcatcac

SEQ ID NO: 2394 - DNA, 148 bp, Homo sapiens
caaaaatcaagaggcttccttggggatgaagacccccgaggccccggcccattctgaaaagccccggcgaaggcagcacgttgcagaaacctcggaggccaggcccttcccggggtaagttccggtagggtttaacagtccaattttt

SEQ ID NO: 2395 - DNA, 186 bp, Homo sapiens
gaggcgccatcatgggagtggacatccgccataacaaggaccgaaaggttcggcgcaaggagcccaagagccaggatatctaccttaggctgttggtcaagttatacaggtttctggccagaagaaccaacttcacattcaaccaggttgttttgaagaggttgtttattagttgcaccaaccggg

SEQ ID NO: 2396 - DNA, 184 bp, Homo sapiens
tcgtcggaatccttgccgtgttctacagttttaaccaggctcaaaagaaccctactggaattctactggacaggagtacaggccctggccttccgcctaagagaccgtaacctgcgccgccgctcaacaagccgggagccctaaggaccagaggcagccgcaggagggcgcgtctttccctctg

SEQ ID NO: 2397 - DNA, 292 bp, Homo sapiens
ccgagtcgtccggaaatccattgcccgtgttctcacagttattaaccaagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaaaaaaaaaa

SEQ ID NO: 2398 - DNA, 189 bp, Homo sapiens
ctcgtgccgaattcggcacgaggtgctcctggacttcaccgggggcagcttcagcctcctgcagatgttcctccagtcctacaacagcggccaagttggaccggttggatcttcggagaccaaccaggttggacttgggtcttctccattgtcttggaggtggtcttcttatatccagcacttcttttt

SEQ ID NO: 2399 - DNA, 188 bp, Homo sapiens
ggcaagtcactcaccctctctgagcctcagtgtcctactctgtaaaatgaacccaccaatggtacttatttcctagggcaaatgtgaggattgacagataaaacatgtaaacttcatgaaagcaaggggttttgttattgatttatccccccttgcagttccttggacatataaggcacttaattaat

SEQ ID NO: 2400 - DNA, 230 bp, Homo sapiens
ggaccgtcaggagaaaatggccagatgatgagctgcacatgtcttgggaacggaaaaggagaattcaagtgtgaccctcatgaggcaacgtgttatgatgatgggaagacataccacgtaggagaacagttgcagaaggaatatctcggtgccatttgtctcctcgcacatactttgaggcagcggggcttgcgctgtgtacaacttccgcagagctctggggtgtaacc

SEQ ID NO: 2401 - DNA, 300 bp, Homo sapiens
gggagactgttctgagactctacctacatctcattgattagatcagcgagggtcacatgccactcctagttaaaaaggagctgggaaagttagtgttctgggttttcttccagctagcatgagaataactattagctgtgtgggaggaagctgtccacacatagtttccacagccacaggccgatttcccaaaccctgaagcctcctccacccatcgctcactagtgatgctggcactcccagagagcaggtcctctccctgctgtcagttagtgatcaagatggttgtgacgccacgct

SEQ ID NO: 2402 - DNA, 350 bp, Homo sapiens
tgacacccccgtggattatttttatgatcacatcaaatttaaacaatgtccaaagtgtaactttaatgttatattttgtttcaaaccctctggtctaagattattgagaaagatgttttttcctcctccctcaaatatgttatctcttcatatataaaaaaataagttattccatgcttttcaggaactgtaaaaattatttcaaaaagatatttgaaaaagttttctctattctggacacaaatgcttccatttatttcaaaagaagaagaagaaaaatggaatcttaatttaaaaaaatatatgtagtagtatctgctatgagatattcagtctctataaaaaaaaaa

SEQ ID NO: 2403 - DNA, 180 bp, Homo sapiens
caatcatgaaccaggaaaaactcgccaaactgcaggcacaagtgcgcattggtgggaaggactgctcgcagaaagaagaaggtggttcatagacagccacagcagattgacaaaaaacttcagttctccttaaagaggtaggggtaaacaatatctctggtattgaggaggtgaatatgt

SEQ ID NO: 2404 - DNA, 240 bp, Homo sapiens
cttcctcattatcagaaattaaagaaatttctgaataaattggcagaagaacgcagacagaagaaggaaacttaagatgtgcaaggagatttaattgatttcaaagaaaataattggtcttttgtttttaatgttaacctttttaaatacaatacttatagtatgaaggaaccattttactctctttgttttagtggagagataatatatgtctcttcacatgtgtaagtgttatatgcg

SEQ ID NO: 2405 - DNA, 220 bp, Homo sapiens
ggtctgggcgcgtgcagaatggcactcgaaggggaggaaagaggagacaagtctcagcctcggacctcaagtggctgaaggagagaatgtatttggtgtctgcctatctttgcatccttcaatgccaatttgtccaagtcacatgatctttctggcgaggaaaccatctgccgtgtgcatagtggggtgaaggtaaagccgaccgagatggatcctcacc

SEQ ID NO: 2406 - DNA, 158 bp, Homo sapiens
gccattaggaccaatgaaagcaaagtacctcatcccctcagtgactaagaatcgcagtatttaaggagggtaggcagggaatggggctggaggagtgggtgtttggcttttctcccacccaggaggggcacactttcatctaaatttgggggatcact

SEQ ID NO: 2407 - DNA, 418 bp, Homo sapiens
tgacaggggtgtagtcggtgaaccgggtccaaagggtgaacagggtgcctctggtgaagaaggtgaagcaggagaaagggggggaacttgggagatatagggattacctgggcccaaaggatcgtcagggtaatcctgggggaacctgggctttgagagggccctgagggaagtcgggggctttctggagtggaaggaccaagaggaccacctcgaccccggggtgtgcagggagaacagggtgccaccggcctgtctcgtgtccagggccctccgggtagagcaccgacagatcagcacattaagcaggtttgcatgagagtcatacaagaacattttgctgagatggctgccagtcttaagcgtccagactcaggtgccactgggcttctggaaggcctggccctcctggtccccc

SEQ ID NO: 2408 - DNA, 280 bp, Homo sapiens
caagaccgcagtgcagagtgaaggtcaagctgttgcagcgcagatttcctccctgctgaggtttgccgccggtgaagatgggagctacgaagtgaagagtgtcctcggaaaggaagtggggttgttaaattgttttgtcccagtccctaaaccgcccacccgaccagctgtcattgggattggagggaaatgcagcttctcagtacaggagggggtctctacgacaacactgtgcgcttccgccgaatctctcaactctacaatatggcttcaggggtgg

SEQ ID NO: 2409 - DNA, 196 bp, Homo sapiens
ttgacttagaatcttcccttttttactccattcaagagcagcattcataaatttccagttccacaggcttgtaaaggaagcatgacttgggcaggccttaggaaacttacagttgattggcaaaaggcacagggggaagcaggcccattccttcatgtcttggggcaggaggaagagagttaaggaggaggttcta

SEQ ID NO: 2410 - DNA, 288 bp, Homo sapiens
gtcgcacgcgtgagacttctccgccgcagacgccgccgcgatgcgctacgtcgcctcctaccttctggcttgcctagggggcaacttcttccccaagcgccaggacaataaggaggtctttgacaaccttggtattcgagccgaccgcggcccgctcttacaaaggttatcacagtagccctgatttggaaaaacacatttagagcgtgtcattccccagggatatggcacacgctccagagtatccctcctggtggcgctatagccgtctcttctcccagagtctct

SEQ ID NO: 2411 - DNA, 291 bp, Homo sapiens
atcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcgcgattttaaggctgcagctgagagctccagctgtaagccaaggctagaggccgcgattagagctcgcaatgggcatatggctctcctctcaga

SEQ ID NO: 2412 - DNA, 134 bp, Homo sapiens
accctcggaggagccgcccagcacagcccacttagaagagcttcaggacgcacccaggacgcttagcccaggagccttccaaggcttacggtcaattccacccagacgggttttcccttttttgtgcttttttg

SEQ ID NO: 2413 - DNA, 158 bp, Homo sapiens
tcaggttgtacaagccaatcaatgtggggtattaacactccatgggcacacttggtcaatgggatgtggggagccaatagatacatgcttccttttttttttcacctcagactgtcaagtcttgagtacattcatatacctgtaggccactatgggcc

SEQ ID NO: 2414 - DNA, 524 bp, Homo sapiens
tcaggttgtacaagccaatcaatgtggagtatttaacactccatggggcacactttggtcaatgggatgtgggagccaatagatacatgcttccttttttttttcacctcagactgtcagtcttgagatacatttcatatacctgtagccaactaatgggccagctattgcagcactttatattggctctctgtcttttttggttatgctgctctgtccttctacaccttgcagaagtattcatgcataaaccttctcagactgccctggtcctcacaacaaagaattatagagcctggcatgtcagttgtgctgaggttgagaaactggtatctgaagtcaatgatttgctttaaaatccaggctcttcagtatttaatgtctatgatttgaattaagaccattgagtcttaatttttgtctctataaaatagtcatgataaataaatacaaacagagtccttaaggattaaatgaggtaagtttgataaacttaatgcctagaacatagaagagttcaacaa

SEQ ID NO: 2415 - DNA, 240 bp, Homo sapiens
attgacaggagactcaaagctggatatgtattctagggccaaggtatatcaccactacctttcggataaaattcaagttaggtgggaagggcaggcaacctttaggaatttttatattccttaattgtcacagacccctgggtattataacatctccccaagggttcacatacattagggaccatgtaattttttaaatttgaagggtgagtaggtgatattattctgggagtcattgta

SEQ ID NO: 2416 - DNA, 432 bp, Homo sapiens
attgacaggagactcaaagctggatatgtattctagggccaaggtatatcaccactacctttcgataaaatcagttagtgggaaggcagacacctttagaattttatatttcttaatgtcacagaccctggtattatacatctccccaagggtacacatacattaggaaacatgtattttttaaaattgaaaggtgagtagtgatattattctttgagttcattgtgaagtgttattttcttttggggttccattctgctttgttttaaggcatggactagaaacagttgaaaagaataatatacaatttcaactttggagcctgaaatattctggctataatttttttttcctaaaaaaagggagaacaaggagagctatataaaatctctgaaatgttttgtcaactagaggcagaaataaaaaaaaaaa

SEQ ID NO: 2417 - DNA, 150 bp, Homo sapiens
attgacatcaagaaggttggtgaagcaggcgtcggagggccccttcaagggcattctgggctacactgtagcaccaggtggtcttctctgacttcaacagcggacacccacttctctcaccttcgacgcttgggcttgcattgcccttaa

SEQ ID NO: 2418 - DNA, 159 bp, Homo sapiens
ggtcggaaagctatcataatctttgttcccgttcctcaactgaatcttccagaaatccaagtccggctagtacgcgaattggagaaaaagttcaatgggaagcatgtcgtctttatcggtcaaaggagaatcttgcctaagccaactcgaaaaagccgt

SEQ ID NO: 2419 - DNA, 115 bp, Homo sapiens
ccgcaagttggggcctgcgcctggggatacaatcattcactctttggggacgtgaaggagcttaatcacttgatgaggtttgtaaaggcaggaggtccctgggcctaatcccaag

SEQ ID NO: 2420 - DNA, 217 bp, Homo sapiens
gcagagtcctaaagaaggaacccactgaaaaacttggagaatcatgttgagctaaaccatatgcaaagaccatgcgccggaaccaccattcttccgccaggccaggaattcacaggctccgggtggattaaggcagcttgctgaagcagcggcacttaaagccaattcagttgagagggcggcgttgcaggaaagaggcttgtggtaaggtaagaag

SEQ ID NO: 2421 - DNA, 158 bp, Homo sapiens
tttaagtgcctattttgatgacttttgaaaaatgtgtacacccttgtaaccatcaccaaatcaaggacaatttgcaccacctagaaaagctcttctcttggcccccttccagtgttgtcttaagtccacaaggaacctgctttcttgacatcatccat

SEQ ID NO: 2422 - DNA, 539 bp, Homo sapiens
tttaagtgcctattttgatgacttttgaaaaatgtgtacacccttgtaaccatcaccaaaatcaagacatttgcaccacctagaaaagctctctcttgccccctccagtgtgtctcagtccacaacggacctgctttctgacatcatccatgagatttctttttgagagtttcatatataagaaattacatggtatatgtactctttttgactcaacataatgtttttgagatccatccatgtgctgtgtgtagagacagttcatgctttgtattgctaagtggtatcccatggtgtaggttgtaccacagggcgtcttccattcactgtggatggacatttgggttgttaccagtctgggggcttttaagaataaggctgctgtgagcattaaagtacaagtattggtggaaacgtatatttttatatatttcatttcacttggctaaatacctatgatacctataaccttgccaacttttttatacagttaaacatatacttaaccgtcttccctaagagtggatataagagtctgt

SEQ ID NO: 2423 - DNA, 101 bp, Homo sapiens
caagacctcccgcctgcccatcatcgatgtggcccccttggacgttggtgcccagaccaggaattcggcttcgacgttggccctgtctgcttcctgtaaat

SEQ ID NO: 2424 - DNA, 222 bp, Homo sapiens
aaataaaaggattctaaagtttgatgcattggaaaatttcttgaggcattagcaacacataggcaaatggcttttgattcttttccaaaacttttaggccataagggtcttttataagacagggatagtaaaatgaaaattgagaaatataagatgaaaaggaatggtaaaaatatcttttagggggcttttaattgggtaatctgaaatctcgggagagct

SEQ ID NO: 2425 - DNA, 550 bp, Homo sapiens
ggaaaataaaaaggattctaaaagtttgatgcattggaaaaatttccttgaggcatttagcaacacatagaaaatgggctttgattcttttccaaaacttttagccatagggtcttttatagacagggatagtaaaatgaaaattgagaaatataagatgaaaaggaatggtaaaaatatcttttagggggcttttaattggtgatctgaaatcttgggagaagctgttcttttcaggcctgaggtgctcttgactgtcgcctgcgcactgtgtaccccgagcaacattctaagggtgtgctttcgccttggctaactcctttgacctcattcttcatatagtagtctaggaaaaagttgcaggtaatttaaactgtctagtggtacatagtaactgaatttctattcctatgagaaatgagaattatttatttgccatcaacacattttatactttgcatctccaaatttattgcggcgagacttgtccattgtgaaagttagagaacattatgtttgtatcatttccttcataaaacctcaagagcat

SEQ ID NO: 2426 - DNA, 306 bp, Homo sapiens
ggcaagatggcagtgcaaatatccaagaagaggaagtttgtcgctgatggcatcttcaaagctgaactgaatgagttttctttactcggggagcttggctgaagatgggctactctggagtttgaggtgcgagtttacacccacccagggacagaaatcattatcttagccaccagaacacagaatgttctgtgtgagaagggcccgcggattcgggcactgactgctgtagttcagagaggtttcgctttcagagggcagtgtagagctttatgctgaaaaggtcgccactagaggtctgtgtgc

SEQ ID NO: 2427 - DNA, 341 bp, Homo sapiens
gaagccggtggggccttcggaaagagagagcaggctgaagaggaacgatatttccgagcacagagtagagaacaactggcagctttgaaaaaacaccatgaagaagaaatcgttcatcataagaaggagattgagcgctctgcagaaagaaattgagcgccataagcagaagatcaaaatgctaaaacatgatgattaagttcacaccgtgtgccatagaatggcacatgtcattgcccacttctgtgtagacataggttctcgtgtaactaatatttgtctgtgtgctactaacagattataataaattgtcatcagtgaaaaaaaaaaaaaaaaaaaaa

SEQ ID NO: 2428 - DNA, 319 bp, Homo sapiens
cgtacccaaagtctcgcttctgccgaggtgtccctgatgccaagattcgcatttttgacctggggcggaaaaaaggcaaaagtgggatgagtttccgcttttgtggccacatggtgtcagatgaatatggagcagctgtcctctgaaggccctgggaggctgcccgaatttgtgccaataagtacatggtaaaaagttgtgggcaaagatgggcttacatatacgggtgcggctccaccccttacacgtcatacgcatcaacaagatgttgtgctgtgctggggctgacaggctccacacaggcatgcgaggtgccttt

SEQ ID NO: 2429 - DNA, 304 bp, Homo sapiens
ggaataagatgtaatttgctgagatagttctacaggccaggtatgatgtcccagagaggaaagtgacctacccaaggcccacatacatagaaattggcagtgctaagtctcaaacggacaatggggggctctaccctacactttccggcttccagtattgtgggaaaatggccaggggatcacaattttccaactcttgcgggaagccactaggatcctccttgagtcaagcccatggcactaaatagacccaggaatgacactctcctcggaacttttggcctcgaacatatttacacagctc

SEQ ID NO: 2430 - DNA, 543 bp, Homo sapiens
ggaataagatgtaatttgctgagatagttctacaggccaggtatgatgtccccagagaggaaagtgacctacccaaggccacatacatagaaaatggcagtgctaagtctcaaacggacaatgggggctctaacctacactttccggcttccagtattgtggaaaaatggccaggggatcacaattttccaactcttgcgggaagccactaggatcctccttgagtcaagcccatggcactaaatagaccccaggaatgacactctcctgggaacttttggcctggaacatatttacacagctccggaggggatgaaaatatcccaacccactccctacagactcaaattagcaattttcttattctttataacccctctggaaattccaactatgtaatattagtctaaaattaggagtgtaagtcacaagagaaaagtcccactacttggggagagaatgtttttgtagcctcatcctgagcatgtgttctaaatcagaacacagcagttgtctttcaaatactgtttttttctcctaatc

SEQ ID NO: 2431 - DNA, 127 bp, Homo sapiens
ctcgtgccgattcggcacgagccccaggaggcggagtttgcagtgagccgagatcacaccactgcactcccatcccagcctgggtgacagggtgagattctgtctcaaagtaaaaaaaaaaaaaaac

SEQ ID NO: 2432 - DNA, 302 bp, Homo sapiens
gccgctgtggctctaaggcctaccaccttcagaagtcgacctgtggcaaatgtggctaccctgccaagcgcaagagaaagtataactggagtaccaaggctaaaagacgaaataccaccggaactggtcgaatgaggcacctaaaaattgtataccgcagattcaggcatggattccgtgaaggaacaacacctaaacccaagagggcagctgttgcagcatccagtttcatcttaagaatgtcaacgattagtcatgcaataaatgttctggttttaaaaaaaaaaaaaaactcggggagt

SEQ ID NO: 2433 - DNA, 319 bp, Homo sapiens
tgatgccaagaatgcatgtgatcacctatcgggattcaatgtttgtaacagataccttgtggttttgtactataatgccaacagggcatttcagaagatggacacaaagaagaaggaggaacagttgaagcttctcaaggagaataaggcatcaacacagatccaccaaaataaatgttttctacattttcatttggactaaatcccacgattgacaactaccacctttttttcctttttaattaatactaaatattgtgatttcttatttgaggtcaaaatgacctccttgaaactttgatacatattggaatacatt

SEQ ID NO: 2434 - DNA, 469 bp, Homo sapiens
cacacatgtgaacgatggcactgaatttggaggttctatctaccagaaggtgaatgagaagattgaaacatccataaaccttgcttggacagctgggagtaacaacacccgttttggcattgctgctaagtacatgctggattgtagaacttctctctctgagtcaaattgactttatcagctttaatcgatgggaagaacttcagtgtcaggaggtcacaaggttggcttgggatttgaactggaagcttaatgtggtttgaggaaagcatcagatttgtccctggaagtgaagagaaatgaacccactatgttttggccttaaaattcttctgtgaaatttcaaaagtgtgaactttttattcttcaaagaattgtaatcctccccacactgaagtctaggggtgcgaatccctcctgagggagatgcttgaggcatgcctggaagttgtcatgtttgtgcacgttt

SEQ ID NO: 2435 - DNA, 335 bp, Homo sapiens
gcgacctgcgactccttgacgttgacaatcgagtagtactcccgattgaagccccattcgtataataattacatcacaagacgtcttgcactcatgagctgtccccacattaggcttaaaaacagatgcaattcccggacgtctaaaccaaaccactttcaccgcttacacgacccggggtatactacggtcaatgctctgaaatctgtggagcaaaccacagttttcatgcccatcgtcctagaattaattcccctaaaaatctttgaaatagggcccgtatttaccctatagcaccccctctaccccctctagagccaaaaaaaaaaaaaaaa

SEQ ID NO: 2436 - DNA, 166 bp, Homo sapiens
cacgcaacatgatgtcactgtgcctgccgcctcggtccacttgcggccgtgtttgactccactcagctccttttacgcttatatttccggccaaatccctgcttgggttttgtcttttaccttgttcgcttgccatccccattaaggtttaaagtctaaaaaaaaa

SEQ ID NO: 2437 - DNA, 159 bp, Homo sapiens
acagaaaagccaagcctcctcactgttgtaaaggaaagccctgcgtggctgtgagggagacgcgtgttgaacctacattgtcgtgttagcgcccttttgagaacccccttgtgggctttttgagacttaaaccggggacaaggcttagagggtttttca

SEQ ID NO: 2438 - DNA, 549 bp, Homo sapiens
acagaaaagccaagcctcctcactgttgtaaaggaaagccctgcgtggctgtgagggagacgcgtgtggaacctcatgtcgtgtggcgccgttggggacccgttgggctcttgagactgaaccgggacaggctgagaggctctccaggacacttccgggcagcaggccccctctggctgtgcttgaccctggcccctgggccctcttggttcaccaagtctcccacgtcctatgctcttgagatcccagactcggcactggatggggtggccctgggtcccactgctgttccagagcactggcccttcctttcggccactcagggtagaggctggagcccctggaatcacacagaaggggcctggctgaagcacaaagggtggagatctggggttaagccagagcctggggccccctgagcccaggggctgggcagctggggaagcaaggagagccaggtgtcactgagtcagtccctcccatgcaggtacttgggggtgtgaggggccgcccccgggcttcctctctcaaccctacggcctcttccgg

SEQ ID NO: 2439 - DNA, 191 bp, Homo sapiens
attagctagaactgctctgttgaaatctacttcccaaacccccacatgtgctaccaattcctcatttcctcaggttcttttcaatttcctgggaggcgggaaggcttaatccaggtggtgtcaacccaccctgaatttaggtatattttgggaaaatctctaaaactcttgggccaaaaaataaaatctct

SEQ ID NO: 2440 - DNA, 540 bp, Homo sapiens
attagctagaactgctctgttgaaatctacttcccaaacccccacatgtgctaccaattcctcattcctcagttctttcattcctggaagcggaaagcttattcagatgtgtcatcctactgtatttaagatattttggataatatcttaaatcttggtcaaaaataaaattcttcatttttaagcatgctttgtagccagctgtttatttctgtgacctcccttttccttctcagtcacagcccttaaggcaatgtcctaacctcctggtgttttgttatctgctctgggttaatcacgtaacagtagtggtggcttctctaaaaagctgaaggttcttattcttttcccttgagattgcacacattcatctgctaaaagataaggggaggaaaaaaactgttaaaatgttatgtgggattagataaactataaatttatttccagttcaaaaattgattttatataatgaatataagagggacctgtgaatttgtgtttaaatactctcacactatacagctttaaaaaaaaaaaaaa

SEQ ID NO: 2441 - DNA, 223 bp, Homo sapiens
gcgcaacagcatggcttttaaggataccggaaaacaaccgtagagccggagtcgcaattcaccgaattctgaattaaccttacaaaggccggaacgtaaaattcctttggaaaggtgtgttctgaatttataaggagcgcaaaagaaaaggatctctaaagtgtaaagggcccattcggatgtctctccagagctttgtgagactcatctacgagaaaactcc

SEQ ID NO: 2442 - DNA, 253 bp, Homo sapiens
cttaggcgcagacggggaagcggagccaacatgccagtggcccggagcttggtttgtcgcaaaacttatgtgacccccccggagaccccttcgagaaaatctcgtctcgaccaagagctgaagctgatcggcgagtatgggctcccgaacaaacgtgaggtcttgagggtcaaatttaccctgcccaagacccccaaggccgccccggaactcctgacgctttatgagaaggacccccggcgtcttttctaag

SEQ ID NO: 2443 - DNA, 229 bp, Homo sapiens
catgacataagatgtgtctttattcagctcgtcgtgaagatgctgctgctgaatgggtcagcatatctctgtttgcatggtttgcaggaggtcggttttcatggtcattcagttccacagatcttaatgattactgtctgtctgtgtcttttttccatgagaaatcactgttgcaaattgcctctaaattgactctactaaaataacaatgtttcagtctgaaaatttg

SEQ ID NO: 2444 - DNA, 194 bp, Homo sapiens
ctgggacctgcctcaggccccctacccacctctgccatgcctaggaatcccacccctgtgtgaatgggactccctttcctccatgtgacaaccacaggggtccatgacccatctaggggactttatagcagttgggtgggaggggaattctcttaatttatcaataaaatattttcagaggggaaaaaaaaaaa

SEQ ID NO: 2445 - DNA, 233 bp, Homo sapiens
gctgcgtgcctatagtcccaactgctcaggagaattaggtgagaggatcggctgagacgatcctcccactctggttcactcctctcaggctagactctctctccctttcattggcttgtcttagctattaataaggaggctcggcccggcgcgggttgctcacacatgttaattccagcacttttggggggcccggacgggtggatcacgaggtcaggagatcgagaccatcc

SEQ ID NO: 2446 - DNA, 166 bp, Homo sapiens
ttagcaccagaacacagatgtcttggtagaggccgcggtttggactactctgagtcagagaggttgctttcagaggcagttagacttatctaaaggtgccctgaggcctttttccattccaagcgagcttcgataaccccatgaggccttcttcggggcctcattg

SEQ ID NO: 2447 - DNA, 546 bp, Homo sapiens
cttagccaccagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaaccaaagatgagatactgcccacaccccatctcagaacagaagggtgggaagccagagcc

SEQ ID NO: 2448 - DNA, 232 bp, Homo sapiens
ttttctttcacgtacatccatcatttgcaactgctgttcgtacacagaaacaggactgctcaaatgatcctatttgtattttctgatgctatcagactctaatgtttttttccctaaaatattattgccatcatgctttagggattttatattttttcacaatcatattttggtattgggtctgtgttatgtgaactctgtacctgcttgggaaagggttgaactctccaat

SEQ ID NO: 2449 - DNA, 278 bp, Homo sapiens
gccctgttaggctaagtggatagttgctgttggcagcactttgcagaattgaccaaagccttgcctgcaaggtcccctttccctcccactttaccacccatagaggggttcaaggtgcacttgagttcaactcagggggatacccttcctaagggggctctcaggatatatgaggggtggatatagagtgagagcatcccatgatataggttgggggttttcacagaaggctctcctagcgctagacgacgcaaagacatcccgagacaggcggcaca

SEQ ID NO: 2450 - DNA, 541 bp, Homo sapiens
gccctgttaggctaagtggatagttgctgttggcagcactttgcagaaattgacccaaagccttgcctgcaaggcccccttccctcccactctaccacccatagagggttcaagtgcactgagtttcactcaggagaataccttcctaaggggtctcaggtatatgaaggtgggatagagtagagcattccatgaataggtgggggttttccagaagtcttctgaagctagacaagcaaagacatcccaagacaggagcacaagcaagggttcaaatcactgtagtcgggatcttcccaaatttactgcagaaaccagtctaattttgttttttcctaaaagccactttcctcttctctcttcctttggaatttccatatattagcattaattcatttattctttgagaggaaggaaaaattgggaagtctaaatggaagctgaaatcttctgagcatttgctttctaacttgtagaggctaaaattagaccttggaaaaggttagttttcttctctttacacccctttttagagtgtgag

SEQ ID NO: 2451 - DNA, 263 bp, Homo sapiens
cggcacgagccggaagacaagtcctgaatctgtgcccataatctctgtcagtctgctgtttgcaggcgtcattgctgctagaatcggtctttggtcctttgatttaactgtgaacacagttgctgcaggaaatggtaattgaatctgaaagaggctattataattggtgtcacagacttccatgaactatctcctggatcttctgcattcatcatggtcatcctggctccaaatcctgaagcttttggctcgctcgtatagat

SEQ ID NO: 2452 - DNA, 183 bp, Homo sapiens
gaagacctcacgcctccccatcattgacattgcacccatggacataggagggccgagcaggaattcggtgtggacatagggccggtcttgcttcttggtaaaaaccttgaacccaagaaacaacacaattccgttggcaaacccaaagaccccaggttactttccaatctagttcattttagg

SEQ ID NO: 2453 - DNA, 209 bp, Homo sapiens
ggctcatgtagcctcactggagggcattgcccggaagatcaagtcgtgctctggcaggcgcgccccttggaggatgaggccactcttggccagttccggggtgggaggccctgactacccttgaagtagcaggccgcattgcttggaaggaaagtccatggtttcctggcccgtccttgaaaaggtagagagtcaacattctagggtgc

SEQ ID NO: 2454 - DNA, 198 bp, Homo sapiens
ggctaatgtaggaaatggtagcagttcataaacactacttattgttcatcacttcagatgtcactaggcttatgtaaattgaaaccgagatatttttcctttcttctgtgtgaaggtcaaggccatttttttcttcttaacattattaggcatcccagaggtggtattcagcattttgaaagccagcagggccctctt

SEQ ID NO: 2455 - DNA, 183 bp, Homo sapiens
ctcgtgcgaattcggcacgagggtctgaggttatcaataagctcctagtccagacgccatgggtcatttcaccagaggaggacaagcctactatcacaagcctttggggcaaggttgaattttggaagatgctggaggagaaacccttggaaaggctccctggttgtcttaccattgacccaa

SEQ ID NO: 2456 - DNA, 186 bp, Homo sapiens
cctgaacgggcagcactcccttattttccccgcagatatggtgcccatgccagcctccgctataacccccgaggaaccgccaggctctattgccttggatgatgggctaccagattgtcctataaggctggagatgagggaggaaggagggaggaggtttgaggagctaggccttgtttttgggca

SEQ ID NO: 2457 - DNA, 181 bp, Homo sapiens
ccaacatgggccgcgttcgcaccaaaaccgtgaagaaggcggcccggtcatcatagaaaagtactacacgcgccttggcaacgacttccacaacgaacaagcgcgtgttcgaggagatcgccattatccccagccaaaaaggttccgcaccagataggcaggtattctaaggaattctatg

SEQ ID NO: 2458 - DNA, 199 bp, Homo sapiens
catcaatggaaatccatcaccatcttccaggagcgagatcctcaaatcagtgggcgatgctggcgctgagtacgtcgtggagtccactggcgtcttcaccaccatggagaaggctggggctcatttgcaggggggagccaaaagggtcatcatctctgcccctctgctgatgccccatgttcgtcaagggtgtgaccct

SEQ ID NO: 2459 - DNA, 300 bp, Homo sapiens
gtggaatagaaaggggggaaaggtggggaaaagattgagaaatcggatggttgccgtgtctgtctagaaagaagtagacatgggagactttcatttgttctgtactaagaaaaattcttctgccttggatcctgttgatctgtgaccttaccccaaccctgtgctttttgtaaccatgtgctgtgtccactctaggggtcaattgagttaagggcggtgcaagatgtgctttgtttaaacagatgcttttagggagcatgctctctgatgagtcatcatcactctcattatatggagccc

SEQ ID NO: 2460 - DNA, 140 bp, Homo sapiens
ctagatagcaccccgtggcattacataacacttcatgagtgctgtgtcttgtaatttttgggacaggtttctcttccttccccctcttttttttgttcaaaagcccagagactgacaaccagctgcagtgtctaagtgtt

SEQ ID NO: 2461 - DNA, 105 bp, Homo sapiens
caaatcctgaagcatccttggccaaccgcaacagcattggtgagcagaggcatgacaaggaacatagggaggccagttttggcacttggaattcaattcctcaga

SEQ ID NO: 2462 - DNA, 125 bp, Homo sapiens
ctgaatctcccctcctcacagttgccatgtagaccccttgaagaggggaggggctagggagccgcaccttgtcatgtaccatccaataaagtgaccctgttcttcaacccaaaaaaaaaaaaaaa

SEQ ID NO: 2463 - DNA, 145 bp, Homo sapiens
caaggaaggtgcttgtttcaacagtacaaactgggatgctacagagaagattcggatggccctgtgcaaggattgacacccaagtttgtgaagcacttcatatatggaggggaaaacatttaaaggcacaaggggggggctttgc

SEQ ID NO: 2464 - DNA, 180 bp, Homo sapiens
tgcattcttagaccacacccagaaaattatgtttcgtttgagattatgcaatttaaggatgttgacaaatctgaatgcatgcaaagaaaaatggtaagggtgaagaaaacccaggaagactgctatatacggagaaagttgctaaaactttgagaggggttgtcttaaggagattatggg

SEQ ID NO: 2465 - DNA, 125 bp, Homo sapiens
cagccctgtcttcttggcgtgggttatatgtccgggatctcgatcagattctcggggctcagaaaccgtccggttgccattaggctacttgggggttagggagttcccaccattttatgtccaga

SEQ ID NO: 2466 - DNA, 110 bp, Homo sapiens
ggctgaacagacttcccgctgctgggtggggtgacatggtgatggcacagtcaaggaaggcaaaccaggagctcagaaaaagggtcatcccacaattggtcattcggaca

SEQ ID NO: 2467 - DNA, 200 bp, Homo sapiens
tacactcaaccatgacctcacccctccttggtttctccctcgatctgttgcctttttggatgtattcttatctaacaacacaatcccgaaagacttaattgaatawttatacttaatggtcatatcctttattgctcaatgatctaattaaaggggtcattgcccaattcatggttataattctaccattggttaggaac

SEQ ID NO: 2468 - DNA, 150 bp, Homo sapiens
tcatttgcagaacagaatgccagaaaagaagttaagcctagaaaggctcagaaatctcacaggtgtctttcaatcttttgctaaataataatctatgtatgcataggggtgaaacaacacccaggcaaatttaagaccaattaattccag

SEQ ID NO: 2469 - DNA, 546 bp, Homo sapiens
gtcatttgcagaacagaatgccagaaaagaagttaagcctagaaaggctccagaaatcctcacagggtgtctttcaatcttttgctaaataataatctatgtatgcatagagtgaaacaacaccaggcaaatttaagaacaattaattccagggggcagaaaaaaaggcataagaaaagaacaaaaaacatgggagaaataaaaaacaaatggcaagatggtcaatttaaacctaaccctatcaaaattacatcaagtataaatggtctaagcacttctaattaaaaggcagaaacttcagattggataaaaaagccacacccaaatatataacatccacaagaaaaccactttaaatataaagtaataggtaaaagcaaaagtatagagcagacataccactcaagcactagtcgttagattgctgaagcagctatataaatatagtagtctcccttatctgcaggggatacagtggatgcctaaaactttgaagagtgggcaggtgcgtggttcacacctataatcccagcattttgagaggcc

SEQ ID NO: 2470 - DNA, 139 bp, Homo sapiens
cagaagcgagatgacgaagggaacgtcatcgtttggaaagcgtcgcaataagacgcacacgttgtgccgccgctgttggctcttaaggcttaccaactttcagaaggttcgaactttttggcaaattgaggctaccctt

SEQ ID NO: 2471 - DNA, 176 bp, Homo sapiens
ggtgattgaaaaaaatcaacagctatctcattaaatgcatggcaagtaaatatatcttctgggccaaaaatagaccagaatttatctgcttacttgaatgtttggcaaaactttcctggaaacctgagttgatgtttgattggttaaggcttcttaaactttcctactaaatttac

SEQ ID NO: 2472 - DNA, 112 bp, Homo sapiens
tgattttgtaaagttgcctttattttgctgttaactgttaactattgacagtatattaagccttattaaaccaattcttaaaccaatattaaatcacaaaattcaggtttta

SEQ ID NO: 2473 - DNA, 111 bp, Homo sapiens
attcagtgaagttagaagcctgaaacttttctcgtattggcgttggtttgcattaaatcctggggtccattttacaatccaattatttttgaccattgctatgtgttcaag

SEQ ID NO: 2474 - DNA, 144 bp, Homo sapiens
ctcgtccaattcggcacagttgggaatgtagccgtcacgacaaccggagtcactcttgtcgccaatttgctttttgtgggatttggccgcttctttacttcaagctgttgtatcagcaaggtttttatgacctgtaccttgtag

SEQ ID NO: 2475 - DNA, 119 bp, Homo sapiens
gcctaccatgaacagctttctgtagcagagatcaccaatgcttgctttgagccagccaccagatggtgaaatgtgacccttggcattggtaaatacaatgcttgcttgcctgttgtacc

SEQ ID NO: 2476 - DNA, 144 bp, Homo sapiens
ggaagagaaagcgctagaggtttatgatttgattagaactatcccggaccagaaaagccaattactttagaaggaccttggaagtgtgtcttcggaaagtgttgtgtgtgaagttcagagagatataattgaagagaggaatat

SEQ ID NO: 2477 - DNA, 242 bp, Homo sapiens
gctttgtgaaatggccccgctatatcaggttgcagcggcagagagccatcctctataagcggctgagagtgcctcctgcgattaacccagtttcacccagggccctgggaccgccaaaacaagctactcagctgcttaagctggcccacaagtacagaccagagacaaagcaagagaggaggcagagactttttgcccgggccgagaagaaggctgctggcaaaggggacgtcccaacgaag

SEQ ID NO: 2478 - DNA, 257 bp, Homo sapiens
ccaacatgccatccagactgaggaagacccggaaacttaggggccacgtgagccacggccacggccatagcaagcaccggaagcaccccggcggcccgcggtaattctggtggtctgcatcaccaccggatcaacttcgacaaataccacccaggctactttgggaaagttggtatgaagcattaccacttaaagaggaccagagcttctccccaactgtcaaccttgacaaattgtggactttggtcagtgaacag

SEQ ID NO: 2479 - DNA, 230 bp, Homo sapiens
gtaaaaagaacaagaaagcaatgtatttacataaccacaaaaggccaggcgtggtggctaacgctgtatccagcactttgggaggttgaggtggacgtatcacctgagatcaagagttcgagaccagcctggccaacatggtgaaaccctgtttctactaataataaaaaattagctgggcatgggggcatgtccctataatcccagctactcaggaggctgaggcaggg

SEQ ID NO: 2480 - DNA, 205 bp, Homo sapiens
gttcacgtacactgccctgaaggatggctgcacgaaacataccggtaagtggggcaagactgttatcgagtaccggtcacagaagacctcacgcctcccccatcattgacattgcacccctggacatagggagggccccccgcaggaatttcggtgtggacatagggccggtctgcttcttgtaaaaacctgaccccagaaacaa

SEQ ID NO: 2481 - DNA, 125 bp, Homo sapiens
cttagttttcctttttttttaagaacttagtctttttccaaaagtcagtttattttgttgaacattttttctttgattggcagtttaggtattttaagaaggttgtcaagttttgcctttaccta

SEQ ID NO: 2482 - DNA, 618 bp, Homo sapiens
  misc_feature 106, 108, 120, 122, 125, 132, 136, 144, 145, 151, 156, 158,163, 168, 174, 181, 191, 208, 218, 232, 239, 248, 254, 256,264, 267, 269, 273, 284, 286, 288, 291, 294, 301, 315, 331,338, 348, 351, 364, 366, 371, 383, 392, 403, 415, 423: n = A,T,C or G
  misc_feature 425, 449, 452, 457, 468, 473, 486, 500, 502, 510, 513, 514,524, 536, 560, 597, 599, 608, 614, 617: n = A,T,C or G
ctaaagggaacaaaagctggagctcgcgcgcctgcaggtcgacactagtggatccaaagaattcggcacgagcttgagtttttttttttttttttaaagtaacggngncatttttaccananagnccatttngcangtaaaccnnggaaanatgtntngcccnaaatngggcantttaagncattttaaanaaagttagtccaaagtngtggcctttnaacccaaagccaancttcagnctttcaaanaaaaangngggatttncantnactngcggaaatttngnanttnggnaaccctngggggcattatccnaacggaaacgtaaacncttactnggaaattttnggncattaaattaaangngggcnaccggggaaatnggttaaatnagggggcttgncaaaggtttttnccaaaatngnaaagggccggcatttttaaaaaanccncattngcctttaggcnaaatngtaaaaaattatnttagaaggcaaaananatgttttnccnncaaaggcaanactttcccaagnatttcggatttcggggttgccagngggggatttttaacccggaatttggtttaaaaaaaancnggggggaanaaatgnggna

SEQ ID NO: 2483 - DNA, 208 bp, Homo sapiens
ctcatctttcttgatcaacatcttttcttgcctctgtccccttctctcatctcttagctccctccaacctcgggggcaagttgtgtgggagaagccacaaggcctgcagatttcatctgctcttccttcctgggagcccagaggagggcagcagaagggggtggtgtctccaaccccccagcactgaggaggacggggctcttctcat

SEQ ID NO: 2484 - DNA, 158 bp, Homo sapiens
ggggggttcagatgactctgctgaggagggggacctactgggatgatgatgataatgaagatcgggggatgacagctggagttgatcaaggatgatgaaaagaggcttaggaaggagaggatgacagacacagcgccaatgcagggctgactctcaag

SEQ ID NO: 2485 - DNA, 209 bp, Homo sapiens
gagaccatcggcagcacctacatggctgcctccggcttcaacgactctacctacgacaaggtgggcagaccacatcatgggcactggccgacttttggccatggaagctgattggaccacatgaaggtaacatcaattaaggcacttcttcaacaacttccagatgaagatcgggctcaacatcggccccgtggtggccggggtgatag

SEQ ID NO: 2486 - DNA, 236 bp, Homo sapiens
ccggaaagggaggcttgcccttccgcggtccgagaaccaccggcctccccagtttgagggctgttacccgtgcgcgcttcgacgtttgctgctgttgggctctcctcgcccctcgttcccttggaacccgccctgggaactccgccatgtcatccacttcgcccaacctccagaaagcgatagatctggctagcaaagcagcgcaagaagacaaggctgggactacgaggagccct

SEQ ID NO: 2487 - DNA, 222 bp, Homo sapiens
gtcagcatagccgcccacggtctgttctcagattcctaatcattccagaagtattaaacgtcattgctgcaacctcggcaggtgccttgttgaaggggcttaattgaccaccacagggaggctcagaccccaaccctgggatcccaggagaaaggagtggacccgaggaaggaaggaaggcaaggctgttttttccatccgtccgtctgtccacctaccttt

SEQ ID NO: 2488 - DNA, 183 bp, Homo sapiens
gtctcggtccttccgaggaagctaaggctgcgttggggtgaggccctcacttcatccggcgactagcaccgcgtcccggcaagcgccagccccttacaattcgccccgcggccaatggccttctgtcttccgagcctcgcctgcaaatcttacttcggcccctcaattcttgcaccgaccgat

SEQ ID NO: 2489 - DNA, 104 bp, Homo sapiens
ctcacagaatgttctccgctcccagacatgggtcccctggcttcctgcccttggatgcgcagagcaggcatcgtggttatggggatgatgcctccccaagggaa

SEQ ID NO: 2490 - DNA, 330 bp, Homo sapiens
  misc_feature 55: n = A,T,C or G
caggcagccgctctggctctagctccagctcgggacctctggacccccggacccngtgaccagcgcctcgcgctggagtggaggatgccttctacacgttggtgcgtgagatccggccagcacaagctcgggaagtgaaaccctcctgatgagagtggccccggctgcatgagctgcaagtgtgtgctctctgacgcaggtgagggggactccagggcggccgcacgccaccggatgaccccggctcccgcccttgccggtctctggctgcggtagagcctcctgtgcccgccagacaagtaaggcatgaggtgccgatcaggaggagtt

SEQ ID NO: 2491 - DNA, 131 bp, Homo sapiens
gaagacatccagttgctcgcggatacggggagagagagcttaagttaaggcagttttttatggcgtttgtagtaatctgtaaaatactttggtttaatttgtgacttttttttgtagaaattgtttataat

SEQ ID NO: 2492 - DNA, 140 bp, Homo sapiens
aatcaggacttgatggaattcacggtataaagccataagaaactgaagactcctaagtaccttccattgtctgatttttcaaaggctgtgacactcagacgagaagttcaaaaccaaaataattttaatttgtactgctt

SEQ ID NO: 2493 - DNA, 504 bp, Homo sapiens
aatcaggacttgatggaaattcacggtataaagccataagaaactgaagactcctaagtacccttcccattgtctgaatttttcaaaggctgtgacactcagacgagaagttcaaaaccaaaataatttttatttgtactgcttttaagaattcagaatgctattatgagacagaggaagcaggtagagttctgacctcctaagggaaaaggaggaattatgtcaccttttgcttcctttaccctactgagactcaatggtgaaatggaaacaagttaaaggattgttctttttatccttaaatgtcaaacgtggttgcatctcctaaagaaataatgcaactgattaattgtgtaatttcacagggaagcagtaattctcagccttataaacatgtaatgcactaatttggtttcagagttaactgaaacagtttaatgagctgctgtatcacgtgtgtgtacagtgttacatagagcagatgccaaaaaaaaaaaaaaaaaa

SEQ ID NO: 2494 - DNA, 125 bp, Homo sapiens
ggccactgcgcagaccagacttcgctcgtactcgtgcgcctcgcttcgcttttcctccgcaaccatgtctgacaaccgatatggctgagatcgagaaattcgataagtcgaaactgaaggagaca

SEQ ID NO: 2495 - DNA, 225 bp, Homo sapiens
cggcacgagtgtggctctaacagcccttatcactgtctgacttgcattaattatcagcatccatatctcttagatacaagctcacaaggagcagaatccatgtcacactcaatattgtttccccattgcttagcatagaggrttaagaatacttgggttaataacttactgaatcctgcaaacacagcattgctcacttcgaatctcacggcttccaacccgcat

SEQ ID NO: 2496 - DNA, 550 bp, Homo sapiens
cggcacgagtgtggctctaacagcccttatcactgtctgacttgcattaattatcagcatccataatctccttagattacaagctcacaagagcagaatccatgtcacactcaatattgtttccccattgcttagcatagaggattaaaaatacttgggtttaataactttactgaatcctgcaaacacagcatgctcacttcgaatctcacgtctccaacccgcatcaatccaaatcacactccaacctttcaggctcgattcaagcccacgcttccttagagtcctattagtctctttttctctaggaatcccaccctcctttcagtccacgcctcgtatttttgcacacagggaaaatacacatgagcgtatcatcgtttcctgtgtatgttttgtcaccaaagctatctgggaaaatattacgtattaatgtcattaattgcaattgataaaaaagcacatctacattcaaaaaaatttttaaatcattgttgtgagttttattagtcggtaatcttttactgcatgtatgaatgtactccacttt

SEQ ID NO: 2497 - DNA, 280 bp, Homo sapiens
gaagttcctcaaggttatacaattcctaacggacatgttagacatcaatctgtctttttacactgcacatcacattgcttgtattaaaaggcagattggagctactagagataagcagtgtgagaagagcagagttaatagctggtgtatacctcatggagagccaagcaattaaagtttaaacagcagataaacctttaaactatatttggacaaatttactcttctgtctttcatagttcccagattatttctattttgtaacaagctctatcttgag

SEQ ID NO: 2498 - DNA, 539 bp, Homo sapiens
gaaagttccctcaaaggttatacaattcctaacggacatgttagacatcaatctgtctttttccaactgcacatccacattgcttgtattaaaaggcagattggagctactagagataagcagtgtgagaagagcagagttaatagctggtgtatacctgatggagagccaagcaattaaagtttaaacagcaagaataaaacctttaaaactatatttggacaaatttaactctgctgtctttcatagttcccaagattatttctattttgtaaacaagctctatctttgagttttatattgatactcatatgaataatttattgagtgctttctatttaccggacactgtactaggtgtcttctgtacattcccattcaatataccagtcatttgagataattaccatttattattcccatattatagacaagaaaactgagacccagagaccttacactgctttgggattgaacccaagtctgatatcagaaactaaacttttaactgtgatggtgttctctggatcattctgtaa

SEQ ID NO: 2499 - DNA, 180 bp, Homo sapiens
gcgcgtgcgcggtgctggaccagtggctcacactgcccatctttgcatggcccgtgctggtgctctacctagaccgcggctggcggccctagctgttcctctctcttgagtgcgtctccctggccagttatggcttcgctctgctgcatccccagggcttcgaggtcgcactgggttctc

SEQ ID NO: 2500 - DNA, 190 bp, Homo sapiens
tccctgcctctgacctcaggtgtaagcggtggtggtatgactttggttacgatgagactctacaggctaccagcctcgctcagcaccttctctcagacccaaggactattaaggttgatgctactctgaagtctctcaacaaccagattgagacccttcttacttcctgaaggctctagaaaggacccag

SEQ ID NO: 2501 - DNA, 225 bp, Homo sapiens
ctaaggtatatctgaattttttcttcctttgaggcaggttcttgctttgttgtccaggctggagtacagtggcacgaccttggttcagtatagccctgatctactgggctcaggtgattctccctcagacctccagagcagttgcaaccgcagcacgtgccacctcacccagctaattttttattttttgtagaggtgaagtctcttcctgtgtggccaggctgg

SEQ ID NO: 2502 - DNA, 271 bp, Homo sapiens
gagaaatacatggaaaagtatagagggctacaagtgtgtaagaattatgcttttacaattgaagagaattgcaagccactctttcctttatatactcccagcatcagttacaattgtttttagtattcatgtactgcttctgcctcaatcacatgaatacaaatagtacatcctgatagcctactctgttcacccaatggcaaaaaataaatacaaagaaagacagccattaaatcatcaaataatagataaactagatatttcgactctt

SEQ ID NO: 2503 - DNA, 111 bp, Homo sapiens
  misc_feature 97: n = A,T,C or G
gtttggaactttaatagcgttgcaacgaaatgctatatccagtttcctgtaatttaattgaaggaaaatacattcaaataaagactttattattaanagaccagatagcat

SEQ ID NO: 2504 - DNA, 267 bp, Homo sapiens
gcgaattggcaccaaagcagcagctgtattgccgcagttctagcttcaccttcacgatgtttcccttggtcaaaagcgcactaaatcgtctccaagttcgaagcattcagcaaacaatggcaaggcagagcaccagaaacgtacacctgattttcatgacaaatacggtaatgctgtattagctagtggagccactttctgtattgttacatggacatatgtagcaacacaagtcgggatagaatggaacctgtccccttttggcag

SEQ ID NO: 2505 - DNA, 274 bp, Homo sapiens
tttctccttaattgcttaaggccggggagcaaagtgtcttaacttctgtctttgactttcccagcgttgagtcatcaacaatttgccaattagctcattggtctggcaacctcagaaaccccttaaggtttaaaaactttcttggtcccacgacccagaatgaaacagctttaaaatagccttaagcaaaaggatgttatttcattaaatttggtttaatggaaagataaagtaaatgaaaacacaccctacacactagactccgaacactggt

SEQ ID NO: 2506 - DNA, 223 bp, Homo sapiens
catggctcgtgggtcccaagaagcatctgaagcgggtcgcagctccaaagcattggatgctggataaattgacccgtgtgtttgcttctcgtccatccaccggtccccacaagttgagagagtgtctccccctcatcattttcctgaggacagacttaaggatgccctacagggatgaagtaaagaggtttcattcagcggttcattaaaatcgattgcaagg

SEQ ID NO: 2507 - DNA, 131 bp, Homo sapiens
ccctggtcctcgcggtcgcactcgtgatgctggtcctgttggtccccccgcccttcctggacctcctagtcccccttggtcctcccagccgcttggttcggacattaaacttcctccccaaccaccttaag

SEQ ID NO: 2508 - DNA, 162 bp, Homo sapiens
ctcgtgccttttttttcgctttgcaaggttttgatttgtttgacagcaggaattggcttgggagggtccccgcaagctggaccccttgttccgttcggcccgttaggagaacggaacttgcggccaaggggacccgcggaacgagatcaactggagccaact

SEQ ID NO: 2509 - DNA, 207 bp, Homo sapiens
aaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgatggtatcttaaagatgtcactttcacagacacagtgtgtcccatccccgcgttcacaatggtggtagt

SEQ ID NO: 2510 - DNA, 102 bp, Homo sapiens
tggagttttcaggggtgaggggaaagagtagtggctaagcatcgggattagtcttttttcccattggagctagggatctttgggtagtacttttggcttgta

SEQ ID NO: 2511 - DNA, 552 bp, Homo sapiens
agagaagccttttgaatgcagtgagtgtggcaaagctttctctcggaagtcacaccttataccacatcaaaggacacatacgggtgagaaaccctatggatgcagtgaatgtaggaaggccttctctcagaagtcacagctggttaatcatcagagaattcatacaggagagaagccttatcgatgcattgaatgtgggaaagctttctcacagaagtcacagctcatcaatcatcagagaactcatacagtaaaaaaatcctaggaatacagttaatagtagtctttgacagatcatcttggacttcaggaaatgcaattatgataacgtttgtagacagtcacgtcatgttaggtgtctgtactccatgaggatgagaactctaaatgaggtggtgtatggaaagccgatcataattcatagagtagagtgaacctatgactgcagtggatctcaaaaacttttaaaaccatagacaagccttatagagtagaacattcacagcaaagaagaatcctgtgaatgtccaaaagccttccagaagtcaagtc

SEQ ID NO: 2512 - DNA, 276 bp, Homo sapiens
gctcagagaccttgaaagccgttgtacgtttctaaaaaaacaataaagtataaccttctggtcatatcataaagagctcaagactttggtttccatatttcaaaatgtcttgggcagaatatattcaaaattttagccaagaccatagaatgttcacttactatatgcgtgtgtacgtttttaaagctaaaaaaattacttctagatccctagaatgaaactctttttttatctatgaattccatatggtcttttccaaatatctttcttcatttt

SEQ ID NO: 2513 - DNA, 107 bp, Homo sapiens
agcatgattttggttttaaatattagtccaagaactattaagaccggcaaatggaaacaggcaatgcgtggaccaaccgaaagcacgttgagctagcgaattttccg

SEQ ID NO: 2514 - DNA, 198 bp, Homo sapiens
aagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaaaaa

SEQ ID NO: 2515 - DNA, 100 bp, Homo sapiens
acggtcttcttcactcggcccgtccggggcttacactcggtcgtcccctggcccgtcctgcgttacccgaggagccgctccctaacgaagagccctttcc

SEQ ID NO: 2516 - DNA, 273 bp, Homo sapiens
ggttactatcgctttggacaggtttacacagaagccaagcgtcctccaggctttgaccgtgtccgaaatgctgagattgggaataaagactttgagcttgatgtcctggaggaagcatataccacagaacattggctggtcaggatatacaaggtaaaggacctggataatcgaggcttgtcaaggacataaatgtcacgtccagctctgatatgcttcgcactgagcacatcacatttaggacgttgaagattttttttttttttttttttt

SEQ ID NO: 2517 - DNA, 210 bp, Homo sapiens
cagcaaaagggtccccggggagctcatctttcagttaatgacaaaccgagagagggggctccggacgagataggaccaaggacagaaccgagaagaggtaaggggcaggtgatgcgagattgaaaaggcgcagataacggagggaaggagttgagggcgcagacgagggcgtcttgtccgcataagtttgagacgttctatggctgcctc

SEQ ID NO: 2518 - DNA, 282 bp, Homo sapiens
cagcagttcaacttcttcaattcctggcccccaaaatacgagctgaacaaatttctccattttttcctttggtaagtgcccatctctctagtgccatgactcacattactgaaggaattcaggaggactctttaaaagttttggacattctgctggaacagtacccagctctaattactggccgtagcagcatattgcttaagaattttgtagaacttatttctcatcagcagctgtccaaaggctgataaatagagacagatcccagtcctggatacttct

SEQ ID NO: 2519 - DNA, 320 bp, Homo sapiens
gtcagtggtggacctgacctgccgtctaggaaaaccctgccaaatatgatgacatcagaaggtgtgaagcaggcgtcggagggccccctcaagggcatcctgggctacactgagcaccaggtggtctcctctgacttcaacagcgacaccactcctccaccttcgacggtggggctggcattccctcaacgaccactttgtcaagctcatttcctggtatgacaacgaatttggctacagcaacagggtggtggacctcatggccacaatggcctccaaggggtaagccccctggccaccagccccagcaagagcacaag

SEQ ID NO: 2520 - DNA, 255 bp, Homo sapiens
aatagagatcgagtctggcccacgacgacgtgatgcaagaaaagtttattatgtgaggagagaggctcataaaacgctgttgcaacagagaaaggatccctmtttccatctagccccaaagctatgaggaacaggaataaaggagatggcaccaacatatgcctaaatggttgtatgtctttcattatcccatccgggagggatattgacagggctgtaaggtgccaatgaaggtttattttgtgaatggcccct

SEQ ID NO: 2521 - DNA, 200 bp, Homo sapiens
cctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcaaaaaaaaaaaaaaaaaa

SEQ ID NO: 2522 - DNA, 190 bp, Homo sapiens
ctgctgggaaacatttgcactcttttagtgcatttcctcctgcctttgcttgttcactgcagtcttaagaaagaggtaaaaggcaagcaaaggagatgaaatctgttctgggatgtttcagcagccaataagtgcccgagcacactgcccccggttgcctgcctggcccatgtggaggcagatgcctctc

SEQ ID NO: 2523 - DNA, 215 bp, Homo sapiens
cctacgcacacgagaacatgcctctcgcaaaggatctccttcatccctctccagaagaggagaagaggaaacacaagaagaaacgcctgtgcagagccccaattcctacttcatggatgtgaaatgcccaggatgctataaaatcaccacggtctttagccatgcacaaacggtagttttgtgtgttggctgcctcaattgtccttgtccaccta

SEQ ID NO: 2524 - DNA, 287 bp, Homo sapiens
gtgccgaattcggcacgaggggagaccacctggtggggaacgtgtacgtcaaggtaggagccagggcgagacggcggcgtggcctttagtgtgccaaggccaaggccaacaggcgaaagcgagacagtgtgtgcagccgcttagtgttccggggccaaggccgacagagagatggggtgcctcttcgccatgcaccttgagatcctgtgatgctcagagcgcacagcagaggctcagtgtgcactttgctcggcgcctaccacatgcgtcatatatggcggtggcca

SEQ ID NO: 2525 - DNA, 532 bp, Homo sapiens
ctcgtgccgaattcggcacgaggggagaccacctggtggggaacgtgtacgtcaaggtaggagccagggcgagacggcggcgtggccgcttagtgtgccagggccaaggccaacaggcgaaagcgagacagtggtgcagccgcttagtgtgccggggccaaggccgacagaggatggggtgcctgtcgccatgcaccttgagatcctggatgctcaggcgcacagcagggctcaggtgcactggctcggcgcctaccagctgcgtcatatgtggcggtggccagcccacacgtgcgcccagccagcagaactgaaggacggaccgtacaccacagccatcgttatttcagtgtagaatatttagtacctgttggtttagaagctgtgtggactaaggaaaagttaggtttactcacatgtttgggttcctttttcctttttagtgataaaactttatttgcctacacagccatatttgctcctttaaccagttgaatttgaaaaatgaaggcacatttggcaaaatccttgg

SEQ ID NO: 2526 - DNA, 227 bp, Homo sapiens
cttagctgtgctcgcgctactctctctttctggcctggaggctatccagcgtactccaaagattcaggtttactcacgtcatccagcagagaattggaaggtcaaatttccctgaatttgctattgtgtcttgggttcattcattccgacattgaaggtgacttacttaaggattgagagagaattgaaaaagttgagcattcagacttgtctttcagcaaggactb

SEQ ID NO: 2527 - DNA, 215 bp, Homo sapiens
tctcaggctacaccctagaccaaacctacgccaaaatccatttcactatcatattcatcggcgtaaatctaactttcttcccacaacactttctcggcctatccggaatgccccgagttactcggactaccccgatgcatacaccacatgaacacatcctaatcatctgcaggtctcattacattctctctacacagacagtatatattaaataa

SEQ ID NO: 2528 - DNA, 205 bp, Homo sapiens
agaaaagaaaaaaacagaaacagaagctcctgttcagcacctcagtcgtccacaccaagtgacactactggcccaggctaccttctccatctggtttttgtttttgtttttttttcccccaatgcttttgtttggctgctgtaatttttaaggtatttgagtttgaccagattagctctggggggaagggggtttccacattgtg

SEQ ID NO: 2529 - DNA, 232 bp, Homo sapiens
gaagatagaagacaacaacacacttgtgttcattgtggatgttaaagccaacaagcaccagattaaacaggctgtgaagaagctgtatgacattgatgtggccaaggtcaacaccctgattcggcctgatggagagaggagggcatatgttcgactggctcctgattacgatgctttggatgtggccaacaaaattgggatcatctaaactgagtccagctgcctaattctg

SEQ ID NO: 2530 - DNA, 224 bp, Homo sapiens
ctcgtgccgaattcggcacgagctcgtggtgaggctgacatgctcacacattacaacagtagagagggaaaatcctaagacagaggacctccagagatgagtgtctggagcgcttcagttcagctttaagggccaggacgggccacacgtggctggcggcctcgttccagtggcggcacgtccttggccgctctctattgtctccagctcagggctctgcgcac

SEQ ID NO: 2531 - DNA, 253 bp, Homo sapiens
cttgggagtagttctgaatatgaagtgtgttgatacaagaagcactgacaatgtttctgtttcttaaattaaaactggcctggttgcctttttatcaagagagcttaacagataaaaaatgaaataggtctatttcctactggccagcggagaatcttgcctaatttaaggatgcagtgtgaacctaaccattccactctgaccactctagtgtgtcatctatgtgaaatttaaacacatttctctctaggca

SEQ ID NO: 2532 - DNA, 241 bp, Homo sapiens
gaagcttgggatccgtctcctctttcgcctcctgcaccttgggagccccgggctactctctcacagcccctgttgccctgtgatctgtaggtccttggggacgatagtcaaggtgccaggccatcctggaggctgggaattgtattgaatcaatttcctaccaccgtggtggaggatatcctatcctatatcttaccatctatatagcatttccacacagtacgctgtagagattctcgct

SEQ ID NO: 2533 - DNA, 241 bp, Homo sapiens
atcctcacatctgttttcacaccttcatccctgtcttcctcatgttcacacttgtcttccccatgttcatagctgcctttcttaccattttggtttgaagggcagtcttctctggcttgtttttttgtttttcccagaaaatcaggattatttttgaaattaggagaaccattcctaggaggtgattattgtgtgaaaccctcctttggctaattgccttttccgagatttgagttccttc

SEQ ID NO: 2534 - DNA, 173 bp, Homo sapiens
ctcgtgccgaattcggcacgaggtgaaaccctatctctattaaaaaatacaaaaaaatacaaaaaaattagctggggcatgttggcatccacctgtagtcccagctattttggaaggctgaggcacgagaattgcttgaatcccggaggttgaagttgcagttagccaagaat

SEQ ID NO: 2535 - DNA, 323 bp, Homo sapiens
ctcgtgccaatttcggcacgagggccacctcaagagaaggctcacgatggtggccgctactaccgggctgatgatgccaattttggtccgtgaccgtgaccttgaggtcgacaaccaccctcaagagccttagccagcagatcgagaacatccggagcccagagggaggcccgcaagaaccccgcccgcaccttccgtgacctcaggatgtgccactttaactggtagagtgggagatccctggattgaccccaccaaggctgcacctgggatgccatcagagtcttctagcacatcgagacgggtgaaactgcgtagtaccc

SEQ ID NO: 2536 - DNA, 338 bp, Homo sapiens
cttgactactcgcatcgcgcactttttggatcggcatctagtctttccgcttcttgaatttctctctgtaaaggagatatataatgaaaaggaattattacaaggtaaattggaccttcttagtgataccaccatggtagactttggctatggatgtatacaaaaacctttattctgatgatattcctcatgctttgagagagaaaagacccacagtggttcgcacacctgaaacagcttcaggcagacacagacccaattgtgaagatgtttgaagatccagaactacaaggcaaatgcagtcacccaggaatggtaggatgctctttgactacctt

SEQ ID NO: 2537 - DNA, 272 bp, Homo sapiens
cggtagcccggtagctctagccgggcctgagctgtgctagcacctccccccaggagacctttgcagtcggccagcccccttctccacggtaaccatgtgcgaccgaaaggccgtgatcaaaaatgcggacatgtcggaggagatgcaacaggactcggtggagtccgctactcaggcgctggagaaatacaccatagagagggacattgcggcctcaaatcagagggattttgacaggacgtccactcccacctggcatgcatcgtggggag

SEQ ID NO: 2538 - DNA, 119 bp, Homo sapiens
ctgatgtgactgatggtgtactgagtgatgtgactgatggtgtactgactgatgtgactcatggtgtactgagtggtgactcatcgggtactgaccaatgtgactaatggggtactgag

SEQ ID NO: 2539 - DNA, 250 bp, Homo sapiens
ctgatgtgactgatggtgtactgagtgatgtgactgatggtgtactgactgatgtgactgatggtgtactgagtggtgactgatggtgtactgactgatgtgactgatggtgtactgagtgatgtgactgatggtataccgagtgatgtgactgatggtgtactgagtgatgcgactgatagtgtattgactgatggtgtactgagtgatgtgactgatggtgtactgactgatgtgactgatggtgtac

SEQ ID NO: 2540 - DNA, 344 bp, Homo sapiens
cgaagatgcgcgggaggtcgcaggtcctggtcgctttgataggtccgagggccatctcctggggcccgcctggccgaattccggtgggcctaaaccaaggtaacttgctgggccccggaaaggttgggtgggtccgtaccgctgtgaaggccatccaacatttcctcggcaatttcttccagaaccagagttgaggtacctggcttttcctccgcaggcggatagaacaccaaccctttcccagaggccctctaccatctcccgggccccagagccgcatcttctgcgcggcaccgtgcgagggtatcgttgccccacacaccaaggcgaggccaggccgctct

SEQ ID NO: 2541 - DNA, 313 bp, Homo sapiens
ggtctacgccgagtgacagagacgctcagggctgtgttctcagggatgaccgaggtgggaagacagcagcaccagcggtggccagagacccaagacaatccaagctctttggggaggttggagcaccgatggatgtcacagatcaatgctatttccctgcaggattcacattgcagtgaaggagatgtatgccaagtacctccctcacagtgcagggcggtatgccgccaaacgtttcccgcaagctcagtgtcccattgtggagcgcctcactactccatgatgatgcacgcccgcaacaccggcaagaagt

SEQ ID NO: 2542 - DNA, 151 bp, Homo sapiens
gcgggtgccagtagtcccagctactcggggaggctggaggcagggagaattcgctttaaaccccaggagggggaaggttgcagttaagcctgagaatcacgccgactgtgcctccagcctggcaacaacagagcgagaactccgctctcca

SEQ ID NO: 2543 - DNA, 311 bp, Homo sapiens
ccacaacggccaccccataaggcataggccaagaccataccccgccggaatgtaaggaaaggaagctctctctcagacagccatctcatagggccccatttccaggaccacttctgagtacatcattttcatgtcatcctgttggcactgatgaggaaccctttacagtccagggttcctgggaccttctaccagtgccactctgacaggcctcaccagaggtgccacctacaccatcatagtggaggcactaagagccagcagaggcataaggttcgggagaggttgtcaccgtgggcactctgtcaccg

SEQ ID NO: 2544 - DNA, 201 bp, Homo sapiens
aagcgttcttcttggcttctgagttagaacgttgaagatgaagtcagttccccatccatcagatgcggtctgtattatcttcaactttgatagcctcagtagacataagggctttcaaggacagcatggcccatgcaaagctagaggaacagaaagtgccttacttgttttgggcaacttgagtcttgcttagctctgcac

SEQ ID NO: 2545 - DNA, 616 bp, Homo sapiens
aagcgttcttcttggcttctgagttagaacgttgaagatgaagtcagttccccatccatcagatgcggtctgtattatcttcaactttgatagcctcagtagacataagggctttcaagaccagcatggcccatgcaaagctagaggaacagaaagtgcctgactgttttgggcaactggattctgcctgagctctgcacaaatgtgcctttgtctcactctctctgggaagctacagtgagccctaagcggccctgttgcctacctggccttcactgctgtgtctgctttcatttaagttttaacagcctctcccaactccaactctggcagtagccggtctcgcctatctacagggcacagctcctggttgggatttctcttcatggcaaacaagctctcaagcaaggtgctgggtgggctggttcctccccctctggcccttcaaagccatcctgggtaggtgtcactattggcccgtggcttctctaatactaaccacatcaaccggaaatggtcctttcaataaactctcttcaatcaactcaactggtcgcaacaatgtgttttccctgccaaggaatcctgatggattgaccaagcgagtggaaaacac

SEQ ID NO: 2546 - DNA, 120 bp, Homo sapiens
tatcacacaatattaagtctttctcctatagcttcagacagaatatttcaactaattgggtcactggaaaacaataatttcatatagcattctgataaataggtccacaggctaaacaat

SEQ ID NO: 2547 - DNA, 638 bp, Homo sapiens
tatcaaacaatattaagtctttttcctatagcttcagaaagaatatttcaactaattgggtcactggaaaacaataattttatatagcattctgataaataggtccacaggctaaacaatttttttttaaagttatttatcaatgtattcaagctgtgtgtttgatccgcaaagagatagggtttcagtttatacttgctgtttgttgaagcagcctcaggcaggaaagggatatgaaaaaagaagacaaccctgattactgcaaaatgaagagggcagcatggtcaccagctcaacgttagaaaaagggcattataaaagcagtgctgagagaccaggtattctgcctacttggatgagctgccacctttgaagcaatgccaaggtcatgtgcattgagctgttaaagatatctgagtaggaaaatgtcttcaggcaaggtaactttctttaaagtatgcttagcacctggtcatctggtcatctcaacagtggctcaatgatcaatagacaagagagcataaaacgttagtcaaatgccagaaagcttgacatctcggctggagagttaaattctctgacttttggaaggcttctcaaatttatttatatctgttccaggagctaggctaaattta

SEQ ID NO: 2548 - DNA, 144 bp, Homo sapiens
ataaattattttctcattgccattggaatagatatctcagattgtgtagatatgctatttaaataatttatcaggaaatactgcctgtagagttagtatttctatttccatataatgtttgcacactgaattgaggatttgttg

SEQ ID NO: 2549 - DNA, 228 bp, Homo sapiens
acctgccaccccactcttaatcagtggtggaagaacggtctcagaactgtttgtttcaattggccatttaagtttagtagtaaaagactggtttatgataacattgcatcgtaaaaccttcagaaggaaaggagattgttttgtggaccactttggttttcttttttgcgtgtggcagttttaagtgattagtttttaaaatcagtactttttaatggaacaacttga

SEQ ID NO: 2550 - DNA, 104 bp, Homo sapiens
gctaattaatagtatttcagatacttgaagaatgttgatggtgctagaagaattttgagaagaaatactcctgtattgagttggtatcgtgtggtgtattttta

SEQ ID NO: 2551 - DNA, 166 bp, Homo sapiens
tgcttcagaaaaaatgaaagaagcagtcagatttggttcatcttccttcctgtacagtatttcaaacttcccagtcattaaaaataagaatattctcatgttcataccatggattttctccgaggaggtggatattttgccttgggaattgaaaaggccaaggcct

SEQ ID NO: 2552 - DNA, 171 bp, Homo sapiens
tcttaagggggtggacccaagttcctcgaggaacatgcgcttttgccaagaagcacaacaaaaggggcctaaggaagatgcaggccaaccattgccagggcattgagtgcaacgtgccgaggctatcaagggccctcgtaaggcccaaggaggtaaggcccaaggatccca

SEQ ID NO: 2553 - DNA, 166 bp, Homo sapiens
ctttgttaaattgacaacaatggccatgtatccccatccccggttacgctgtatgtgcacctgcaaacaggtgtacaatttggcatctgtcaagactttctcaactcaagacttgctggcaatctgtaaaggaccaaatcttcaactgcaggtcctaacaaggaag

SEQ ID NO: 2554 - DNA, 227 bp, Homo sapiens
tctttgcaacaccatcttctagctgttctttctgagcaggtttagtgttatcctccgttcttttgtggaacctaattcttttgggacctcaattactttctcaacctatttgttctcccgtctgatgcctctttggtgggatactctttataaaaacaatatgtaattgtagcctatggtgtataactctaacactctaaaatgttgccacgatctcgagggctaaa

SEQ ID NO: 2555 - DNA, 276 bp, Homo sapiens
  misc_feature 46: n = A,T,C or G
tgtctttgcaacaccatcttctagctttctttctgagcaggtttantgttatcctccgttttttgtggaacctaattctttttggacctaattactttctcaacctatttgttctcctgttgtgcctcttgggtgaatcttttataaaaacaatatgtaattgtagcttatggttataactgaacacttaaagtttgccagatctgaggctaaatgctttatattgataactctttgatcctcttcatcaccttatgaggtaggtataatttccta

SEQ ID NO: 2556 - DNA, 226 bp, Homo sapiens
catcgacagcacaccgtaccgacagtggtacgagtcccactatgcgctgcccctgggccgcaagaagggagccaagctgactcctgaggaagaagagattttaaacaaaaacgatctaaaaaaattcagaagaaatatgatgaaaggaaaaggattgcaaaacagcagtctctggaggagcagttccagcagggcaaggtttttgcgtgtcattgcttcaagggcc

SEQ ID NO: 2557 - DNA, 254 bp, Homo sapiens
ctcgtgccgaattcggcacgagctttaatcagtggtggcagaacggtctcagaactgtttgtttcaattggccatttaagtttagtgggaaaagactggttaatgataccaatgcatcgtaaaccctycagagggaaaggagattgttttgtggaccactttggtttctcttttttcgcgtgtggccagttttaggtatatagagttttataaaacacagtactctttaatggacacaactggcccacatattt

SEQ ID NO: 2558 - DNA, 370 bp, Homo sapiens
tcgaagcgaggacgtggtgggtcctctggtgcgaaattccggatttccttgggtcttccggtagagctgtaatcaattgtgctgacaacacaggagccaaaaacctgtatatcatctccgtgaaggggatcaagggacggctgaccagacttcccgctgctggtgtgggtgacatggtgatggccacagtcaagaaaggcaaaccagagctcagaaaaaaggtacatccagcagtggtcattcgacaacgaaaagtcataccgtagaaaagatggcgtgtttctttattttgaagataatgcaggagtcatagtgaacaataaaggcgagatgaaaggttctcccattacaggaccagtagcaaaggagt

SEQ ID NO: 2559 - DNA, 324 bp, Homo sapiens
caccttagcagctcttcccctttcctgggggatgtgcacggcagcttgagcctgtcacgtggtcaaggcccggccccatcagaggctgggggaggcggcacattggcagtgtgtcacactgagctgggcaccacaggctgcctcatgaccctcctctccagcaggtagtgggtgaatgtgtgaaggtcttgcctgaatccatcaggactggggacacagagacccctgtggggtgtgcgctgtggggaaggtccctcccaggtgtttagaagagcctaactgtgtccagtgccttggagcagaaagccagggtcctgagtggct

SEQ ID NO: 2560 - DNA, 243 bp, Homo sapiens
ctttagagaaatgtctattcctatcctttgctcatcgcttaaagggattatttgttatttaatgttgagttgtttgagttccttgtatattctggatattatcgccctctcagatgagtagtttgcaaatcttttatccctttcaggaggttattactccactctggattgttctctctgtctgtccagaggctttttacctcatatatagtccactcgtctatacgtgctctgtgctgtgcc

SEQ ID NO: 2561 - DNA, 226 bp, Homo sapiens
ctcatccccatggagcattgcaccacccgcttttttcgagacctgtgacctggacaattgacaagtacatcgccctgggatgagtgggcccggctgtttcggcatcaaggcagagggttatcgacagggatctgttgatctaaatccattccttccaaagaaccggattctctctttaaccctcccctcgcgtgtttctcccaatgttataaaatgtttgagatgg

SEQ ID NO: 2562 - DNA, 108 bp, Homo sapiens
gcgggtggagagccccggactggagctcctgcgaactccccttcctgccctcaggagatgccactgcaggacccaaggagcagggaggaggcggccaggaccaagaag

SEQ ID NO: 2563 - DNA, 490 bp, Homo sapiens
gcgggtggagagccccggactggagctcctgcgaactccccttcctgccctcaggagatgccactgcaggacccaaggagcagggaggaggcggccaggacccagcagctattgctggccactctgcaggaggcagcgaccacgcaggagaacgtggcctggaggaagaactggatggttggcggcgaaggcggcgccagcgggaggtcaccgtgagaccggacttgcctccgtgggcgccggaccttggcttgggcgcaggaatccgaggcagcctttctccttcgtgggcccagcggagagtccggaccgagataccatgccaggactctccggggtcctgtgaactgccgtcgggtgagcacgtttcccccaaaccctggactgactgctttaaggtccgcaaggcgggccagggccgagacgcgagtccggatgtggtgaactgaaagaaccaataaaatcatgttcctccaaccaaaaaaaaaaa

SEQ ID NO: 2564 - DNA, 135 bp, Homo sapiens
aaaaaacaggggcagaagaacaaggaagcggagaggcaagagagagctgtagtacacatggatgaaccgacgagaagaacaaattgtacagttactaatttctgtcaaggcgaggaattgataaagagtcagagg

SEQ ID NO: 2565 - DNA, 111 bp, Homo sapiens
gtttaatttcggatttgcattgaaaaatatagtcttactgtacaatatgtcaaacatgtgaatttatgtgtaaaagcagggatatatcatgtgaaaatggaggatttttaa

SEQ ID NO: 2566 - DNA, 570 bp, Homo sapiens
gtttaatttcggatttgcattgaaaaatatagtcttactgtacaatatgtcaaacatgtgaattatgtgtaaaaagcaaggaatatatcatgtgaaaatgagattgtgaatatgttattaatagtaaaatgtcaggtggaaaaataggcagagtccaacttggacatatatctgtagctttcatttttccatctatttctctctctcgacacacacatggatatgtttaagttaagacatacatgaatttatttacagataagacacacatgaatttatttatagataagagtaatgaatgtatgtcagacatcatgcggatttatgaatttgatgttttggcttcagatggattatcatgttatctccgatgttctctcagttatgacccagaaacatttcttatcaggggcagaacttacagtacctcttttcttctaccccctttcccaatcctgactattacctgcttatttatcaccaattacaacatcttacatgggtcacagctactgctgcaggctggtatgaactcctggtgtcttaattcctattttttgctgttcaaaa

SEQ ID NO: 2567 - DNA, 282 bp, Homo sapiens
gatgttgtaagataaaacctcatctccagggtcacagccgggcctcggcctcctgtgagcagcgggaacctggaaagcagcacccagagcgccacgccgttccacagatgggggccagactccggcccctcagagacatagtggccgggtggtgggggccacaggcagggcttctgagccctgtcttgtatacagccagactttcagagtggtggggaggaggtttatggatgtcacacaccctcacctgagatatcctacacacacatagcacgttgtggg

SEQ ID NO: 2568 - DNA, 323 bp, Homo sapiens
gcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacggctgctgtccacggaaggctcccagaacatcacctaccactgcaagaacagcattgcctatcttgacgaagcagctggcaacctcaagaaggccctgctatccagggctccaatgacgtggagatccgggcagagggcaatagca

SEQ ID NO: 2569 - DNA, 332 bp, Homo sapiens
aaaaaccggcccagtcggtcctcagggacctgcaggaaagcctggtccagaaggtcttcggggcatccctggtcctgtgggagaacaaggtctccctggagctgcaggccaagatggaccacctggtcctatgggacctcctggcttacctggtctcaaaggtgaccctggctccaagggtgaaaagggacatacctggtttatattggcctgtattgtgtgcctccaggagaacaccagggaaaaaggtgacccagggctccctgtgaactcaaggatctccagagagcaaaaggggatgggggaattcctctgtcctcctggtcccttag

SEQ ID NO: 2570 - DNA, 323 bp, Homo sapiens
attcgtaaggtctttccaataaaatttagtactttattgagtcaaatttgaacattgggattgtttattcatttttaccagggaaatgatcgtttaagcttctgttagaagaatattgacctggctacataggttaaaatggggaatcaattggagatagagaaataagttagatgtctaatttaacaacaagtagagtattaagtcattgatgcaaaaaaggctatggtaattataactatcaataaattttgtgaatgtattattaattaacattcttagaatgaggtggtgagaaaagatggagatgcatctcctttgtc

SEQ ID NO: 2571 - DNA, 325 bp, Homo sapiens
gcggcacgaggattgaccccaaccaaggctgcaacctggatgccatcaaagtcttctgcaacatggagactggtgagacctgcgtgtaccccactcagcccagtgtggcccagaagaactgtgtacatcagcaagaaccccaaggacaagaggcatgtctggttcggcgagagcatgaccgatggattccagttcgagtattgcggccagggctccgaccctgccgatgtggccatccagctgaccttcctgcgctgatgtccaccgaggcctcccagaacatcacctaccactgcaagaacagcgtggcctacatggaccagca

SEQ ID NO: 2572 - DNA, 229 bp, Homo sapiens
ggtggctgtgcacatgaacatcgtctattgtgtgccagccaaaacaacaaacagttggaagtaaaaacaaaaaccaaaacctcgttagattcccagcttcaccacttactagctttgtgacctaagcacatcacttaccttcttagactgttgtctaaggagggaaaattgtaatgtcaggtgtatgtgtagagagcgcgttagcgacatatgtgagacgctgtctagt

SEQ ID NO: 2573 - DNA, 250 bp, Homo sapiens
gtggctgtgcacatgaacatcgtctattgtgtgccagccaaaacaacaaacagttggaagtaaaaacaaaaaccaaaacctcgttagattcccagctccaccactcactagctttgtgacctaagcacatcacttaccttctcagactgttgtcaagaagggaaaattgatgcaggtgtatgtgaggagcgcttagcacatggtagacgttcagtaaattcatggaactctgaaaaaaaaaaaaaaaaaa

SEQ ID NO: 2574 - DNA, 216 bp, Homo sapiens
ctcgtgccgaattcggcacgagtacaaaagaaccaagtattaaaagcattttgtggggtacatcatttctataattgtataatgtagtactttgtgggtttaaatgataaagacattagaggtaacacacatataaggcatgtatgcactgtttgaaatgtaaatatattcttaggacaatttcaatatgggggtcgcactatgtcctcttgagtg

SEQ ID NO: 2575 - DNA, 257 bp, Homo sapiens
cccatcatgaacgacaccgtaactatccgcactagaaagttcatgaccaaccgactacttcagaggaaacaaatggtcaattgatgtccttcaccccgggaaggcgacagtatcctatagacagaaattcagggaaaaactatgccaaaatgtacaagagccacaccggatgtcatctttgtatttggagttcaggactcattttggtggtggcaagacaactgatgactttggcatagtatttatagtattcccta

SEQ ID NO: 2576 - DNA, 287 bp, Homo sapiens
gctcgtgccgaaattcggcacgaggatcaggccagtgggtatgtaaagaaggccctgaagctgatggggtcaaatgaaggtgaattcatcggctgaaggaaatagcaaatttcacctacacagttctggaggatggttgcacgaaacacactggggaatgtgagcaaaacagtctttgaatatcgaacacgcaaggctgttagatctatcctattgtgatgagtattgcaccctttgtacattgatgtggtcctcgtatcaagagtttgtgtgtggacgttggccct

SEQ ID NO: 2577 - DNA, 214 bp, Homo sapiens
catcctccagagaaggtggcccctggccccgcccctggttacagaggcaactaatatcctgccctgaaccgggaaccgaaaaacaattatatgtctaattcccctaagaaatataagaagagcgagccccctaattgaaggaaaaagacaggacaagaggcctctcttagacaaccaactctagtggccccattcaggacacacttgtagcaca

SEQ ID NO: 2578 - DNA, 290 bp, Homo sapiens
tgcaggcaggtgttggttcgggcacgggccacggtctaagcagttgcaggacagcaaggaaaggagcctctccagaccagaaggtgaagtcgggcccctaagatcacggagaggcccagccgtggctgtccacatccacagaggggctcaggatccccatgactcctacatcctctcttgtgtctccgccaccacccactgcctcacctcattccaaccggaccacaccgccttaaggggcccagaatggccagtcccccatggcagccctgatctaggtggcagacatt

SEQ ID NO: 2579 - DNA, 300 bp, Homo sapiens
cggcacgaggtgcactgggcttcctggaagcctggcctcctggtccccccggccctcctggagagaatggtttccaggccagatgggaattcgtggccttccgggcattaaggggcccctggtgctcttggtttgaggggacctaaaggtgacttgggagaaaagggggagcgtgcgccctccaggaagaggtcccaacggtttgcctgggagctataggtctcccaggtgacccaggccctgccagctatggcagaaatggccgagacggtgagcgaggcccccagggttggcaggaat

SEQ ID NO: 2580 - DNA, 307 bp, Homo sapiens
gaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcagggctggggctgctgccagcgagtccctctgcgtctctaaccacgcctattaagcggaggtgttcccaggctgcccccaacactccaggccctgccccctcccactcttgaagaggaggccgcctcctcggggctccaggct

SEQ ID NO: 2581 - DNA, 196 bp, Homo sapiens
gtaaaacagtccagactcctgatttctgtccccagctctgtcttacccactcctcttctttgggcaggtcatttctctccgggcctgagtttccttactttttaaatgagagaattaaactttgcaatctccaaggccccttctcactcttgaaaacactatcttcataggtaggtattatttccacattccccat

SEQ ID NO: 2582 - DNA, 450 bp, Homo sapiens
gtaaaacagtccagactcctgatttctgtccccaagctctgtcttacccactcctcttctttgggcaggtcatttctctccgggcctgagtttccttactttttaaatgagagaattaaactttgcaatctccaaggccccttctcactctgaaaacactatctacatagtcagatataatcacacatccccagtgtcctgggatcattaaaagttcagtctactaacagaactgtgtggtaagaatggtaatgaggttgctggtcagtctgacacaggagcctcagggattcctacttgatctgtatatccgttaagcctggtaccttcttctgcaagtatcagaaaccctgcaactgactaacttaaactaacttaacagtagaactaatttaactaaccgaaacaggacaatgcatttataacaagacagtttattataaaaagaaa

SEQ ID NO: 2583 - DNA, 153 bp, Homo sapiens
ctttactcgacatttactaaggtgtttcttttgtggttcttgtaatctacaatccaacagtgtttttgagtagagctgtgtgtaaatatttgacaaccaggttacttgattatttctgttctcatttaggaccaggaatctcaaccgagtagg

SEQ ID NO: 2584 - DNA, 103 bp, Homo sapiens
ctttactcgaaatttactaaggtgtttcttttgtggttcttgtaatctacaatccaacagtgtttttgagtagagctgtgtgtaaatatttgaaaacaggtta

SEQ ID NO: 2585 - DNA, 151 bp, Homo sapiens
caaccatcggcagccgattccgtgtcttgatcacggggtgggagggaaccgtgggcgtccctgcgtggggcccatgggtgagacactccagtactgagacctagagtccagatgcttgtaggagccaagtcgtgttctaagtatttattta

SEQ ID NO: 2586 - DNA, 108 bp, Homo sapiens
  misc_feature 4: n = A,T,C or G
tggnacagctgaccagtttctgaagcgttccttagaaatgagggagcgagttctaggaccagatcaccctgactgtgctcagtctttgcattattctggcagctctat

SEQ ID NO: 2587 - DNA, 107 bp, Homo sapiens
caactctttgctttatagcattttgttgtattcacatgataatggtagcatttccatgcttgtgacagcatttttaaggttattaatatatttgcatcaacctttca

SEQ ID NO: 2588 - DNA, 225 bp, Homo sapiens
ctcgtgccgaattcggcacgagcaagttttaggagttcatatcctatatcatttcaaattaagtacataataaagtaaaattttgagatgaacactttaggtattttttgccaagatttagatgtttttaattaaacttttctctccctttttttttcactaaagcatgtttattcccctaatccattaaagagcatgaaaaaaagataaatgtatttgagaatt

SEQ ID NO: 2589 - DNA, 320 bp, Homo sapiens
gttcatctcccaccaggacattcgaaagcgaaactatgtgcgggatgatgcagtcttcatccgtgctgctgttgaactgccccggaggatcctcagctgagtgcaggtgggggttcgaggggaaaggacgatggggcatgacctcagtcaggcactggctgacttggagagggggccggaccccgtcagctgcttctcctgcctaggttctgttacccatcctcctccccagccaccaccctcaggtgcctccaattggtgcttcagccctggccctgtggggaacaggtctttgggtcatgaagggctggaacaagttg

SEQ ID NO: 2590 - DNA, 240 bp, Homo sapiens
gtattctccctgtgtgcatgcctgtctccaaatttccacatttcaaaaggacacaagtcatattggagtaggggcccaacctattccaatatgacctcatcatcgtcactaattacatctgcaatgaccctatttccaaataaggtcataatctgaggtactgggggttaggacttcagacatccaaatcttgggggggacacatttcaacctgtaacaaggggggtgggcagttcacag

SEQ ID NO: 2591 - DNA, 113 bp, Homo sapiens
gcaaaattaccgaattaaacctgttttatggatggcagcttggagcatagcaaggaagttgggaggattttgaattccatttccaagttcttcaatggtgtttttggtttctt

SEQ ID NO: 2592 - DNA, 172 bp, Homo sapiens
gttaatagtaattatagtcaagctggggttaaaaatttgttgtagatgatgcatacttggggataattaagagtaccatctaattttctgtcactttagaaaggaacaagtggcaactttgttgacttattggagaaagccagatgttctttactcagtaataccccttact

SEQ ID NO: 2593 - DNA, 181 bp, Homo sapiens
ctcgtgccgaattcggcacgagggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgac

SEQ ID NO: 2594 - DNA, 154 bp, Homo sapiens
atttagacagacttctataaacagtgatcatattgctgtccaatatgatatcccctagctacatgtagctattgaccacttgagatgtacaggttagagctgacatgtgctgtgagtgtgaaatacacacaagatttggggaacttaatatgag

SEQ ID NO: 2595 - DNA, 348 bp, Homo sapiens
ctcgtgccgtcataccacacacctatggtggacagaacatctgcattcaccagaatgtacttgttcctttggctgtgaataaattggataagacttttttattgtaagttccagcttttggaagatacggggataagattgacattgctgttgcagtattgcaaaaacatgactaaattgtgttataatatgtctaccgcttatgtttaagagaatcctcttcactaacttaaattgttaacattgttgtgatatttgagagagagtattaacctcaacagtcactttacaacactcatgtgaagacgtgtgcctccagttgaggggttttgcatttctgagcctcct

SEQ ID NO: 2596 - DNA, 106 bp, Homo sapiens
ttacagtagtgtataaattaaatattgtggaaaaacagtcttgtatttttctgtatgtgtgtatatatatatcgcttatggacttccttggcaattctatctgtat

SEQ ID NO: 2597 - DNA, 116 bp, Homo sapiens
ctcggtttctcggctgctgggtcggtcccgcccacagctggggcggcctatgtcgagtggcggccatgggaaggagggctcaactcgcatgttgaagactctcaccttcttcgtcg

SEQ ID NO: 2598 - DNA, 148 bp, Homo sapiens
ccacaaccgacttcatcaagtctgtcatcggtcacctgcagactaaagggagctagagccctttatttcttccaaccttgcaaggaccacactccccatacccttcagtgcagtgtaccaggggagagaccttgtgcctctaagcagt

SEQ ID NO: 2599 - DNA, 200 bp, Homo sapiens
ctcagcctcccaaagtgctgggattacaggcttgaaagtctaacttttttttacttatatatttgatacatataattcttttggctttgaaacttgcaactttgagaacaaaacagtcctttaaattttgcactgctcaattctgtttttcggttgcattgtctttaatataataaaaggtattacctctcacatattaa

SEQ ID NO: 2600 - DNA, 225 bp, Homo sapiens
gccttcccagccaatgcggcctgtttccttggctttgaagttgccatgaagttccttaattgggccacccccaacttgtgaggctgaaggctgctcaagttcacttctggatgctggaagctgtcgttgaggagaaggagtagtaagcagaactaagcagtcttgtgagggcaaggggaggggaatgtgtgagatcccagccctcgtgtcatatgatcttttgtg

SEQ ID NO: 2601 - DNA, 268 bp, Homo sapiens
gagaggctcttttcaaccctattttctctctccatccttctagatgatcccacctccccaaactctatggtcttctggatgtgcaagatacgtgcactggtgatgcacgcgagcctaggagggggtagattccagaatatgagtttctggggcctcggaaaggaaacagctatttatcatgcatcattatacaccctgctgtctgcagatacttcagtgttactgcaggggggttctctgaatttctccgcttttggcttcccatttg

SEQ ID NO: 2602 - DNA, 216 bp, Homo sapiens
ccggaccaggaccgccagcagctgggaggaggactggttcgccaagatccccctggcctgggaggcaagcagctcgtattaaactctacggaggccgactttgttctcttcggctaccccaagcccgaaaacctcctccgagactgtaaagctttcgcgttgctttttctcgcgtgcctcgaacctgacgaacgcgccactccagttttttttatg

SEQ ID NO: 2603 - DNA, 247 bp, Homo sapiens
ctgggaggctaggcctgtctctccttttgacgtttttctgcctggtttatgtttgctgggagctattagactgtagccagcagattcagggtggatctggcttgcccaggccactgactgcgatgttaatgctcttttgatcagcagccacacgacgcacactcaggaattgatgactttgatatcactcaatgccaatcagtttagacactcactattaggccatcacatatataggtatttatgt

SEQ ID NO: 2604 - DNA, 299 bp, Homo sapiens
ctggtgcgggagctacggggcccagggattgtgtttaaagtagtgcttctaccaacatgtcccgtggttccagcgccggttttgaccgccacattaccattttttcacccgagggtcggctctaccaagtagagatatgcttttaaggctattaccagggttggcttacatcagtagctgtcagaggggaagactgtgtcagtgaattgtcacacagagagagagtgtctctacacattttttgggttcagcgcagtgtctctctctttcacgatatctctgaacacatggtgttgtgt

SEQ ID NO: 2605 - DNA, 226 bp, Homo sapiens
gagaaatctcgtctcgaccaagagctgaagctgatcggcgagtatggctccgggaacaaacgtgaggtctggagggtcaaatttaccctggccaagattccgcaagcccccccgggaacctcttgacgtttgatgagaagtgcccgaagtcgtctgttcgaaggcaacgccctgtgtgcgcgcgcgctggtccccaatatggggtgctgtatagagagccaaaatg

SEQ ID NO: 2606 - DNA, 247 bp, Homo sapiens
gcaccatccctactgccccccaagaaagaaacactcaaaatgttgctattccaaagtgtaagtcagtaaccattccctaattcttttaggaaacacctttcatattacttttataacacaggtaaataattaatggtcaccattgttttattgttagatggatagtaccctagttgaaggccccaattaatatactctaaacgcgaagactctaaaactctaagatgtagcgccacagtttttttta

SEQ ID NO: 2607 - DNA, 610 bp, Homo sapiens
gcaccatccctactgccccccaagaaagaaacactcaaaatgttgctattccaaagtgtaagtcagtaaccattccctaattcttttagaaaacacctttcatattacttttataacacaggtaaataattaatggtcaccattgttttattgttagatggatagtacctgagttgaaggcccagaattaatatactaaaaacgtaaagacttaaaaacttaaagatgtagcaacagatttttttttaacccgcttcaatcaaaaataactaactagaattaaaaaccatttgtctttgtgaatctcttccttgctggattaaccctcatgctgagagccgtcaatctcctacttatatttgacttaacatttttctggtttgtttttggttacggaaactcaccttagaaacagactcagtgctctctgtgccagtttgcctgcctgcttgcctgctctttagcaagtaacctataaatattcgtggtctatgaattctctctttgatgatgtatttacttcctggttagctgttttatcacttaatctgccatcagttcaagagataaagtgcatacaaatcgtaaccctgactaaaaaagtgggcac

SEQ ID NO: 2608 - DNA, 218 bp, Homo sapiens
ctcgtgccgaattcggcacgagcccaggttccagcgtgcccctccctcagacacacggacacaatcagccgagaagttcctggtctgcatcacgagaatttggaggggtagggggtgtcaattgaaaggcataaggctgagctgagaccagttgctggtgaaactcgggccaatctctgggaggggaacatacctttccacaggagtgtttttagggg

SEQ ID NO: 2609 - DNA, 229 bp, Homo sapiens
ctcgtgccgaattcggcacgaggagaatgaagactattctcagcaatcagactgtcgacattccagaaaatgtcgacattactctgaagggacgcacagttatcgtgaagggccccagaggaaccctgcggagggacttcaatcacatcaatgtagaactcagaccttctttggaaagagaaaaaaagagggctccccgggtgtacaaatatgtgtgggtgtacacaaa

SEQ ID NO: 2610 - DNA, 265 bp, Homo sapiens
ctcgtgccgaattcggcacgagtgatgtcatgatcaatgactttggtgatcagaatcagaagttcggatttgaagttggtcctgtttgttttcttggctaagattaagacaaaggacatatcaaatcaacaggaaatataccttgtgtgccaccaaacccattttgtgccacatgcaagttttgaattaggatggtattgagaacaacgctgcatatacaggtgccacttttggggatatcgctgtctctgtggggggcagagtc

SEQ ID NO: 2611 - DNA, 284 bp, Homo sapiens
ctggagtgtggtggcacaatcacagctcattgcatcctcaatcacccagggcctaagcaatcctcccacccttgtagctgggactacaggttcacagcacacctgggctaaaatttttttttttgttgagacggattcctctatgttgcccaggctggtcctcaggcttcctgggctcagatggtcctcctgccctcagacttccaaagggcacagagccaagtttgttggctttgtcccttgcccatacatgccccaacaggaggttctttacccttttaatg

SEQ ID NO: 2612 - DNA, 288 bp, Homo sapiens
attgccacacatacagtaggagccttttgcttctcctaaagccattttcatctgccccaaccctgactgtagttgtcagggagcattccaggttgtttgtcaccagtagtaaaactctaggagcatgtattcattcaggaaccatttattgagctccttctatgtgtaagaaataccataggattaaggtttcaactatagggaaatatatgaaaggttcttttaatttccctttttctctatcctgatttaaatgtgtgattttttacattcacagacaaatagctt

SEQ ID NO: 2613 - DNA, 530 bp, Homo sapiens
attgccacacatacagtaggagccttttgcttctcctaaagccattttcatctgccccaaccctgactgtagttgtcagggagcattccaagttgtttgtcaccagtagtaaaactctaggagcatgtattcattcaggaaccatttattgagctccttctatgtgttagaaataccataggattaaagtttcaactatagggaaatatatgaaagttcttttaattttcctttttttctatcctgatttaaatttgtgattttttacaatcacagaacaaatagctttaggctttacaacttataaaaactatcctttgaggaattctatcatatcctggttatgaattttatttttgctgcaaagatgggagaagtttactgtgtttccttcctacattccctgctcctccttcctttttgagcactggcgggggaagatgcccttagacctcagggatccccaagcctgacttccagcagatatacttgtgacaaggcccaacctactggacagccactcccgtaat

SEQ ID NO: 2614 - DNA, 303 bp, Homo sapiens
gaaagtaggatagtggtttaccaggagtcaggaggaaagatggtgaggagttattgttttatgcatacagagtttcaattgggaatgctgaaaatttctggagataaacagtggtgatgattgtccacaattgtgaatgtactcagtgccactgaatttgtaaacttaacaccagttaaatggtgaagttgatgtcgcatatatttcacacgagtacttctagagcgcccgcgcgcccatcgattttccaccggggtggggtaccaggtaagtgtacccaattcgccctatagtgagtcgtat

SEQ ID NO: 2615 - DNA, 193 bp, Homo sapiens
catgatatgtctaaaaattttcaggaaaatggaatctttttttaaagttcaggtatgacaaagtatagaatttattcatttaacatattcacatttaggttatgtttctgatattgcagaaaaatgaaagtgtttgagttcagcctctcatttactccatttcaattaaaggctctggaaagggtaggttgtt

SEQ ID NO: 2616 - DNA, 269 bp, Homo sapiens
gacagctggtgcgcctgcccgggaacatcctcctggactcagtcatggcttgtggtctggtcgccagcaacctgaatctcaaacctggagagtgccttcgagtgcgaggcgaggtggctcctgacgttaagagcttcgtgctgaacctgggcaaagacagcaccaccctgtgcctgcatttaacctttcgtttaaacgccaacggggacgccaaacaccattcgtgtacacagcaggaccggcggcccttggggcccgcgcagcgggag

SEQ ID NO: 2617 - DNA, 145 bp, Homo sapiens
gaagaaacggtggcagagattaacgcaacaatgagtgtccatctcccattttgcagtgggttggcagcaccgaaggaggtgaaggatttggcaacaaggatggccaaaggcccaggcagttaccccttggggttgtgttccaggt

SEQ ID NO: 2618 - DNA, 188 bp, Homo sapiens
ggatgttgcagagtttcttgttaagtatattttgtacatgaattacttccaggaaaaggtcagttcaattgtttaaaggtttttcatacaaaataacttaaaccagacctcttagggatttgccaactcctaaccctggtaattataccctaagtctattggtaatcctctgctgtggtttaaaatat

SEQ ID NO: 2619 - DNA, 280 bp, Homo sapiens
ggatgttgcagagtttcttgttaagtatattttgtacatgaattacttccaggaaaaggtcagttcaatgtttaaagatttttcatacaaaataactaaaacagacctcttaggaattgcccactcctcacccctgttattaataccctaagtctatttgttaattctctgctgttgttttaaatatttacaaatttccctatccttttctgtgccgtttcaaaatataaacttagtttttcttaacctgaaaccttagatagtaaaaaaaaaaaaaaaa

SEQ ID NO: 2620 - DNA, 203 bp, Homo sapiens
gccccgcgccccgcgtcgggtcccatccggccatcgtgcgctgccccacggttcggtaccacacgaaggttgcgcgccggccggcggcttcaggcctggaaggagctcagggtggccggcaattcacaggagggtggcccgacccatcggcatttctgttggatccagaggcctaacagtccacgagtcctgcaagccaacgt

SEQ ID NO: 2621 - DNA, 187 bp, Homo sapiens
ctggggatttcataactcaaggaattcccctcaggacagctgtagtgggctccccattgtttaacttcagattatcccgatatagctttgtgttgtttgcaattcatgagccactaagagccatataagttacttcttggaaggttttacaaggaaccatgaggaactgacttgctggcatcgaaag

SEQ ID NO: 2622 - DNA, 590 bp, Homo sapiens
ctgggatttcataactcaaggaattcccctcaggacagctgtagtgggctccccattgtttaacttcagattatcctgatatagctttgtgttgtttgcaattcatgagccactaagagccattataagtactctttggagggttttacaggaaacaatggagaaactgacttggctggcatctgaaaggcgcatgagtcaggagggtgagtctgaagaagagaattctcaggaggagaactctgagccagaagaagaggaggaagaagaagcagaaggaatggaaagcctgcagaaagaggatgaaatgacggatgaagcagttggagactctgctgagaagcctcctacttttgcttcacctgagactgctccagaagtggagaccagcagaactccaccaggagagagcatcaaagctgctggaaaaggccggaacaatcatcgagctcgcaacaagcggggaagtcgggctcgggccagcaaggacacctccaagctgctgttgctgtatgatgaggacattctcgagcgagatccactcagggagcagaaggacttggcctttgcccaagcttatctgacagggt

SEQ ID NO: 2623 - DNA, 283 bp, Homo sapiens
aaaaaggaaaaaataaaaaaaccatgtatatttgtacaaaaagtttttaaaagttaatactaacttaatattttcctatttaatgtccaggcgtggaccgctctgccacgaactagctcggttattggttatgccaaaggcactctccatctcccacatctggttattgacagtgttactttattttcatcgcggactcttggggaagggggtcactcacaagctgtagctgccattcatgcccatctagcttgcagtctcttcgcgctttcgctgtctctct

SEQ ID NO: 2624 - DNA, 207 bp, Homo sapiens
ctggtttctccataatatctacaagtgaagatgaagattacttctcaaaaagtatccatatttccagtgttccttttaataaaatatgccacttttaaataaaataattacaaaatgtaaaattataaaatttttaaatttaaataataagtgaccgtaaaatttttttgacaatatatatagtcactgtctcttgtaatttaaaca

SEQ ID NO: 2625 - DNA, 298 bp, Homo sapiens
ctggggccaaagccaggaccagcaggagaacacacacaataagagctagaagacctccttgctggtgggtttgtcctaaaagggagcaggcaggccggaagagaaacttctgcaagaaaccagaacaacatctttttgggctcaaggatcgggtgttgtcaagagagaggctctctttctatttatattttaaaatcacaaggtacacactcacatagagagacacatagtcacatatcaccctctgaggttttattttatggcacagcttctctctgctcctcttctcatagtcstg

SEQ ID NO: 2626 - DNA, 536 bp, Homo sapiens
ctggggccaaagccaggaccagcaggagaacacacacaataagagctagaagacctccttgctggtgggtttgtcctaaaagggagcaggcaggcgggaagagaaactcctgcaagaaaccagaacaccatctgtggggctcagggatcgggtgttgtcaggaaagaggctcttttctatttatttttaaaatcaaagttacacattcacatggagaaacaaatggtcaaataacacctaagaggctttatttcaggacacagctactctgtcccccttttctcattgtctgcccacaaaaccattttccattctatgacctgagtcacaaagaccttctgtgctgtctccctctgccaaggtgctggccaccccctccattacttgagcccttacagctatgcatgattgctgcattggtaatttgttgcaacaatttggtgataacaatttaacacttaacccagttttccacctgtataacatctcatagccgattaaatgagattttcactcaaaaaaaaaaaaaaaaaaaa

SEQ ID NO: 2627 - DNA, 110 bp, Homo sapiens
ggtatatctatgttaacctcaagatggactgagttctgtatggcagaactattgctgttctctccctttcttcatgccctgttgaactcttctaccagcttctcttctta

SEQ ID NO: 2628 - DNA, 117 bp, Homo sapiens
ggatggtgtggcttccaccgaggcccgcatcgtgttcatgaccaccaaccacgttgacaggctggaccctgccctgatacggccggggcgagttgaccttaaggagtacgttggctw

SEQ ID NO: 2629 - DNA, 126 bp, Homo sapiens
aagagccatttccttttggaacaatggtgccgtttgtttcactttttttttttgttattttttcccctaaatctttgttggaacaaatctttgccgaaactttttcagggcagcccaactttcctt

SEQ ID NO: 2630 - DNA, 560 bp, Homo sapiens
aagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttgggggataatgtgtggagcgaattgggtacaa

SEQ ID NO: 2631 - DNA, 169 bp, Homo sapiens
ctctactaaaaatacaaaaatttactgggcatggtggtgggcgctgtagtcccagctactcaggaggctgaggcagaagaatggcatgaacctaggaggcagagttttgcggtagcttagatcacggcacttcacttcagacttggttacagagttagacttcttctta

SEQ ID NO: 2632 - DNA, 221 bp, Homo sapiens
ctgggacaagggccactgggctggtctgtgtctgggcctgtcccatggctggggcagtgaggggggcccagtcagcctcttttgggcacctctctcagccaggcttggcccactgccatcacccagcaccccagatcaccgccaggccagcccccaatggtccccttacggacaggtcccagagatggacaagagcacccagggccccaaccgtccttctg

SEQ ID NO: 2633 - DNA, 344 bp, Homo sapiens
cggcacgagccaaggacaagaaacacgtctggctaggagaaactatcaatgctggcagccagtttgaatataatgtagaaggagtgacttccaaggaaatggctacccaacttgccttcatgcgcctgctggccaactatgcctctcagacatcacctaccactgcaaggacagcattgcatacatggatgaggagactggcaccctgaaaaaggctgtcattctacagggctctaatgatgttgaacttgttgctgagggcaacagcaggttcacttacactgttcttgtagatggctgctctaaaaagacaaatgaatggggaaagacattcattgattaca

SEQ ID NO: 2634 - DNA, 356 bp, Homo sapiens
gtcctctggaataagagcctgtggctgaagcagagggccttctcgggagagctctccaaggtcttggaggaagggtccccccagaaggagctccggggttagccccactgtgcccccctggactccaccagcttcatgcttctcagatgctacccaggggccggcccgggggagaccagggcaagatttctcccgcaccaggtctgtggagggtttggaggtctgttagagcagacactgtcccattgctgggcgctgggggaaagaatatctgagacgacgtttggggagcaatgctctttaccacgttcaccaagtcgtctggggcaggtttgtaagctgcagcagttgctggt

SEQ ID NO: 2635 - DNA, 187 bp, Homo sapiens
ctcattcagtaatcagacaggccctgcttgggcaggctcagaacagagactacacataccgaggagctgctgaatcgagtgttcaaccatcatgaggaacaaggcttccagatattggtgcttgggggagaacaggaaattttggtaattgaaacctccacaggtcgtccgattgggacccaagaaa

SEQ ID NO: 2636 - DNA, 216 bp, Homo sapiens
ctcgtgccaattcggcacgagcttacagttgccatcacctttctgtggtaatactactgatatttgcctttcctatataaggaaagtgtgcctagggctgtctggtattctttcaaggggttttccagtatgaatgttaatgtggtcagtgtatgtatgaatatgaaagtgccttggtttggttggttgctgtttttgtgtttatgtgtgtgttta

SEQ ID NO: 2637 - DNA, 306 bp, Homo sapiens
gtttcattccatgtaagcattaaaacagtgtatgtaggtttcaagagatttgtgatgattcttaaattttaactaccttcacttaatatgcttgacctgtcgccttactatgtaaggcatctagactaaaggccaaaatataataatgcctgccttctctaaaaacccaaattgtagtctctctattaaccctgaaatgtacactagcccagaacagtttaatgggtactcactgagctatagcatagctgctgagttgtttgtgagatttttgagtcaacacataatggaaacttctttcttcta

SEQ ID NO: 2638 - DNA, 211 bp, Homo sapiens
ctcgtgcgaattcggcacgagaggtaagccaagatgggtgcatacaagtacatccagggagctatggagaaagaagcagtctgatgccaatgcgctttcctctgaagggtcccgctgctggcagtaccgcaagctctctgctctccacaggctcccggcccaacccggcctgtataagcgcgccgactggcttacaaggccaagcaaggtt

SEQ ID NO: 2639 - DNA, 176 bp, Homo sapiens
gacagcgaggacctccaggagaagcaggtcccaaaggagatagaggggctgaaggtgctagaggaatttcctggtctccctgggcccaaaggaggacaacggtttgccaaggtgttggatggccgtattgggttccctggattgcctggaccaagggttgacccaggaaaccctgg

SEQ ID NO: 2640 - DNA, 231 bp, Homo sapiens
tggaggtggtggcctactcttccccaggacactcagacactgaccctgataactcgtccctgacagggacactcctacacaaaggttgttgcgggtctgaaatgggcctgtgaggaccccaatgcttggacaaggaaaggacccacattgacaaccaagccacagtaagtagcaggcttgtcattggcacacagtggcctcaaagggcaacgatttgattggaagtaacag

SEQ ID NO: 2641 - DNA, 206 bp, Homo sapiens
cggcacgagggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacaggggcatctcaggctgactgtgctgtcctgat

SEQ ID NO: 2642 - DNA, 206 bp, Homo sapiens
ggttacatatggtcagcttcagcaaccaacaacgggagcagccagtggtggatacattagacgcataacttatgatgccagagaagatgatatggaagagaacctgactcaagtgggcagtatcctgggatatctaaaagacatggccctgacacataggcatatgagattgatgctcaaaatccacaaatattagcgctatcaca

SEQ ID NO: 2643 - DNA, 211 bp, Homo sapiens
gcaaaacaacatagacatgaagtgtcctttgttattcataatctgccaataattgccaagatggctgccgtcagcaggccagtggacggtttgggcttcttcaaggacctcagctgatacctgttgggggattactgatttgtctgtcaagagaaacaggcggctcgcttttgttctgagatcatatactccaagtacggagagggtcacc

SEQ ID NO: 2644 - DNA, 171 bp, Homo sapiens
ttcagattcagcatttgttctttgccagtctcattttcatctccttccatggttccacagaagctttgtttcttgggcaagcagagaaattaaattgtacctattttgtatatgtgagatgtttaaataaattgtgaaaaacatgaaataaagcatgtttggtgttccaca

SEQ ID NO: 2645 - DNA, 142 bp, Homo sapiens
gtggaggccacaggagcagaaacatggaatgccagacgctggggatgctggtacaagttgtgggactgcatgctactgtctagagcttgtctcaatggatctagagcttcatcgccctctgatcgccgatcacctctgagac

SEQ ID NO: 2646 - DNA, 201 bp, Homo sapiens
taatgagagctcaattttgttgaggacaggaatgtcctgatgagagtgttggaacaccagttggttagaaaaataaaccagaaccaaggacttaggttaaaatagtaggtgggttcagttggctattttaactgggttttctttgagggtttaaaactaatgcatttcttagtgcccctctgtagctctagtgtaccagat

SEQ ID NO: 2647 - DNA, 240 bp, Homo sapiens
cgaaaggggagttcaaggagacgggggcgacgcggctgagggcttctcgtcggggtcggggctgcagccgtcatgccggggatagtggagctgcccactctagaggagctgaaagtagatgaggtgaaaattagttctgctgtgcttaaagctgcggcccatcactattggagctcaatgtgataaggcccacaaggagtttattctcttcccctcgggaagagaaagatacccggccgt

SEQ ID NO: 2648 - DNA, 123 bp, Homo sapiens
gggatttgatggcgtgatgtctcacagaaagttctccgctcccagaacatgggtccctcggcttcctgcctcggaagcgcagagcaggcatcgtgggaaggtgaagagcttccctaaggatga

SEQ ID NO: 2649 - DNA, 178 bp, Homo sapiens
cttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaaggctta

SEQ ID NO: 2650 - DNA, 281 bp, Homo sapiens
cggtggtgctgaccaggaattctttgtggacatttgccagtctgtttcaagataaatgaactcaatctaaattaaaaaaggagagagattttgagatcactttctctttgcccatttcttcttcttccttttttaactaagcgctgaatccctccctttcttctgcacatctacttgcttgaattgtgggccaaagagaaaaagagggattgatcagagcattttgccaatacagtttcattaacctccttccccgttcccccagagtttgaatttttttt

SEQ ID NO: 2651 - DNA, 369 bp, Homo sapiens
ctccgcaagcggatgaacaccaacccttcccgaggccttaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttctgctgccctcaaggtcgtgcgtctgaagcctacaagaaagtttgcctatctcggggcgcctggctcacgaggttggcttggaagtaccacggcagtcacagccaccctggaggagaagaggaaagagaaagccaagatcccctaccggaggaagaacaactcatgcgcctcggaacaggc

SEQ ID NO: 2652 - DNA, 267 bp, Homo sapiens
gaggcgccatcatgggagtggacatccgccataacaaggaccgaaaggttcggcgcaaggagcccaagagccaggatatctacctgaggctgttggtcaagttatacaggttttctggccagaagaaccaacttcacattcaaccaggttgttttgaagaggttgtttatgagttgcaccaaccggccgccctctgttcctttcccggatgatccggaagatgaagcttctcttggccgggaaaacaagacggccttggttgtgggg

SEQ ID NO: 2653 - DNA, 224 bp, Homo sapiens
agaccgtgaggctctggcctgcagctcgcgccgccatggacgctgccgaggtcgaattcctcgccgagaaggagctggttaccattatccccaacttcagtctggacaagatctacctcatcgggggggacctggggccttttaaccctggtttacccgtggaagttcccctgtggctggcgattaacctgaaacaaagacagaaatttcgcctactccctcca

SEQ ID NO: 2654 - DNA, 271 bp, Homo sapiens
gattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttcctgggtttctgcctaccccctaatt

SEQ ID NO: 2655 - DNA, 312 bp, Homo sapiens
ggtttctgctctgtctgtcatggcagtctcttggtttgtgtctggccaaggccatgcgtgtgcctcggaccgagccccagcttaggcgagggagtcaggctggcttcggccctcggttttcattcaggccaccctgctcatggcccttcctggccgcctgccacaccgcaagctcgctgggggggacactagaagcaccgtggcctgggattccatctggagctgtccgcaggcaccagccccagccttccaccacgttcactgcctggcttggaaaggttaagaagccccttaagaagagaatcgaggcca

SEQ ID NO: 2656 - DNA, 200 bp, Homo sapiens
gccgtgtgtacgtcattaacaaggagatctgtgttcgtacagtgtgtgcccacgaggagctcctccgagctgacctctgtcggggacaagttctccaaatgtggcgtgatggccagcagcggcctgtgccaatccgtggcggcctcctgtgccaagagctgtgggagctgctaggggggggctggcatctcgaggctcgg

SEQ ID NO: 2657 - DNA, 190 bp, Homo sapiens
ctcgtgccaaattcggcacgagggccagacctgcccctgacaaactccacagtatggggaccctggagggctaggccaaggccttctttgcacctccacctagaagctgaatagtgacgccctcccccaagcccacccagccgcacacagggcctagaggtaaccaataaagtattagggaaaggtgaat

SEQ ID NO: 2658 - DNA, 280 bp, Homo sapiens
ctgcacatgtcacactgaccacatctgtagacatcttgagttgtagctgcagacggggaccagtggctcccattttcattttagccattttgtcgcctgcacccactcccttcatacaatctagtcagaatagcagttctagaggcacaggtctcagtctaagctatggaaagctcccttatccacgagagttaaaggaggtccttgggttttcgcgagctctttgtaccctaggctcttgggagggcccagctaagacatgcccagttagagacgcaca

SEQ ID NO: 2659 - DNA, 233 bp, Homo sapiens
tggggacagtcttataatcagataattttgatgcttccctgtgcatcacggagtttcacaccgttggtgagtagtatttgttatagtttgtcaatttataacttttcaaattaaggtttcatgtgtacattagtaccacgggtggtatttgggtttgtaaaaccttcaattatttgcaaattaatatttcaggggaggttttaggtaatttttctcagggcccaaaaaaaaaa

SEQ ID NO: 2660 - DNA, 142 bp, Homo sapiens
cggatcataacaaaagggaagcattctgtgcgtggggtttggctctttcagtatgtcattctgttctcatcttctgccacagtctctcagatagctcatgaagacaatcacctgcctcaccttctaggtgttttcctttttt

SEQ ID NO: 2661 - DNA, 257 bp, Homo sapiens
gagcgcccctggctgcccctcggccgccgactggacgcgcgggccttgccagcgagcaccctcatcgggctgtcgcctgacagcatacctcaaaaggccctagctaataagcctgttaggcccagcatttgagagagggtagggtgtttatatataaaagggtgtgtacaacttcccgggggtaaaaatattccagtacctgtttacatagcgtattgtgtgtaggctctgtgctctatcccatataaatgggatat

SEQ ID NO: 2662 - DNA, 250 bp, Homo sapiens
ccactgtggcctggcatcgcatcgtgggtgtgtcaatgccacaaaatcgtgtgtccgtggaaccagtcctagccgcgtgtgacagtctttgcattctggttgtctcgtgggggggaggtggacagtccctccggaatgtgtcttgtctcccatttgggtaaaagggacccacccacaaacaatgtgcatcacttggatttcccacccgtttgtgtgagcgtgtcggatgtgctagagaaaccctgtatcc

SEQ ID NO: 2663 - DNA, 208 bp, Homo sapiens
actagttcgagtttttttttttttaaaggaagaaacaaagtgccctcttcttaaatttgctaagaaacaatatagtgggattaagggacatgagatttgaaggctgaattttgatatcattgattattttatcgggggaaaaaaatctctttaaacccgtttccttatctgtaaaatgggaaggatagtgattttcaggggatttttt

SEQ ID NO: 2664 - DNA, 279 bp, Homo sapiens
ctcgtgccgatctgggacgaagcagctggcaacctcaagaagggccctgctcatccaggggctccaatgacggtggagatccgggcagagggcaatagcaggttcacggtacacttccctgaaggatggctgcacgaaacataccggtaagttgggcaagacttttatcgagtacccgtcacagaagacctcacggcttcccatcattgacatttcacccatggacatagggggggcccagcagggattcgtgtggacatagggccgtctgtttttgtg

SEQ ID NO: 2665 - DNA, 138 bp, Homo sapiens
ggtagatagaaataaatagctatatccatgtactgtagtttttcttcaacatcaatgttcattgtatgtactgatcatgcattgtgaaggtggcctgaattgtcctacaataacaagttttcccatgaaaaccgtttt

SEQ ID NO: 2666 - DNA, 113 bp, Homo sapiens
aaagtgaaagacatttcaaatctgtagcataggctagtgggcaggtccgcacagtcgaagccacacctgtctgtttctgtgcactgtaggcctttaggtgttcaccctttctt

SEQ ID NO: 2667 - DNA, 102 bp, Homo sapiens
ggatcctgctaaggtgcagacataaacgagtatcagccattattctgggaggttataagatatgcacttccaattaccctgcatcacaaccattattggtgg

SEQ ID NO: 2668 - DNA, 590 bp, Homo sapiens
ggatcctgctaaggtgcagacataaacgagtatcagccattattctggaggttataagatatgcaccttccccaattacccctgcaatcacaccattattgtagattggcccttagagtatcttttcaggttttttggcatgtctgacactcatggctctacttggacccaccaaccctgctcctatggctccacccagaagccattcagcctagaggacagctctgaccccccctgtgatttcatacaatcagcagcaagtaactgttacctcaccatccccaccccttctgccagactgcctttgaaaaacctctaacctgtgagcacgagatgattccagaacaaactctgtctcccatgtggcatgaccagccttgggtctcttaaactttttctccactataatgccatggtctttatgcagcaggcaggaagaattcaggtggttataattccgtatgtgctttttgaacatttttctactgggctattgctctcttcataatgatttctttaacttcccctctataaggaactgatttcatctgaaattgaagagacaatcagagaaaaacataggaccactc

SEQ ID NO: 2669 - DNA, 136 bp, Homo sapiens
ctcgtgccgaattcggcacgagtttttttttcctttttaagagacttttatttgagtggttcttacagatgttgcaatatgaagtcattttgtttgataagaaatatccaaggctgtctttgtcaaaccacacttg

SEQ ID NO: 2670 - DNA, 116 bp, Homo sapiens
aagaatcctctctctctacagcaagaatgaacatattgatcagagggacccaccattcaccaaggaggcagccttgcatcagatgagtgtacttcagggaaggaactttgaccccc

SEQ ID NO: 2671 - DNA, 580 bp, Homo sapiens
aagaatcctctctctctacagcaagaatgaacatattgatcagagggacccaccattcaccaaggaaggacagccttgcatccagatgagtgtactcaggaagcaacttgacccccataggcaagtcgaggtggggaccacagagacttttgttcactattatcccagtgttcttggaaaagggctgcccttgatagccatctgttgaatgactgaatgaatacactggtggttgaatgaatcaagggttgaatacttggatcacagcaataataaaaacctatctgttggccagacatggtggctcacgcctgtaatcccagcactttgggaggccaaggcaggcagatcacttgagcccaggaatttgagaccagcctgggcaacatggcaaaaccccatctctactaaaaatagaaaaattagctgggcattgtggcacgcgcctgtaatcccaggtacttgggaggctgagacacgagaatcacttaagcctgggaggcagaggttgcagtgagctgagatcgcaccactgcactccaggctgaatgacagcatgagactgtctcaaaaaaaaaca

SEQ ID NO: 2672 - DNA, 144 bp, Homo sapiens
tagtccattcttgcactgctataaaaaattcctgggctggactcagtggctcacacctgtaatccacactttaggaggtgaggtgggtggatcacctgaggtcaggagttcgagaccagcctggccaatatggtgaaaccccgt

SEQ ID NO: 2673 - DNA, 122 bp, Homo sapiens
tccgcttctcgcccaacagcagcaaccctatcatcgtctcctgtggctgggacaagctggtcaagtatggaacctggctactgcagcctgaagacccacccacaattgggccacacaaggct

SEQ ID NO: 2674 - DNA, 215 bp, Homo sapiens
gcacttttaggcattcccaaagtcctttataaatctaaaacaggaaagtacagctttcccacatacatatataagagctgtccatgcactgcaaaccaatcaacccttggtaagcagtcagacaggttttggatcagtaatgggtaaatacagctactcacttcagttcttcagtgtttgacaaaaatatttaacacatgacatatgtgatacrt

SEQ ID NO: 2675 - DNA, 590 bp, Homo sapiens
gcacttttaggcattcccaaagtcctttataaatctaaaacaggaaagtacagctttccacatacatatataagagctgtccatgcactgcaaaccaatcaacccttggtaagcagtcagacaggtttggaatcagtaatgggtaaataccagctactaacttcagttcttcagtgtttgacaaaaatattaaccattgacatggtaatcactgttaagagacaccctcagaaagttcacaatcaagattcagaagatgaactataacatcagaagtttttaattaaccaaacttttcatctaactcaagccaagtaaagcagtcatgtgaccactggttctaaagtcagttcagtctacttaggaaaatagcgtaactttaaaagtctttagaagaagcacactaaggtcaccagaccagatacaaatattaaattactttatggaacaaatctagaggggaagccaagatttggctaagtgtgtctgttttttccctaatttatgcctctgtgtctcagctctgtgttagcctatgtgtttaggggagggttttttcctttagagctcccttttactctcctggtatc

SEQ ID NO: 2676 - DNA, 260 bp, Homo sapiens
ctcgtgccgaattcggcacgagttaaatctgtgcagagcttagcaaatcttgtggaatttggagctaaggagccctacatggaagggttcaatccattcatcagaagcaccagacatcgtatgatcatgtttttagatgaccttgggattgtacctgatcttcggacactacagagcattctagagcggacctgtcccgtgatttagcagcattgcatgagatttgcgtggctcattcagatgaacttcgagcgctcagt

SEQ ID NO: 2677 - DNA, 370 bp, Homo sapiens
gctcgccgtccccgccatgctgtctctagactttttggacgatgtgcggcggatgaacaagcggcagctctatttatcagtcctaaattttggaatgattgtctcatcggcactaatgatctggaaggggttaatggtaataactcggaagtgaaagtgccgattgtagtggtggctcagtggcagcattggaacctgcatttcatagaggagatcttctctttctaacaaatcgagttgaagatcccatacgagtggggagaaattgttgttttttaggatagaaggaagagagattcctatagttcaccgagtcttgaagattcatgaaaagcaaaatgggcatatcaagtttttgaccacaggagat

SEQ ID NO: 2678 - DNA, 138 bp, Homo sapiens
ctcgttgctgctctgtggcacatatcggaagcagtacagcgcgcggctctacacgcttgggtagcgggataagtcactgttttctttatttctttaaaaaaaaaaaggttcttttgcaaccgcctcctttgggattct

SEQ ID NO: 2679 - DNA, 235 bp, Homo sapiens
aggctggctgggtgtcaaggagcaggctccaggccaaggtcctggcccagccacggccattgcaagggctcagcctggcaggctttgtgggggacgccgccctctctgccgcagtggggtgcacggccgggcaccacagttggactcaggcccgggaaggtcatgttctcgaccagagctttgcttccagtccaggcggcttattcggaggcctccttgacttggacacagagat

SEQ ID NO: 2680 - DNA, 115 bp, Homo sapiens
tgaagtgccaagagagctgagaggagcagttgtgactctacccaggaacaaactgtgcctgaacctgaggtgcccaaccccaaataaacccaagatgctgtgtattttcagagga

SEQ ID NO: 2681 - DNA, 245 bp, Homo sapiens
gactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatggggggttgggaagccgagcatgttctagttcaatgttgacttttttttttttaaaggaaagcattaggcataaaatct

SEQ ID NO: 2682 - DNA, 274 bp, Homo sapiens
caacgctccgccgccgctgctgccgcgacccggactgcgcgccagcacccccctggccgaacagctccgtcactattggaggatatgaacgagtacagcgatatagaggaattcgcagagggatccaagatcaacgcgagcgagaatcagcaggatgacggtgaaatgtttattggaggcttgagctgggatacaagcgaaagagatctgacagagtacttgtctcgatttgggggagttgtagactgcacaattaagacagatccactcactc

SEQ ID NO: 2683 - DNA, 332 bp, Homo sapiens
gatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgagataaatttattccacccacata

SEQ ID NO: 2684 - DNA, 149 bp, Homo sapiens
cagcccctgctgctggttctgcccctgctgcagcagaggagaagaaagatgagaagaaggaggagtcttaagagtcagatgatgacatgggatttggcctttttgattaaattcctgcttccctgcaaataaagcctttttacacatca

SEQ ID NO: 2685 - DNA, 296 bp, Homo sapiens
cgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacacacggtagttttgtgtgttggctgctccactgtcctctgccagcctacaggaggaaaagcaagggcttacagaaggatgttccttcaggaggacgcagcactaaaagcactctgagtcaagatgagtggaa

SEQ ID NO: 2686 - DNA, 142 bp, Homo sapiens
caagactgttatcgagtacccgtcacagaagaacctcacggctcccccatcatttgacattgcaccatagacataggagggccgagcaaggaatttcgggtgttggacataaggggcccggtctctctctctttgtaaaaaa

SEQ ID NO: 2687 - DNA, 181 bp, Homo sapiens
caagactgttatcgagtaccggtcacagaagacctcacggctcccatcattgacattgcacccatggacataggaggcccgagcaggaattcggtgtggacatagggccgttctgctcctggtaaaaccttgaacccagaaccaccacattccgttgcaaacccaaaggacccaggtactt

SEQ ID NO: 2688 - DNA, 118 bp, Homo sapiens
ctcatttggtcacagtgtataatccttacatatattgctaaaaattggcttgctagtactttgttaagtatgtttgcattaataatcataagggatattggtttgtagttttcctctt

SEQ ID NO: 2689 - DNA, 172 bp, Homo sapiens
tttcaagtggctattatgtaatataaattcacagcacattgtgaatagagcctacatgacaccatacactttgttgcccactgacatgttaccagaggttgtaccatgatgttgttttgacccctgtgagctgatggccccggccctcttctgtacacatttctgtccgtgt

SEQ ID NO: 2690 - DNA, 230 bp, Homo sapiens
tgttggtggagcctgcatttacaaggtacttcatgcccaagagcaccatttaccgtggagagatgtgcttttttgattctgaggatcctgcaaattcccttcgtggaggagagcctaacttcctgcctgtgactaaggaggctgacattcgtgaggatgacaccattgcaatcattgatgtgccttccccagtttctctgatagtgaccctacagcaattatacatgact

SEQ ID NO: 2691 - DNA, 108 bp, Homo sapiens
ctcgtgccgaattcggcacgagctaaggggggtgtatattatcttctggtgcatgttcttttctggaaaatatggtagctcgccaacacaatctgctcatctgatatt

SEQ ID NO: 2692 - DNA, 255 bp, Homo sapiens
gatccatccatctccagggagcaagacagagacgcaggaatggaaagcggagttcctaacaggatgaaacttcccccatcagttcccccagtacctccaggcaagtagctttccacatttgtcacagaattcagaggagagatggtgttggggagccctttggagaccgccagtctcccaggccccctgcatctatcgagtttgcaatgtcacaccctctctgatctcgtgctcagcatgattctataatagagt

SEQ ID NO: 2693 - DNA, 165 bp, Homo sapiens
attcaagatactgcatatagtccgggtgtggtggctcacgctgtagtccagctattcgggaggctgaggcgggagagttgcttgaacctgggaaggcagaggttgcagtaagccgagatcatgcctctgtactccagcctggtgacagagcgagactccatctca

SEQ ID NO: 2694 - DNA, 160 bp, Homo sapiens
ctgcccatagcccagtgctcaggtcagcactcacagaccagactccaggccacaaccagtaccaggccattcccctgtaaacccaggcttaatacctgtaaggaaccaggccggccccatggacccagatccaggctatctttagggatacagttccctt

SEQ ID NO: 2695 - DNA, 337 bp, Homo sapiens
gctcttcaagcgcatctcggagcagttcactgccatgttccgccggaagcctttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttccttagccgtcttactcactgccctttcctctcctcagatttgtgttgctgcctctatctgttttggtttttctctgggggggtctagacagtcct

SEQ ID NO: 2696 - DNA, 320 bp, Homo sapiens
agggccacaaagtgaccaagaaccgtgagcaagcccaggcacagccgacgccgcgggcgtcttgaaccaaacacaccaagttcgtgcgggacatgattcgggaggtgtgttggctttgccccgtacgagcggcgggccatggagttactgaaggtctccagggacaaacgggccctcaaatttatcaaggaaagggttgggacgaacatccgcgccaagaggaagccggaggagcttagcaacgatctggccgccataaggaaagctgctgccaagaaagacttaagccctccctgcctctcctaaaataaggcaagctk

SEQ ID NO: 2697 - DNA, 349 bp, Homo sapiens
gggatcttggggaacccctcctaggagagctgcagtctcttccctcaggggaacatcccagaatgcatatcgatcagctctcagccaggcttcgacaatcttgcagcccccactaggtggacacattaatgatttggtttctcccctgggcagccaacctgccccagaggcaccagacctgggtctttcagctttgggaccaggctgcccaaaggtactcctatatacaccgggcaccttccacgagagatggtactcccaagcaagcccctatgatgtgccactatagatggaaccctgacttctgcccaatcctttcctcccaacctagacccaggccataaggtcg

SEQ ID NO: 2698 - DNA, 349 bp, Homo sapiens
aagaagcgcgaagagccgtttagtcatgccggtgtggtggcggcggcggagactgcgggcccgtagctgggctctgcgaggtgcaagaaagcctttgaggtgaagtgttatgaaagtcatcataacagatgttttccaaaaacttgtagaaagttgtgaaaaaactactaggatcacgcggcatgtattgagcatataggttgctgtagatgaagtgttcttagctgtcatgtttaaaaatacttctgcttcgatacctcaagtgtggcatgcagcattttgggagggaaaatttgagacgtgttcagaacacatgcacagacgcaattgatgaaaatgagcattttac

SEQ ID NO: 2699 - DNA, 278 bp, Homo sapiens
caccttccccgccagacccagacttgggccgttgctctgacatggacacagccaggacaagctgctcagacctacttccttgggagggggtgacggaaccagcactgttgtggagaccagcttcaaggagcggaaggctggcttgaggccacacagctggggcggggacttctgtctgcctgtgctccatggggggacggctccaccagcctgcgcactgtgttcttctctaagaggctccagagaaacggcacacattcattagagactgagcagag

SEQ ID NO: 2700 - DNA, 234 bp, Homo sapiens
cagaaacaaatatgcgcatctctttctctatttgatcaaatgaaaattttaactagaattgtctgatatttaagagaaacattcaggacctcatcattatgtaggggctttgttctccacagggccaggtaagatgatagccttctgaggctgccacatcagaaatcacgcaggcattcctgggtaggcggcctccagttttcctataagtcgcgaccgctgtacgtttggtca

SEQ ID NO: 2701 - DNA, 311 bp, Homo sapiens
ctcgtgccgaattcggcacgaggaaaattctcggatatgaccgctgtgatgcgggctggttggcggatggcagcgtccgctacccgatctctaggccaagaaggcgctgcagtcctactgaggctgcagttcgcttcgtgggtttccagataaaaagcataagctgtatggtgtctactgcttcagagcatacaactgaatgtgccttaggagcgcatcagttttaaaggtcattaggaccatgttaaagggtgtttttttttcccaatatgacctcaggcaggttcccaactctgtgataccctttctca

SEQ ID NO: 2702 - DNA, 224 bp, Homo sapiens
atttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgacatagacctttatatttttgcatatgtatagatagtaattatatt

SEQ ID NO: 2703 - DNA, 228 bp, Homo sapiens
tgaactatcctgcccgccatcatcctagtcctcatcgccctcccatccctacgcatcctttacataacagacgaggtcaacgatccctcccttaccatcaaatcaatttggccaccaatggtactgaacctacgagtacaccgactacggcggactaattcttcaacttcctacatacttcccccattattcctaggaaccaggcgacctgcgattccttgacggtgr

SEQ ID NO: 2704 - DNA, 218 bp, Homo sapiens
tttttttcaaagaccacaaagatttaatttaaaatcacagtgtctcagctggaatgccccgtccatagcgggcacccctgcaaattaaaagttcctcaagaggccccttccaagccccagcaacaaggggtgagcagggcccaactgggggtcttgccaagctttgcccctccacatgattttggagaggaggcccagatcttaggtctagatgggca

SEQ ID NO: 2705 - DNA, 179 bp, Homo sapiens
cagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcg

SEQ ID NO: 2706 - DNA, 213 bp, Homo sapiens
cctggctgcccctgacagtggggatatgcaaggggctctggccaggccacagtccaaatgggaagacaccagtcagtcacaaaagtcgggagcgccacacaaacctggctataaggcccaggaaccatataggagcctgagacaggttccctgcacattcatcattaaactttacaggatgaggctttacatgagttaattacaaaagggtca

SEQ ID NO: 2707 - DNA, 191 bp, Homo sapiens
tcccgccagaagaggctgagccacacactgagcccgaggagcaggttcctgtggaggcagaaccccagaatatcgaagatgaagcaaaagaacaaattcagtcccttctccatgaaatggtacacgcagaacatgaaaccgagcatagttaccacgtggaagagacagtttcacaagtctgtaatcagggr

SEQ ID NO: 2708 - DNA, 233 bp, Homo sapiens
gcagtggtgctgtcatggcttactgtggccttgaccttctgggttcaagtggatcctcctaacctcagcttcccaagctgctgggggccataggcacataccaccatggcccggctaatttttctgtttcttgtagagacagggtttcaccatgttgcacaggctggtctcaaactcctgagctcaagcaatctgccttccttggcctcccaaagtgctgggattacaggagt

SEQ ID NO: 2709 - DNA, 300 bp, Homo sapiens
cagacgtgaacagcgtgggaaaatatttctcagtaataataaaaaatggtactttgttaaagtttacagcggcttgcagtcatgggtttgtaatctctcttgtccattctaaaagtaggtaggtggctttcaacagactcccttctcccattaatgttttgttctgctgaagaagcttggaattaaaggagctccgtgtgtggctattccgagacagagtttgagccttctgcaggctggacccaggcctgcaggctcttttttcccgagaagtgaagtatgatggagtccagatcttag

SEQ ID NO: 2710 - DNA, 125 bp, Homo sapiens
aaaaccttgaccaatttaaaagagtagacatcatataagtatgctctcaggccataatggcattaaagtaggaatctctaacagaaagatggctagaaagtcccaaaatacttgtatacaaaaca

SEQ ID NO: 2711 - DNA, 400 bp, Homo sapiens
  misc_feature 112, 209, 218: n = A,T,C or G
aaaaccttgaccaatttaaaagaatagacatcatataagtatgctctcaggccataatggcattaaagtaggaatctctaacagaaagatggctagaaaatcccaaaatacntgtatacaaaaaaagctctaagtaacacatgatcaaagaagtgtgaagagaaattaaaaaatatattgaactaaataaaaacattttcatttacaanccatcaaanttcgtgggatgcagcaaaagcagtgctcagaggcaaatttatagcattgagtgcatgtattagaaaagaatccaataaattaagcctccaccttgtagactaaaaaaaaggacaaattaaatccaaactaagcagaagaaaagaaatagtaaaaatcagatcagaaatagtgaaattaaaaa

SEQ ID NO: 2712 - DNA, 182 bp, Homo sapiens
cggcacgaggataaacctaatattcaatgaacttccatttgtattcaaatttgtgtcataccagaaagctctacatttgcagatgttcaaatattgtaaaactttggtgcattgttatttaatagctgtgatcagtgatttcaaacctcaaatatagtatattaacaaattaaaaaacaaaa

SEQ ID NO: 2713 - DNA, 234 bp, Homo sapiens
aagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcggttcttattctggcatttt

SEQ ID NO: 2714 - DNA, 281 bp, Homo sapiens
aacaagatttgctgcatttccggcaatgccctgtgcatgccatggtccctagacacctcagttcattgtggtccttgcggcttctctctctagcagcacctcctgtcccttgaccttaactctgatggttcttcacctcctgccagcaaccccaaacccaagtgccttcagaggataaatatcaatggaactcagagatgaacatctaacccactagaggaaaccagttttgtgatatatgagactttatgtggagtgaaaattgggcatgccattacaat

SEQ ID NO: 2715 - DNA, 159 bp, Homo sapiens
ctcggccatagaagacacgtgccatgcgccgccggctcaacaagcacgaggagaacctgaagaccaagaagcagcagcggaaggagcggctttacccgctgcggaagtacgcggtcaaggcctgaggggcgcattgtcaataaagcacagctggctgag

SEQ ID NO: 2716 - DNA, 304 bp, Homo sapiens
gaaaggtgtccacagccacaaaaagaagaagatccgcacgtcacccaccttccggcggccgaagacactgcgactccgggagacagcccaaatatcctcggaggagcgctcccaggagaaacaagcttgaccactatgctatcatcaggtttccgctgaccactgagtctgccatgaagaagatagaagacacaacacacttgtgttcattgtggatgttaaagccaacaggcaccagattaacaggctgtgagagctgtatgtcattgtgtggccaaggtcacacctgattcggcctgtggag

SEQ ID NO: 2717 - DNA, 279 bp, Homo sapiens
tattagtccgttttcacactgctgataaagacatacctaagactgggaaaaagaggtttagttagacctacagttccacatggctggggaggcctcagaatcatggcaggagttgaaagacacttcttacatggtggtggcaagagaaaatgaggaagaagcaaaagtggaaatcctgataaacccattgatctcataagacttaattactatcacaggaatagcacgggaaagactggcccccatgattcaaatatctccccctgggtccctcccaca

SEQ ID NO: 2718 - DNA, 300 bp, Homo sapiens
atctaaaaatgtggaagtgaatttggaactgggtaacaggcagaggttgaacagtttgcagggttcggaagaagacagaaaaatgtgaggaagtttggaacttcctagagacttgcagaatggttttgaggaaaatgctgatagtgacatggacaatggagtccaggctgaggtggtctcatatggagatgaagactcgttgggaactggagtaaaggtgactcttgctatgcaaagagactgacggcattttgccctcccttagaaatctgtggactttaaacttgagagacatagttt

SEQ ID NO: 2719 - DNA, 294 bp, Homo sapiens
gctgtttctgggctggtttttaaagtagctgcaacagaatcatgaggctttccctttttatcaaatacgaaaaacattttttaaaattctgcacacccagtgatcatcttttgtgcgggaaagcaagatgatgatggatgattttattcatccttttagtaaagacacaaaacatttttctcaacatttgtacagttctgaaaaaaacctggtcaccaaaaatatcttctctgctaattcagcaattcttgggctccagttaggggagctggggcctcactttctccaggaatt

SEQ ID NO: 2720 - DNA, 303 bp, Homo sapiens
cacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggctccaggccctgaggcccacttgctgccttcaacct

SEQ ID NO: 2721 - DNA, 286 bp, Homo sapiens
tgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaaggagaaggacgagctggagcgtgtggccaagtccaaccg

SEQ ID NO: 2722 - DNA, 256 bp, Homo sapiens
catccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagctgaccctcgtcgctgcgagtcaaaaagttggaggtcctggtgcccgcgctcgctaccagaaatcctaccgataagcccatagtgactcaaa

SEQ ID NO: 2723 - DNA, 217 bp, Homo sapiens
ctcaggaggctgaggcatgagaatcacttgaacctgggagacagagattgcagtgagccaagattgcaccattgcactccagtctgggcaacagagtgagactctctccaaaaagaaagaagaaaaaaaaaagtatccaggcttggtggcatgcgcctgtggtctcagccctcctgagtagctggacctacagtcatgtccatcactgttgcctaac

SEQ ID NO: 2724 - DNA, 231 bp, Homo sapiens
ggaggttcaaaaggtgtgcaacatgtatgtctgcaaagccacaaaaggtagtgacaaatgagtacctgacacacagaaatcaggacagtatataataagtgttaattgtacagaaggaagtttgagaaactggaaggtagaggtcactgtggtcaaactcttcaggacccattatgggggtggtattacaattcctttggtcacaaattatataattctaaccttttagag

SEQ ID NO: 2725 - DNA, 470 bp, Homo sapiens
ggaggttcaaaaggtgtgcaacatgtatgtctgcaaagccacaaaaggtagtgacaaatgagtacctgacacacagaaaatcaggacagtatataataaagtgttaattgtacagaaaggaagtttgagaaactggaaaggtagaagtcactgtggtcaaactcttcaagaaccattatgggggttgtattacaattcctttggtcacaaattatataaatctaaaccatatagaagggggatttattggcttacatggctaaagtgtgggagaagtgaggtagttctcagggaagccagaacggggaactccacaccacctacactttctgtcttatatctctgtgcctctttttttgtgtcagttttctccacattttggggtgtggctgcagcaagccagagatcacccagaaagaatgtctgaccttcttcccttcatttaaaattttcaaaatccccggaatggg

SEQ ID NO: 2726 - DNA, 301 bp, Homo sapiens
cctggacatcagcatctgaaaagttctgaggagtcttcagtgacctcattttatcgaattgtttaatgtgctttccacttgttgttcgagcagttagtgttttgtattgaaattcgtgcctgttcacatcctacactgcttgtgtttgggtggaaaccacttggggagatgctgcttgatatacagatcctggctccatctgtgcatttgaattcataggcatctggagacagtggcatagaggcagtgggcgcaggaaagttcaactcagagtttacacgagaaaagtgaaacccacttg

SEQ ID NO: 2727 - DNA, 241 bp, Homo sapiens
aaaacatttgtgagaagattcaaaagaggcaatctgggtcttcgtggggaaggactaggacccagaatcagaggagcagctgattagttacctgattaaatgtaagtaataatcattcttggcctcaggtacctgatccgttaaaaaaaactttttttctacattacttcagaggtgctttaaatataggattttttaaaaggtaggcaaaaacttaaaggttatgagtatgatgaaaata

SEQ ID NO: 2728 - DNA, 226 bp, Homo sapiens
tccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaggatgcaaatttaggctttgattggcactttttgaaaattatgcacca

SEQ ID NO: 2729 - DNA, 298 bp, Homo sapiens
gttagtagcatgttgagccaggcctgggtctgtgtctcttttctctttctccttagtcttctcatagcattaactaatctattgggttcattattggaattaacctggtgctggatattttcaaattgtatctagtgcagctgattttacaataactactgtgttcctggcaatagtgtgtcctgattagagatgaccatattatactagaaaagatacgacttaattttcctggtagatagagaattaatagctataccatgtcctgtagtttctctcaacatcaatgtccattgta

SEQ ID NO: 2730 - DNA, 274 bp, Homo sapiens
ctcgtgccgaattcggcacgagagcaagagaagaagcagagactgttggcccgggccgagaagaaggctgctggcaaaggggacgtcccaacgaagagaccacctgtccttcgagcaggagttaacaccgtcaccaccttggtggagaccaagaaagctcagctggtggtgattgcacacgacgtggatccatcgagctggttgtcttctggcctgccttgtgtcgtaaaatgggggttcccttactgcattatcaagggaaagccaagattgg

SEQ ID NO: 2731 - DNA, 278 bp, Homo sapiens
aggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgttaagccgcaagctcgatcgacttgcctacattgcccaccccaggtttgggaggcgtgctcgtgccctatttggccaaggggctcaggctgtccggccaaaggcaagggccaaggccaagggccaggccaagg

SEQ ID NO: 2732 - DNA, 300 bp, Homo sapiens
caagcccatgtgtgttgagagcttctcagactatccacctttgggtcgctttgctgttcgtgatatgagacagacagttgcggtgggtgtcatcaaagcagtggacaagaaggctgctggagctggcaaggtcaccaggtctgcccagaaagctcagaaggctaaatgaatattatccctaatacctgccaccccactcttaatcagtggtggaagacggtctcagacctgtttgtttcaattggccatttagtttagtagtaaaagactggtaatgataacattgcatcgtaaaacctt

SEQ ID NO: 2733 - DNA, 244 bp, Homo sapiens
ctcgtgccgaattcggcacgaggtgaggaaacaaagagtcgcttcacggagtattcgatgacttcctcagtcatgaggagaaatgaacagctgaccctacatgatgagaggtttgagaagtttatgagcaatatgatgatgatgaaattggagctctggataatgcagaattggaaggttctattcaagtggacagcattcgcttacaggaagttttgattgactactataaagagagggcaga

SEQ ID NO: 2734 - DNA, 204 bp, Homo sapiens
gttttggtgttagagttgcactaaactcagaacaccagttggaacatgttccttctatctctaatctcacggtgtataaaaaaatatttttttcctgaagtatttggaggaattcatcaggaaagcattctgaggctgcagtaacatttgtttttttgtgtgtgtggaaagattttcaatacagattcattctcattaatagat

SEQ ID NO: 2735 - DNA, 103 bp, Homo sapiens
ggggaggccagccacctccttcctctgggactgtccagcctagtgtcgggggctttcagggtttcgtggggtttgcccggaaggcggctatcctccccctagg

SEQ ID NO: 2736 - DNA, 102 bp, Homo sapiens
ggccttgaggggcgcatctgacaccgagatctcatggtttgcgggtagggtaggggtccagagaggtgagttctcaggagctcttgccacctggaggcgtca

SEQ ID NO: 2737 - DNA, 610 bp, Homo sapiens
cggcacgaggggcctggagggggcgcctctgacaccggaggacctgatgggtgtggcggggagggtgggggtgccggaggaggtgacggtcctgaggagcctgctttgcccagcctggagggcgtcagtgaaaagcagtacaccatctacatcgcacctggaggcggggcgttcacgacgttgaatggctcgctgaccctggagctggtgaatgagaaattctggaaggtgtcccggccactggagctgtgctatgctcccaccaaggatccaaagtgaccccaccaggggacagccagaggaaggggaccatggggtatccctgtgtcctggtctatcaccccagcttctttgtcccccagtacccccaacccagccagccaataagaggacacaaatgaggacacgtggcttttatacaaagtatctatatgagattcttctatattgtacagagtggggcaaaacacgcccccatctgctgccttttctaattgccctgcaacgtcccatctatacgaggtgttggagaaggtgaagaaccctcccaatcacgcccgcctaacaacaacaaacgtgcttttttcctccttgaaaaaaaaaaaaaaaa

SEQ ID NO: 2738 - DNA, 102 bp, Homo sapiens
cgaaaccagacgagctacctaagaacagctatagagcacacccgtctatgtagcaaaatagtgggaagattgttaggtagaggcgacaaaccttcccagcct

SEQ ID NO: 2739 - DNA, 154 bp, Homo sapiens
caaagacctggctttaagatgtttctgtggtttggcaatccgtggaggatagcttagggaaatagcctcagagcctgttgcaggagcactacttctacacggctgacttcaaggaccatcaaccagataggcaagaagttccaggagaagatct

SEQ ID NO: 2740 - DNA, 265 bp, Homo sapiens
aaaatgcacttcaggatcttgtcaatgaattgtttattaggttggtctttatcatcagtctggttatatctgtaaggttaggaaaatagcatagtgtcggttgtgaattattttcagagtgcttagcctttccagtagatgaagagtaacaacttttactaaattattgagatgtggattagggaattacatctggattggagttctatatctgtttcttgccaggtatgtgacctgggcaaattacttaatctttctaagccta

SEQ ID NO: 2741 - DNA, 450 bp, Homo sapiens
aaaaatggcacttccaggatcttggtcaaatgaattgtttattaggttggtctttatcatcagtctggttatatctgtaaggttaggaaaatagcatagtgtcggttgtgaattattttcagagtgcttagcctttccagtagatgaagagtaacagcttttactaaattattgagatgtggattagggaattacatctggattggagttctatatctgtttcttgccaggtatgtgaccttgggcaaattacttaatctttctaagcctcagtttttacatttgtaacataatataattgtacccattataaggttctgatgaggagtaaatgaaccaacatatataagttcttggtacagtgcttagcttatggtaaaggccagtaaaagttagttgctcctatcagcatcatctttaatataattagattatttcccctcttctctt

SEQ ID NO: 2742 - DNA, 270 bp, Homo sapiens
ccacacaggcttcctggacacctgcctgaaggactgcatgctcaccaaccccgagctgctgaaggtcttctccaagctcatgtctgtgtgcgtcatgttcaccaactgcatgcagaaatttacacagagcatgaaattagatggcgagctgggcgggcagacgctggagcacagcaccgtcctggggctgccgcagcccgaaggagcgggccggaaggagcttgccaggaagcacctgcttagcacgagcactttcagctgggttccgct

SEQ ID NO: 2743 - DNA, 270 bp, Homo sapiens
gtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttcagatggacagtacatctataaagggaaagtgatggcatctatatcataaatctcaaggggacctgggaggagcttcttctggcagctcgtgcaattgttgccattgaaaaccctcctgat

SEQ ID NO: 2744 - DNA, 290 bp, Homo sapiens
gtccttccgaggaagctaaggctgcgttggggtgaggccctcacttcatccggcgactagcaccgcgtccggcagcgcagccctacactcgcccgcgccatggcctctgtctccgagctcgcctgcatctactcggccctcattctgcacggcgataaggtgacagtcacggggggtaaggtcaattgccctcattaaagcagccggtgtaaatgttgagcctttttggcctggcttgtttgcaaggccctggcaacgataaattggggcctatcttcattgtggggccg

SEQ ID NO: 2745 - DNA, 275 bp, Homo sapiens
gctttgaacagggcccaggtggcagcattccctttcttgctggaaggctggggggtgaaagacggggccactgcagcccttttggagaccacacagctgttttcttggtaccaagtactttaagagacagcagcccatcccctcagcccacacccttgcgccctgtggacccgacaccacaaaggccaatgtttggagatttgcacaacctcccgttccccacatggagaggggagtaagttgaggcagccgtgggatggtggtaggctcctctt

SEQ ID NO: 2746 - DNA, 260 bp, Homo sapiens
tactgctgttgctgttctctgtacttggcccagggctggaggcttttcctgactgattactccacctgctcaccccgcaagctgagtcctttccgctcctttgccagcaccgagctcttccacttccatgttcctgaggacacattcctggctgtttggaacctcatcatcttcaaggagcaagggggcacttttgggcacactccccacacaaagtgtgactgctgtatctccggtccgggcacccctgtcatcaatcc

SEQ ID NO: 2747 - DNA, 305 bp, Homo sapiens
caagcacagaggggcatgatcagacagctctggggcacagactgagaggaggaactcagcacacccttcctttccaaggccagtgacattgtctgacagtggttgccttcaagcaggcagcatcttggttgcttccagcggcagaaagctggccagtgcttacacacgtgtttccagttggagtgttatcagccatggttctgacaatattctagggtccttagatgagcacacttcctgtatctgcattatttttatagcattagtggggttgatcccaggctcacctttctcacaaatacatc

SEQ ID NO: 2748 - DNA, 192 bp, Homo sapiens
cttgattcccataacataaaagtgctacttgagagtgagggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctgg

SEQ ID NO: 2749 - DNA, 317 bp, Homo sapiens
tgcttacctgctaaccagtttacccctggagtggtcctgtttgaccctcaccaggtgccctgagattgccctccaggataagccttgttttgcatggaccgaggggtgcaaggaattcctgtctcatatttgtggagggagtcatatgcacaggctagcaggatttctcctgttgcaccatcctctgcctactcaaccttctcagcagaaccctttgatcctggcgcttccctccaaacaatagcatcttcagggcttaacacaaaagaacagtggaccataaggacaggcctggctccaggccttccttcctcata

SEQ ID NO: 2750 - DNA, 280 bp, Homo sapiens
agaaagcatttggtttagacgtgttgggtgtgaggtgccatggaatagcagggtggagctggtgggggaagctggggggctgccctggggctctagcacatggaggccaaggagggagtcgtggggtggagggggcacagggctcccaaaggtcctgggtctgcctcagggccgctgctactccacacccttcctccatgcctgagcacccatggcagtaccagcagtgaccatcatacccaatggggatggagagaactgaggctggcctgagatgtcc

SEQ ID NO: 2751 - DNA, 527 bp, Homo sapiens
agaaagcatttggtttagacgtgttgggtgtgaggtgcccatggaatagcagggtggagctggtgggggaagctggggggctgccctggggctctagcacatggaggccaaggagggagtcgtggggtggagggggcacagggctccccaaggtcctgggtctgcctcagggccgctgctactccacacccctcctcccatgcctgagcacccatggcagtgaccagcagtgaccatcatcacccaatgaggatggagagaaactgaggctggcctgagatgtcctgaggaatgagctggcaccggagtcccacaggtgaagggtgagcatggatgggccgggagcatgctccctgtaattgtgcatggcgcagaaggtcaagaacggcctggtggccccgtgggagactggttactccaatctggtccagcagaaccccaggcagcctcgttggaacgttgggggaagtgtctaatgcttagcgatgtggcagatgccccggagtgccgttgagcctttataacag

SEQ ID NO: 2752 - DNA, 311 bp, Homo sapiens
ggaaatcagtttactcatcacagatgtattatatcctagaagcaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgttccatgaaggaagctgcctgctcctaaggtgtgctactggagtaaagcactccggatcttgcaactgtgagtccgatttttacctcgctgccatttaaggctttccag

SEQ ID NO: 2753 - DNA, 214 bp, Homo sapiens
tctaagagccgtgttcttcatggaattttccaggccacttggcagcttgggtttaccgatgggatggggctagagatcttgtcggttcttgggaggtcacaagggaagattgaagagaacgcttgagcatccttgggcaacagcccaggtgggacctggatgaagctttgcactcaagtattgtcaagggaagcttcctgtgaaccaaagttct

SEQ ID NO: 2754 - DNA, 107 bp, Homo sapiens
agcaccattggcgggttggcaagaacaagcgccgtacgaaaggcggcaaaaaggggagccaagaaggaaaggggggtgagtccagtgttctgaagaaagaattggga

SEQ ID NO: 2755 - DNA, 205 bp, Homo sapiens
catcagacaagagatcattaaaatgtttgatgagagaatggcttactacacctccaggatgcagttccccatggagatggcggcagtcccgggacgaccagggcctccagggaaggatggtgctccgggcaggcaggtgctccagggtaactgggctcctggtaagattgcagagaaggacggcagggcttcaggagtaagagat

SEQ ID NO: 2756 - DNA, 218 bp, Homo sapiens
gtcacccgtaagattggcaatgcagtggaaccacgctgcttgaggctctggactgcatcctaccaccaactcgtccaactgacaagaccttgcgcctgcctcttcaggatgtctacaaaattggtggtattggtactgttactgttggacgagtggagactggtgttctcaaacccggtatggtgggcttcaatgtcaagaatgtgtctgtcaaggat

SEQ ID NO: 2757 - DNA, 259 bp, Homo sapiens
tgagtctccctgcagcccaagtggaagctttgctcctaacaagcacaagctgccaattgttaccttcttctgagagccttgctaaaaaagtaactctgggaaaactcttatagggttcctgaccatgaatccatcttttttattcccccaaaagttattcaactattagatcaatggataataactatgaggttttgggtgactatttagatggaggaaagtgtattaaggttggaaactaaatactatacttaatact

SEQ ID NO: 2758 - DNA, 105 bp, Homo sapiens
cggcacgagaaaaaaattgcataatcttgagcctaactaagaaaagcataaagaatattttgttttctgtgttcttcaagggcatctgggacaacaggattgtga

SEQ ID NO: 2759 - DNA, 530 bp, Homo sapiens
aaaaaatgcatatctgagcctactagaaaagcataagaatattttgttttctgtgttcttcaaggcatctggacaacaggattgtgatagttctatgtgcttttaagtaaacctccctaattcttgaggaggagaaaaaggtgaaattccttggagcatatagggtacaaacattgggaatttttgccaataattgttcttctgagacaaacacagacaaaatggtgaatataaaaacactgaaagtgctttctttaaacagaagactgagacaagaagatagataccaccactatttattaatggactagaaaaattgattaatgcaatttgaaaaggaaaatagatgaaggataggtaaagataattagtaaaactatcacattttgagggtgatataataatatcactttaaaactcgagagtacttctagagcggccgcgggcccatcgattttccacccgggtggggtaccaggtaagtgtaccaattcgccctatagtgagtcgtattacaattcactgggggc

SEQ ID NO: 2760 - DNA, 359 bp, Homo sapiens
cagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtagtatggagatgcacaacagattggccagtatatgcctaatggttggcagttcctgcatatggatgtatggccaggcatggacccagcgaggatttatcagacacagtcttctgcaccatggatgggcccaattatggagtgcaccgcctcaagggcaaaatggcagcatgttgcccaatcagcctctgggtatcgggtggcaggtatg

SEQ ID NO: 2761 - DNA, 368 bp, Homo sapiens
gagctggagaaggccatggtggccctcatcgacgttttccaccaatattctggaagggagggagacaagcacaagctgaagaaatccgaactcaaggagctcatcaacaatgagctttcccatttcttagaggaaatcaaagagcaggaggttgtggacaaagtcatggaaacactggacaatgatggagacggcgaatgtgacttccaggaattcatggcctttgttgccatggttactactgcctgccacgagttctttgacatgagtgagattagaagcagccaaacctttctgtaacagagacggtcatgcagagagcagacagcagggctttcagctagtaggagctgagctttccagccgtg

SEQ ID NO: 2762 - DNA, 202 bp, Homo sapiens
ctaatgctgttttgagattctgagattaatgagaatacttatttcagagatgcatttaatgcttttcttcttgtgacagtgacgcagatcagcttgagttccatatgtccctgagttatttttatcatagaggccacagatgtattataacacggcaaattgtaatatatataattcctgaactcatgaccatgtctcggtt

SEQ ID NO: 2763 - DNA, 229 bp, Homo sapiens
gccggctacactgcgctgcactatgccagccgcaatgggcactacgctgtgtgccagttcctgctggaaagcggacgaaagtgtgatgcccagacccacgggggtgccactgctctgcaccgagccagctactgcgggcacactgaaatcgcgcggctcctgctatcacatggggtccaccccagggtggtggatgacgacggcatgaccagtctgcataaggctgctg

SEQ ID NO: 2764 - DNA, 121 bp, Homo sapiens
ccctgccctgacccagacctggcgggctccactcatgaggcatttcttcacatccgtgtcccgcccggccgctggggagccccgtttcatcgccgtggctacgtggacgacacgcagttcg

SEQ ID NO: 2765 - DNA, 113 bp, Homo sapiens
cctatcatatagttaaaccccagcccatgacccctaacaagggccctctcaagccctcctaattgaccctccggccctagccatagtgatttccacttcccactccataaacg

SEQ ID NO: 2766 - DNA, 120 bp, Homo sapiens
gcaacggggtcaaaatgacccacacgctgcagttacaagaagggcagagggcagtcatggggcccaggaccatgccactggccctgctcccccagccgaagcttgaaacctacaggtgct

SEQ ID NO: 2767 - DNA, 272 bp, Homo sapiens
gaccaagaagaaggaagggggtgccctccggcccagagagcctcatccaatgtcttctccaactttgagcagactcagatccaggagttcaaggaggcattcacactcatggatcagaacccgagatggcttcattgacaaggaggacctcaaggacacctatgcctccctgggcaagaccaacgtcaaggacgacgagctggacgccattctcaaagaggcctctgggcccatcaacttcaccatgtttctgacctgtttggggagaagct

SEQ ID NO: 2768 - DNA, 260 bp, Homo sapiens
cggacatctctggggaaaggaaggtggcacagaccatgttccctggttcctccctgccccttgccaggcttccttattccttactatgggaagaggtcatatcccttccctgcccctcgctgtctttagcaagcaggtttcacttcttcattagaggaggacaagtcaaaagtgaatcatttttcactacttaagggataaatcccagagctttccagagacttgcttcttcagcccctgggaatttcttttggatttac

SEQ ID NO: 2769 - DNA, 302 bp, Homo sapiens
ctagaatccgcttaacccttggctgataacaggcaaatttcagtctgctacactttgttaggtccagaaggagctgcccatactactttcttatgagcatgctcagtatggcatatggacatgtaatgtcacatctttgtggagtgtgattttctttttttacatatttgtatgcagtagagagcctgttgtagaaaacgctccctgtatcttgctgtactgttaaagaaagctgaattccacattgccaacaaaagcgtgaaaatgttcatgaccttcttcaggaaagccattcaggctga

SEQ ID NO: 2770 - DNA, 206 bp, Homo sapiens
aaaaaaaaaaggaaaaccaaacacctcccttgaacaaatttatactcctgttcccaggatcttgagctttagtgtgctatacctatgtgtcttatcgtgggccactgtgccaataaacaaaaacacctgtttggtttacctcagttgcagtagttatttctatttagaggttgttctcagattattgcttcagctactattagagg

SEQ ID NO: 2771 - DNA, 212 bp, Homo sapiens
cggcacgagcagcaacccagggttgtcctgaaacagacttttatacttgaacatggagactgcacatggactttaggggttgtgctgtgggataaacggagctacagtgagaacatagccagtcccaaagacaatttcaaagagaaatgacagtaaagattagctgggagtagtctttgacagtgcttattttgatactgtctctcagcagt

SEQ ID NO: 2772 - DNA, 406 bp, Homo sapiens
ctcgtgccaatttcggcagaggggcattaaggggcccctggtgctcttggtttgaggggacctaaaggtgacttgggagaaaagggggagcgtggccctccaggaagaggtcccaacggtttgcctggagctataggtctcccaggtgacccaggccctccagctatggcagaaatggccgagacggtgagcgaggcccccaggggtggcaggaattctggagtgcctgaccccgggacctcctggcttccggtttctgtagcagcctcctgcaccatgcaggctggtagcgagcatttaacaaagggccttaccttgaaaggcttactgctgcatggctgtctcataaccacggctggtgaggagcctggttagaacacatccaagctgggcaaagatgattacc

SEQ ID NO: 2773 - DNA, 278 bp, Homo sapiens
ccgtgctttatcagagctgtttttaatgatgttattctagaatgttttctttccagatgatgattcagaagctaattttaaaaaacggtgccaggtaccacaacagtaacagaactttgcaattttctgggggtttgttttttacctttttcccccttttttttaaatggggtgtgctggatgtctctataattttatacagatgactgcagaaccctggaaaggctgttgctgctattgatgcataacatactgctattgggcttgttatataaata

SEQ ID NO: 2774 - DNA, 349 bp, Homo sapiens
aggcaagccagtcttctgtcttcctttgctaacttagggttttgagcaggttggggtatggtgcctgtcatacccacctgccaccctgggaacctcactgttctctctttcagcctagacctgctgatccagggtgtgtgttagttgagggtgggtggaggggtttgcagtgtgggaatgtggcccttcagttgaccttagctgcttcacatggttgtccattctggggcttaaagaactgggaccagaccaagtagaggccttggtgcttgttggggttgggcctccagagtcttagttactgatttcattttcaataaatgtagggttgttacatgagtttcccata

SEQ ID NO: 2775 - DNA, 140 bp, Homo sapiens
cctgccgcctcggtccaccttgcggcccgtgtttgactcaactcagctcctttaacgctaatatttccggcaaaatcccatgcttgggttttgtctttaaccttgtaacgcttgcaatcccaataaagcattaaaagtca

SEQ ID NO: 2776 - DNA, 268 bp, Homo sapiens
cggcacgaggtaattagttgttatgatgaggtcattagggtgggccctaatccagtatgactggggtccatataaaaatgggaaacttgtgcacagacacacacacaggaagaatgtcatgcgaggatgaaggcaatgattggggtgaggcttctacaccccaaggcatgccagtgatcaccagcaaatgtccagaggccaaaggagaggccttggaacatccctcagaaggacccaaccctgcaaacaccttgatcttgggaattcc

SEQ ID NO: 2777 - DNA, 130 bp, Homo sapiens
gtttttttttttagttgaatttaactttctttaaggggaaagaaattttacttacccaccaatttatttcagacccttttcaatttgcttaggagaaagagataggctttgtattaagagaaccctaccg

SEQ ID NO: 2778 - DNA, 460 bp, Homo sapiens
  misc_feature 350: n = A,T,C or G
tttttttttttgagtggaatttaacttgctttaagtggaaagtaattttactcacccatcaattcattgcagaccctgtgcaattagctgaggagaaagagtaaggcttagtatcaagagaacctcaccgttttggattcaaaagttgaggattccattaatattttcacacgtgtaaaacattttttaaacaatcgttgaatatgcttatgtgtttttttcacatgtgtaatttttgttttgttttgttttttgtttttaggtggagttttgctcttgttgcctaggctggagtgcaatggtgtgatctcggccacgagagtgaaactctgtctcgggggaaaaaaaancaattaaaaacggtgtgggcacattggcgcgtgcccgcggtcccaggctctgtactctggaggctgaggtggaaggatcgctcgagagtacttctagagcggccgcgggc

SEQ ID NO: 2779 - DNA, 164 bp, Homo sapiens
ggaaaactgaggtaaataaaggagagccattaattaagtggcactttcttgggaaagtgtacatctgaggaaaaagtacgttatgcaatttttgtatgaaatttttcatgagccaccccacccggcctcccactcttaactattttaatgtggtccccccctct

SEQ ID NO: 2780 - DNA, 620 bp, Homo sapiens
ggaaaactgaggtaaataaaggagagccattaattaagtggcactttcttggaaagtgtacatctgaggaaaaagtacgttatgcattttttgtatgaaatttttcatgagccaccccacccggcctcccactcttaactattttaatgtggtccccccctctgagccctacatgattttgtggactactttagtgttatccttcagttatcatattttaagattaattatcctattatttgctttcctctatatgtgccactcatgcttgaaagttactttaggccgggtgcagcagctcatgcctataatcccagcactttgggaggtagaggcgggcaggtcacttggggtcaagagtttgagaccagcctggccggcatggcgaagccccgtctctactaaaaatacaaaaaattagcgagcgcaaattgctgtaaatgggtagtaatagcacctaagcatagcataaggctttgaattagtaggtacttgggaggctgaggcaggagaatcgcttgaacctgggaggcggagattgcagtgtgctgataccgcaacactgtactccagcctaagtgacggagcaagactccatctcaaaaaaaaaaaaaaaaaaa

SEQ ID NO: 2781 - DNA, 194 bp, Homo sapiens
atttacaagtacttcatgcccaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctctccccaggctctctgatagtgaccc

SEQ ID NO: 2782 - DNA, 254 bp, Homo sapiens
gaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccggaaactgtggcgtgatgcccgcggggctctccagaaccatcatccctgcctctactggcgctgcaaggctgtgggcaaggtcatccctca

SEQ ID NO: 2783 - DNA, 225 bp, Homo sapiens
ggaaacatggcggacgacgtagaccagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggagaaactgtcactactatagaaattgatgaggaacatatgaggagat

SEQ ID NO: 2784 - DNA, 184 bp, Homo sapiens
ctcgtccgaattcggcagaggttttttttttttctatagacttttttcagataacatcttctgagtcataaccagcctggcagtatgatggcctagatgcagagaaaacagctccttggtgaattgataagtaaaggcagaaaagattatatgtcatacccccattggggaataagcataaccc

SEQ ID NO: 2785 - DNA, 147 bp, Homo sapiens
cggaggtgcaggtcctggtgcttgatggtcgaggccatctcctgggccgcctggcgcaatcgtggctaaacaggtactcctgggccggaaggtggtggtcgtacgctgttaaggcatcaacatttctggcaatttctacagaaacaa

SEQ ID NO: 2786 - DNA, 103 bp, Homo sapiens
gaagatgccgacattcagactgagcgtgctaccaaaaggaagcggacaattttaaaacaggaggaggtcctcttggagaaacttgcaagagaggttccgcggt

SEQ ID NO: 2787 - DNA, 111 bp, Homo sapiens
gcaggccatctcatggccatcacatccactggtgggctaggagcttaggatttcttgctgaaggtaagggacccagctaaacattggacccatctcacctgactcggggga

SEQ ID NO: 2788 - DNA, 520 bp, Homo sapiens
cagccatctcatgccatcacatccactgtggctagagcttagattctgctgaagtaaggaccagctaacattgaccatctcacctgactcgggagagaagaatctgttggaatttgatcacaagtgtgtgctgtcagatcgtcctagttcgggacacttttgtgtaaccagattttaaaaaccattttacattattcatgcccttgatctttcaagctgtggaacatcaatttcctcctcttcactttcaccactgttcacaaaagtaggtaaacggtggccccttttcccctcccagtttctttgattctgtggacttgtgctgatagccactagagggtgtaccaggggtctctggagtctgggtctcttacagatggatttgaaaagtcaaaagtcaatcattgcagagccctcagaggtgaagagccagactgcagtgcagatgcaggaacagaattttagagctggaattaatcaaggagaattaccacaagttgaaaaaaaaaaaaaaaaaaaa

SEQ ID NO: 2789 - DNA, 129 bp, Homo sapiens
cgtgagtgagtgcttgttaagtgctttgcagggtgcacccagttagcacttagacagtggtgctggtactattgttgttgtcattatgatttaagggcccttcagcactaaagaggtttagatttctgg

SEQ ID NO: 2790 - DNA, 430 bp, Homo sapiens
gttgggtgatttcgtgagtgagtgcttgttaagtgctttgcacaggtgcacccagtgagcactcagacagtggtgctggtactattgttgttgtcattatgattgaaggtcccttcagcactaaagagtttagatttctggactctaggtgggttgtatatttgacttggcactgtgtgctgggaatacagtaatgaacagcatcattacctgaggccttatgcagaagtgatagttacaatacaaagtgacagtgactgcgattggaatactgtggaattacacagacatatctcagtcatggagggtcagagtaggctccagagtaagagcccacggtatgagtaggcattgacaaatagaagggaaaagtaacccagagaacattccaaacaacaagaagagcatttgtaagcatggggcactgtaa

SEQ ID NO: 2791 - DNA, 194 bp, Homo sapiens
ggccacaaggggcgtccacccaggacaccgtctgggtcccactcaaggcccagtcccctcccagggccctggtctgagccccacacggccatctgcccagtccttgactcgtccatggagctgagggtcggaggaaccttccttgggggcagcagccttcccgggggcctacccagtgccccacagcagaaccc

SEQ ID NO: 2792 - DNA, 291 bp, Homo sapiens
aaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcta

SEQ ID NO: 2793 - DNA, 110 bp, Homo sapiens
tctcagaccacaccgtcggtttccttttcaacaatggtgctcacatgagcctccttccagacaaaaagtaagtgtatcaattaatgaattcctgtcagttctttagtctt

SEQ ID NO: 2794 - DNA, 205 bp, Homo sapiens
aattacaacaatcagtcttcaaattttggacccactgaagggaggaaattttggaggcagaagctcttgcccctatggcggtggaggccaatacttttcaaaaccacgaaaccaaggtggctatggcggttccagcagcagcagtagctatggcagtggcagaggattttatttaggaaacacagcttagcaggagaggagacca

SEQ ID NO: 2795 - DNA, 130 bp, Homo sapiens
ggtctacgccgagtgacagagacgctcaggctgtgttctcaggatgaccgagtgggagacagcagcaccagcgtggcagagaccccagacatcaagtctttgggaagtggagcaccgatgatgtgcagat

SEQ ID NO: 2796 - DNA, 101 bp, Homo sapiens
ttataaagcacacaaaaattcctcttgtgttctaacccctgggggttagctctagggttggtgtgtacaaggcatgtggatgatgatatgatgctgtggtg

SEQ ID NO: 2797 - DNA, 640 bp, Homo sapiens
tttataaagcacacaaaaattcctcttgtgttctaacccctggagattagctctaggattggtgtgtacagagcatgtagatatatatgtctgtgtgtaatttcatccggccatcactgaagctctgagggctgcttcttttagtttcaccttttcactccctctacctttctctcctggccattgtgtaaggatgcagatttggtgacctgataactgctctaactgattggtttattttttgcttcgtttcctgcttttcaacattctctactgatttgcttattttgcagcaagtacactctttttggagtttaccttttcaaaacaacattgtgctgaaaataaaaccactagagattatttgggtattgtaggatttttccccctccaaatgtacaagtaaatacagtataagaggcatgactcagtattttaagatatagaatgcaattttaaaaaattgtttgccattttatatatagatattagaggtgtaaaatgtgttcctacttttagcatttaagggggttcccttcctgttaaaaaaaggtaaaatttggctacgtaaccttttgggataacaagtttggggcaataatgaacccaaaaggtccattacaaaaaaaaaaaaaaaaaa

SEQ ID NO: 2798 - DNA, 140 bp, Homo sapiens
ggaacttaattcttttataatattgaaatgtccctcctttttaaggctaattttctacttttatactctatttatttccattttgacatctcacagacatttttttagcagtctttcttctaccacactttcttgttaga

SEQ ID NO: 2799 - DNA, 101 bp, Homo sapiens
cggcacgagcagaaaaataagttcaaggcagccttcgacatcttcggtgcttgggcgctgaggatggctgcatcagaaccaaggagctgggcaaggtaaat

SEQ ID NO: 2800 - DNA, 121 bp, Homo sapiens
gttgatatggttcctgggcaagcccatggtggtggttggaggaggcttctcaggactatccacctttggggtcggctttgctggttcggggatatggaggcagacaggttgcgggtggggg

SEQ ID NO: 2801 - DNA, 105 bp, Homo sapiens
cggcacgagagttatgagattgttactgttgggaaagaagaaagataaaggagaaaaaaatcttaggcaatacatgaacagtttttaagaacagatgtagcttgt

SEQ ID NO: 2802 - DNA, 297 bp, Homo sapiens
ccaagcagagctggaggcatccctgaaggagtcccgctccttgagcactgagctcttcaaactgaaaaatgcctacgaggaagccttagatcaacttgaaactgtgaaacgggaaaataagaacttagagcaggagatagcagatctcacagaacaaattgctgaaaatggcaaaaccatccatgaactggagaaatcaagaaagcagattgagctggaaaaggctgatatccagctggctctcgaggaagcagaggctgctcttgagcatgaggagccaagatcctccgaatccag

SEQ ID NO: 2803 - DNA, 100 bp, Homo sapiens
agtacttctagagcggccgcgggcccatcgattttccacccgggtgggtaccaggtaagtgtacccaattcgccctatagtgagtcgtattacatttaac

SEQ ID NO: 2804 - DNA, 142 bp, Homo sapiens
gccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagat

SEQ ID NO: 2805 - DNA, 169 bp, Homo sapiens
gttcggtgcagtatctgtaatctcagcactttgggaggctgagatgggaggatcatgggaacccaggaatttgagacatgcctgggcaacatagtgagacttcatctctataaaaaacttaaaaaattagccaggcatggtggcacacactgtgtaccagctacttagg

SEQ ID NO: 2806 - DNA, 152 bp, Homo sapiens
ctgaccaggaattctttgtggacattggcccagtctgtttcaaataaatgaactcaatctaaattaaaaaagaaagaaatttgaaaaaactttctctttgccatttcttcttcttctgttttaactgaaagctgaatccctccatttcctct

SEQ ID NO: 2807 - DNA, 183 bp, Homo sapiens
gatgaatggaggtcattacacctactctgagaatcgtgtggaaaaagacggcctgattcttacaagccgggggcctgggaccagcttcgagtttgcgcttgcaattgttgaagcccttaatggcaaggaggtggcggctcaagtgaaggctccacttgttcttaaagaaatagaggagccaac

SEQ ID NO: 2808 - DNA, 127 bp, Homo sapiens
ggcgcctgtagttccagctactctggaggctgaggcaggggaatcacttgaactcgggaggcagaagttgcagtaagccgcgatcgggccactgcactccagcctggcgacagagcaagactgtcta

SEQ ID NO: 2809 - DNA, 198 bp, Homo sapiens
ctcacattgcatgcaagtttgctgagctgaaggaaaagattgatcgccgttctggtaaaaagctggaagatggccctaaattcttgaagtctggtgatgctgccattgttgatatggttcctggcaagcccatgttttttgagagcttctcagactatccacctttgggtcgcttttcttttcgtgatattagacaaa

SEQ ID NO: 2810 - DNA, 223 bp, Homo sapiens
aaatactttataatagacctattaatagaatatctcaatgcaaattcaatttgtagaagtcgaattctatttgttcatagacttataaatgaataaatactttatcttaatttctcattgattttcagttagttttattttttacactttggctatgaagtgtgggcccaaggtctctttcaaaaagttttaattatataaatgggcctaagtccaccccagg

SEQ ID NO: 2811 - DNA, 290 bp, Homo sapiens
aaatactttataatagacctattaatagaatatctcaatgcaaattcaatttgtagaagtcgaattctatttgttcatagacttataaatgaataaatactttatcttaatttctcattgattttcagttagttttattttttacactttggctatgaagtgtgggcccaaggtctctttcaaaaagttttaattatataaatgggcacttaagtgcaaccaaagaagcaaaatatctttgaaaaattttcaatatctccttttgtaaagcaaaaaaaaaaaaaaaaaaa

SEQ ID NO: 2812 - DNA, 209 bp, Homo sapiens
cggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgggggcgg

SEQ ID NO: 2813 - DNA, 309 bp, Homo sapiens
ggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgacttctgtagttcagaagaggtttggctttcagaggcagtgtagagctttatgctgaaaaggtggccactagaggtctgtgtgccatttcccaggcagagtctc

SEQ ID NO: 2814 - DNA, 232 bp, Homo sapiens
gtagtttatataaaggaagttaattgttagggaggattttctctgttactctgaaattgttttcaaatgtgatatagtctgagagtattacttgactcattctttttttttttggtgacaaagtctcgctctgtcacccagggtggagtgcaggggcaccatcttggcttactgcagcttctgcctcccaggttcaaatgattctcctgcctcaaccaccctagtacctggg

SEQ ID NO: 2815 - DNA, 293 bp, Homo sapiens
gtgaagcaggcgtcggagggccccctcaagggcatcctgggctacactgagcaccaggtggtctcctctgacttcaacagcgacacccactcctccaccttcgacgctggggctggcattgccctcaacgaccactttgtcaagctcatttcctggtatgacaacgaatttggctacagcaacagggtggtggacctcatggcccacatgggcctccaaggagtaagacccctggaccaccacccccagcaagagcacaagaggagagagagaccttacttcttgggagtcct

SEQ ID NO: 2816 - DNA, 110 bp, Homo sapiens
cctgaaggctaaagctttaccataaacagcgtcatgctgagagaatacaaatgaaaaaggactatcaaggattgcatgaaaaggggagccaccaaccaaaaggattgttg

SEQ ID NO: 2817 - DNA, 302 bp, Homo sapiens
cccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtccccctgcggtgaagaacttcgggatctggctgcgctatgactccggagcggcacccacaacatgtaccgggaataccgggacctgaccaccgcagcgctgtaacccagttctaccgagacatgggtgcccggcacgcgcccgagcccactccattaagataatga

SEQ ID NO: 2818 - DNA, 308 bp, Homo sapiens
acttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcaggttcggatgagaccaggtgttgcttgttcagtatctcagccca

SEQ ID NO: 2819 - DNA, 303 bp, Homo sapiens
ctcttgtcaaattttagtttaattggcattgcttgttttttgaaactgaaattacctgagtttcattttttctttgaatttatagggtttagatttctgaaagcagcatgaatatatcacctaacatcctgacaataaattccatccgttgttttttttgtttgtttgttttttcttttcctttaagtaagctctttattcatcttatggtgcagcaattttaaaatttgaaatattttaaattgtttttgactttttgtgtaaatatatcagatctcacattgttggtttcttttgtttcca

SEQ ID NO: 2820 - DNA, 244 bp, Homo sapiens
ggatccagtgcgcaaaaaaccctacccggggcccttcccagaagcaataagttcctctgcggacccggggctggaagagagccccgctgccttggagccgccctcctgaagcttgaaaatggaggaatttagttttgttggttgaattgaaaatggcgacttgagaaacaactgtgccttcttttcttcctttcttttttttaaacctctacagacacattcctcacaccaaccaaaactcagt

SEQ ID NO: 2821 - DNA, 570 bp, Homo sapiens
ggatccagtgcgcagcacagacctacccggggcccttcccagaagcaataagttcctctgcggacccggggctggaagagagccccgctgccttggagccgccctcctgaagcttgaaaatggaagaatttagttttgttggttgaattgaaaatggcgacttgagaaacaactgtgccttcttttctttctttcttttttttaacctctacagacacaatcctcaaaccaacaaaactcagtatacacagccgctattcattgagggctggatacctcaacaagactgagagcctttccccgcttctctccaagaaggagacgttcagctagatttgttcccatttccgttgtgttaattcaaagctcatgctcccctacggtacaggctgaggtacacggttagcaaaaccatgggaaggggaatggcggtgcatatcattaactaacactccaaacaaaggtgagcttgcccaggacttggcatttccaaatcaaagtttttagatatgaacacctactgtgagttctgctacaaagcacaaatgaattgtcccaactatgcaattt

SEQ ID NO: 2822 - DNA, 290 bp, Homo sapiens
ggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggcccccaagcagtacacttgctggtctaggtatt

SEQ ID NO: 2823 - DNA, 257 bp, Homo sapiens
ctcgtccaaatttcgggcagggttgcctctgacgattattggatgcatactttggttttaagaagaatgccattgaacacccagttcgaaccaatcagattccacgtcagattcctgaacagtcgttctacacgaggcccttgcctggtattatcatgggagggattttgccctttggctgcatctttatacaacttttcttcattctgaatagtatttgggtcacaccagatgtattacatgtttggcttccattt

SEQ ID NO: 2824 - DNA, 162 bp, Homo sapiens
ctcgtccattttcggccgggggaattgaagccagagacaggaaagccaagatgacagattttgatcgttttaaagttatgaaggcaaagaaaatgaggcacagaataatcaaggatgaagttaagaggcttcaaaaggcagctctcctgaaagcttctccca

SEQ ID NO: 2825 - DNA, 228 bp, Homo sapiens
ctcgtcccttttgaatggtttttcttttcttatttttaaagaaatgcacttgcctatgatactgtctctccagtgaaatgattactcctccattactctattgatacaatattgtgcatgctagtgttgtatttctatacagtagcttgaaattgattaacctatactgtaggggttatgtattcctatgacaaaaaaaaattaagtcttcaaattttttaaagggtt

SEQ ID NO: 2826 - DNA, 264 bp, Homo sapiens
ggactacaatggccacgtcggtctgggtgttaagtgctccaaggaggtggccaccgccatcccgtgggggccatcattctgtgccaagctctccatcgtccccgtgcgcagaggctactcggggaacaagatcggcaagcccacactgtcccttgcaaggtgacaggccgctgcggctctgtgctggtacgcctcatccctgcacccaggggcactggcatcgtctccggacctgtgcctaaagaggctgctcatgatggctgg

SEQ ID NO: 2827 - DNA, 165 bp, Homo sapiens
tgaaggtagaccccatctctcaccatacacaaaaattaaattaaatggattaaatacttaaaccaaagacctgaaagtataaaactactagagggtatcattagggaaaggctctcggatactggtttttgagagacattttgtgtaagactcaaagcacaggta

SEQ ID NO: 2828 - DNA, 192 bp, Homo sapiens
gccattttttagctttgcccattgtcttattggcacatgggtggacacggatcttctgggctcttcctttaaacacacattgcagcttcacctttctctttagtgttctgtttgaactaatacttaccgagtcagactttgtgttcatttcatttcaggggcttggctgcctgtggcgttcccaggtggcct

SEQ ID NO: 2829 - DNA, 235 bp, Homo sapiens
ctgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaaattgatttagcattcatattttccatcttattcccaattaaaagtatgcagattatttgcccaaatcttcttcagattcagcatttgtt

SEQ ID NO: 2830 - DNA, 190 bp, Homo sapiens
cgccattgctaaaacgaagctagggcctttcttaggatggaggacatgaaagaaaatgccacttccaaagctcaacactccatcagattgacaagttagctgggatcagataataatagccatttcatgtcttgattaagaacctcacacagactccacagaactgttgataaactagagcaaagggaat

SEQ ID NO: 2831 - DNA, 590 bp, Homo sapiens
cgccattgctaaaacgaagctagggcctttcttaggatggaggacatgaaagaaaatgccacttccaaagctcaacactccatcagattgacaagttagctgggatcagataataatagccatttcatgtcttgattaaaaacctcacacagactccacagaactgttgataaactagagcaaaaggaattcacagttccattcttcttataaaccaaactaaaatgctgactttcgaaatccttttttccgacctcctgatggaaagttttgacaagtgtagcactgaagcatttccccctctctgctagaggagaaatggcaatcttcaaagaccattgttttgttttattcgcttccaattcattcttagtaaacaattgcaggatttctaaaaagaccagaccatagtagttaccagacatgagatgctttctaaaagctactttgaatagaaatgttttctctgaatctgtcctccctcatgcagcaggaagaatgtctaaagctatgctacctcatatagaaacagcgtccacagtcagtcctcccagttgggtttatctgagcggtcctttagaggtggccgc

SEQ ID NO: 2832 - DNA, 207 bp, Homo sapiens
ccactccctgtgcctccagcgagtaccctgtgcggcggcgcaatgtgaagaagtggcccgggcgctgggcaaggaaagcctccgggaggtacaactggaagagctagaggctgccagggacctggtgagcaaagagggcttccggcgggccggcacgtggtgggggagattcggcgcacggcccagccagcggccccctgagacgtg

SEQ ID NO: 2833 - DNA, 275 bp, Homo sapiens
cgtcacagggatacccacccaccatcccagggtctacaacatccacagccggaccgtcacccgctatcctgccaactctatcgtggtcgtaggaggctgtcctgtcttcagggttggggtgctggaggacttcttcaccttcctgggcatcttcctggccatcatcctcttcccctttggttcatttgctgttttgccttaggaggcacggtgcccaactgtggggcaccttcggttaaagggacacaggccggctttctacaccaggtcttttt

SEQ ID NO: 2834 - DNA, 300 bp, Homo sapiens
atagagaccctggcccccggagaggtctgctgatttcgcagcagccttcgaagccgtggctgcctttcatctgctgcgttttattactattatcgccgttccggaaaagtcatggaagacagcccgctgccagacctcagagacatcgagctgaagctggggcgcaaagtaccccagagtctagtgcgctctctccgtggggaggagccggttcccagggaaagggacagggacccttgcggggaagcggtggttgttgcgccgccgcgccgcgccgcttcagtagcagcagcagctact

SEQ ID NO: 2835 - DNA, 185 bp, Homo sapiens
ccagctttgcaccagcgtggcggtgtttactggcgccttgatctatgccattcacgccgaggagatcctggagaagcacccgcgagggccaagcttcggatactgcttcgccctggcctgggtggcctgacccctcgccctggtcagcggcatcatctacatccacctacggaggcgggagtgag

SEQ ID NO: 2836 - DNA, 235 bp, Homo sapiens
acagtcctataacaaaaacactaatgacatttgtttttaacatttcctttagaatataatcatgggaattgaagagtgagttaaggtttagacctatgtctcttttcttccacttttatgactctgagatttaaaaaaaaaaccaaaacaaaactgtccctgataaagacctgaaaaaggtgcttttctctgactgcagttttctaaaaggggaggttaatgtcctaaaatgtat

SEQ ID NO: 2837 - DNA, 540 bp, Homo sapiens
acagtcctataacaaaaacactaatgacatttgtttttaacatttcctttagaatataatcatgggaattgaagagtgagttaaggtttagacctatgtctcttttcttccacttttatgactctgagatttaaaaaaaaaaacaaaacaaaactgtcctgataaagaactgaaaaagttgcttttctctgactgcagttttctaaaagtggaagttaatgttctaaaatgtatgtacacattgcaattgtgtgtagagctcaaaagcgtaaaaagcaaaatatattgaatttcaacatacttgttatcctgcattccagttgactgtagagaatctctagtcatgtctatctgtttttgatgcctctacagaataactgcccagcatcctctgcccaaccaatcagaatgtaggaaaatctacagatatgacggaatctactgtgaatctacctaccagaagtatgttgaaatccttgtgagtcttccctctggctcgtacatcagtgcttgtggttgccagctattcaaaaatatcct

SEQ ID NO: 2838 - DNA, 270 bp, Homo sapiens
tttgggtgaccctggactcgccactggtacccgcccttccgagcggcgcctaagcctttgccgtagcatgcacactgagaatgctaatggttgggttgattgtatgttgaggatctattactgaccgtatgatgaggccaactttttttccttgtggttagcaagactgcaagagatggaaaaaaggtagtttgaatgttttgtgtgtaaggagtataccatgagatggatgccccccaatcatttccttgggggaagggggtgtctcca

SEQ ID NO: 2839 - DNA, 290 bp, Homo sapiens
gggagaggaagctagaagggttatggttggagttctgtacagtgttgagtttccgacaggaaagaggattcctccaatgcgcctagagagaaagccttagcaggagatgatgcagcagaggggaagggccctttggtgccgccgcccttcctttagcctccgaaggtgatggaaatggagagtggggacccagcctccagctttttggcctcgcccttaaggcttaacaataagcccacctccctctctccttccagcattagcccttggttcctggcccagctgggggt

SEQ ID NO: 2840 - DNA, 194 bp, Homo sapiens
gggcgacgtgctcacccttttggagtcagagcgagaagcccggaggttgcgctgagcttggctgctcgctgggtcttggatgtcgggttcgaccacttggccgatgggaatggtctgtcacagtctgctccttttttttgtccgccacacgtaactgagatgctcctttaaataaagcgtttgtgtttcaagtt

SEQ ID NO: 2841 - DNA, 290 bp, Homo sapiens
ctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgagcccctcagcatactgggaatctcttcctgacaacgagtgtaaatttggtcaagtctactctccgctcattcaattatttgaggcatt

SEQ ID NO: 2842 - DNA, 193 bp, Homo sapiens
cgtccaatttcggcaggttggcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaattaaaagtgctgccgtaccc

SEQ ID NO: 2843 - DNA, 123 bp, Homo sapiens
gttcaatgctgatgaatttgaagacatggtggctgaaaagcggctcatcccagatggctgtggggtcaagtacatcccaatcgtggccctctggacaaggtggcgggccctgcactcatgagg

SEQ ID NO: 2844 - DNA, 133 bp, Homo sapiens
gggaaccccagcctgaatgtattggatgagaaggagccaggagggctacaccatctgtattagggaaaagcctttggggagaggggtgggttcctccctcctcccgaggggtaagccgccaggaggagagcca

SEQ ID NO: 2845 - DNA, 290 bp, Homo sapiens
tctgtatgagggaaaagccttgggggagaggggtgggttcctgcctcctgccgagggtaagccggcaggagagagccatcagagggacctccgctgcctgggagttgggttccctccaagggtccctctttcagtgtcctctctctcacctgggtctgccaccctaacaggtggcaactcggcagggctgctgggggcacttcctgcccagtggggggtgccgcccaaccttctcccctccccaaccccgcccccgggaccgtgcaggcaccagggttccgtgcacctat

SEQ ID NO: 2846 - DNA, 105 bp, Homo sapiens
tagaaggaggtaacttccaaggaaatggctacccaacttgcctttgatgcgcctgctggccaactatgcctcttagaacataacctaccactgcaagacagcatt

SEQ ID NO: 2847 - DNA, 141 bp, Homo sapiens
tgcttcctgactcgctctactccgtgcgacgcacgcttcacaaaggcacgtcgggccgtcgccccgcttgggtcggcttgaaggaacttccggatcggaagcctccgaagaggcccttattgggcccaccatcccggaccc

SEQ ID NO: 2848 - DNA, 300 bp, Homo sapiens
ttccagagcaaaaactggcactcatagcaagccagaacccccatccccatcctcatgggtctgtggctgggtgcaggccatcaaaatggacaccacgagacagaagtggggactgcctggccacctagcgccttccactccttaagcaagcacacagaagatgaggcagagaattgtcagagctgaaagttcctttggttgctcacaactcaggtatgcaccatgtggcagccaggcagcggagcctactagactgccagtctcatgcacccagacctgtggccagattgtggcctctgg

SEQ ID NO: 2849 - DNA, 176 bp, Homo sapiens
ggacaccggggatctgcgacacctcagcctgccaaggagccgtgttaggaggggtcggggagaaatcaggctctcgaagctcataaaattcaacgtgaggaagcaagtcacaaggacgcccgaagcacagtggacggtcatgaaggagcgggggttttgcaggcgggtcacgtcca

SEQ ID NO: 2850 - DNA, 145 bp, Homo sapiens
ctcgtccaatttcggcagggggttacactggggcttcccgttacaagatgagggtctgtgtatgctcacttccccatcaacgttgttatccaggagaatgggtctcttgttgaaatccgaaatttcttgggtgaaaaatatatcc

SEQ ID NO: 2851 - DNA, 138 bp, Homo sapiens
tgaatgtagattgaagctaaacttgttaaggcttttgaaattcagggtttatatactactttgttctccagtatatttctaaatttcataaataacttgagaggcctactaacatcactttcttaacaaaagcagaga

SEQ ID NO: 2852 - DNA, 195 bp, Homo sapiens
ctctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcagggaatactgcctcg

SEQ ID NO: 2853 - DNA, 261 bp, Homo sapiens
ggcatgaaaaggcacttgctgctggaggagtagggtccattgttcgtgtcttgactgcaagaaaaactgtgtagtctggcaggaagtggattatcttcctcgggagtgggaattgctggtacaaagaccaaaacaaccaaatgccaccgctgccctgtgggtagcatctgtttctctcagctttgccttcttgctttttcatatctgtcagaaaaaaatacatatcagatgtcctttaatgaaaattgggatatatagaga

SEQ ID NO: 2854 - DNA, 213 bp, Homo sapiens
ttaggacgtatccgcctccatcctccccggccgggcttgcccgaggtttcgggattcctacttggggatggccgggcagaggcgaagggatcacggcctccgtggctcgtggttccaagaagcatcttaagcgggtggcagctccaaagcattggatgctggataaattgaccggtgtgtttgctcctcgtccatccaccggtccccacaagt

SEQ ID NO: 2855 - DNA, 166 bp, Homo sapiens
cgaggactccttccttttcaatattttgtaacagtttcagtaggattggtgtaagttcttctttgaatatctgacagaatttggctgtcaattctggcttttttggttgttgttgggagattttgttattactgattcaatctcggttaccattattggatctgtt

SEQ ID NO: 2856 - DNA, 205 bp, Homo sapiens
cagctgtggagttctacatgagcattttcccacttcctcctgatgctgcttttgtgtgttttgttcactgtaataattttttcaaagggaacttacataaatgtccagggcactatatttttctaatgttagtgtaaatacaccccaccagggtaaattaaaaggtgacattgcatttccttttataattaattggggttacaat

SEQ ID NO: 2857 - DNA, 505 bp, Homo sapiens
agctgtggagttctacatgagcattttcccacttcctcctgatgctgcttttgtgtgttttgttcactgtaataattttttcaaagggaacttacataaatgtccagggcactatatttttctaatgttagtgtaaatacaccccacaggataaattaaaaggtgacattgacatttcctttttataattaattggggttaacaatggcctaaagattagcacaccctcgtgccgaattcggcacgagtgacatttggggattatgggagctacaattcaagatgagatttgggtggggacacagccaaaccatatcattagaagaatgccacaaaagtgatgtcgtgcccttcttagtgtgtcctaacaagcggaacatgatggcgtgatttctactcacggtggtaacgtcgatcacccttttaaggtagggtctgttaggttttttgcgataatgttatgattttccctttgtaattaataagtacctgtcatttgttttta

SEQ ID NO: 2858 - DNA, 177 bp, Homo sapiens
acgtgctttcagaacccgttctgggggtgcggcgcacacctgggccccgtgcagggcttcagctcggcagcagctctgagggcagctcaatgaaaaagtgaatgcacacgcccttgttggcgtggcctggcatggctggtgctatcggcagccgctctccactccccgactgatact

SEQ ID NO: 2859 - DNA, 241 bp, Homo sapiens
actagtggatccaaagaattcggcacgagggctcttccatgtaacatagcagttatcgtgtaatttagtgccacttattgcaaagtgttaccaagggggaacatttcaaatgccttttgttttttctttggacatcaagataatttagtggacaacaaatattaaattttacattatgctttttaattgtggggaaatgcaaaacctcatgtcttaccacaactttccattggtattgcta

SEQ ID NO: 2860 - DNA, 218 bp, Homo sapiens
ctcgtgcgaattcggcagagaattttgttctttttcatgggtgaaaaatatttcattgtgtatatataccacattttctttatccattcatccattgatggacacttgggttgattccatatcttggctactgtgaatagtgctgcaataaacatgggaatacaaatatctctttgatatactgatttcctatcttttggacatatactcagcagtag

SEQ ID NO: 2861 - DNA, 222 bp, Homo sapiens
acttggtctggtctctctggtggctacaaccccagagttttaaggacttggaaaggaaagcacaatcagagaagaaaacagcccccgaaccagcaggagtggcctggcacatggaccggctgagcgatgtgcactccacccaagccaggctcccagggggcctgatttctctctcactgtctctttttttaaaatgggttgcacggctctgccccatggggg

SEQ ID NO: 2862 - DNA, 141 bp, Homo sapiens
cttttgcagatggaggatttcttgattaatgttgaaaaaaaacccttgattatactctgttggacaaaccgagtgcaatgaatgatgcttttctgaaaatgaaatataacaagtgggggaatgtggttatggccggaaagg

SEQ ID NO: 2863 - DNA, 192 bp, Homo sapiens
taaaatctcaccaaggcaaaaagaggaaaaacgctcagaacagaaccttgaaagtgccaaagttaagaggagaaagcagaaaaggagattgagaaggaagaattttagagctaggagaaattaggggagaatttaatttcatggaagctaaagggcaagataattgagttggtagttttcccaaatacttta

SEQ ID NO: 2864 - DNA, 209 bp, Homo sapiens
taaaatctcaccaaggcaaaaagaagaaaaaacgctcagaacagaaccttgaaagtgccaaagttaagaggagaaagcagaaaaggagattgagaaggaagaattttagagctaggagaaaataggggagaatttaatgtcatggaagctaaagggcaagataattgagtgggtagttgtcccaaatactttaaaaaaaaaaaaaaaaa

SEQ ID NO: 2865 - DNA, 307 bp, Homo sapiens
ccagccaattttttttgtatttttagtagagacagggtttcaccatgttggccaggatggtctcgatctcctgacctcgtgatctgcccgcctcagcctcccaaagtgctgggattacaggcttgagcacttcgcccggccggtcattcattcttgcaacaagcatttattgagcacctactgtgtgctcacagtaaagaaacgtgatcttatcccaatagaggtagatattcttaaaaaagaataattcttaaactccttaaacaaggggtcccacccccaggccacaaacagtaccagtccgtgg

SEQ ID NO: 2866 - DNA, 100 bp, Homo sapiens
ctcgtcccttcgtgccgaatcggccattccaaggatcccgtggtgagatcttcttcttccaaggaccgggttcatttggcggcctgtgcacgccaggtgc

SEQ ID NO: 2867 - DNA, 199 bp, Homo sapiens
atgatggccaaaaagcacctggagatcaaccctgaccaccccattgtggagacggtgcggcagaaggctgaggccgacaagaatgataaggcagttaaggacctggtggtgctgctgtttgaaaccgccctgctatcttctggcttttccttaaggatcccagaccactccaaccgcatctatgcatgatcaagctagg

SEQ ID NO: 2868 - DNA, 194 bp, Homo sapiens
ggcaaatcaagcacatgattaagtaccggtacatcccgttcacacatgggaagagaaggtacagaggcaaggaggatgccggcaaggctttcgccagctagaagcgggactgaggctgcctcacgtgttgcaagaacagttttgagccattgttaacaatgccttttttcttcacataaagtagttgattacga

SEQ ID NO: 2869 - DNA, 228 bp, Homo sapiens
aattaatgtgcgtattgagcacattaagcactctaagagccgagatagcttcctgaaacgtgtgaaggaaaatgatcagaaaaagaaagaagccaaagagaaaggtacctcggttcaactaaagcgccacctgctccacccagagaagcacactttgtgagaaccaatgggaaggagcctgagctgctggaacctattccctatgaattcatggcataataggtgtta

SEQ ID NO: 2870 - DNA, 134 bp, Homo sapiens
gccgaggttcttctcattcggcatcaacagcattttatatcagcgtggcatatatccatctgacacctttactcgagtgcagacatacggactcaccttgcttgtcctactgatcttgaggtcataaaatacct

SEQ ID NO: 2871 - DNA, 236 bp, Homo sapiens
aagaccccatcatcgggttccaccagatgttcctattaaagaatatcagtgaagcttgggtttgcaccaatgacatgttcaggcttgccctgctcacttcggctgacctcctctcagccaggcactcacactgtttcctcctcacacctcttcccaatactattcgtactcctccagatgctccaaatatcatacacaaatgagcagggccacgatgggagtttgcacagtgtctt

SEQ ID NO: 2872 - DNA, 220 bp, Homo sapiens
cgccatctcaggtctcttggctttgcagggcccaccggagaaaactgacgacccgtttctgtaatccttatgggagaccaaccttgtgcctccgggagatccactctcccacctggaaacgcacgggaagccaagcctccaaaaaagcgctgcctcctcgctccggtttgggattattccggaagaacttccaacggaggtagtaccactctaccctccg

SEQ ID NO: 2873 - DNA, 245 bp, Homo sapiens
ggaaagaaaagcaaacatgcattcaaggtaaaataaaataaaataaaataaagatgatggcaattagaaacagagaagtcaaaagaaagaaagaaaagaaggaagaagaaagagaaaaataagcaacatgcattcaggtaaataaataaataagatgatggcattaggacagagaagtcaaagatggctttgacactaattttacaaatcaaaaccctaaagtgacccgtgtgtttgtgcccttt

SEQ ID NO: 2874 - DNA, 240 bp, Homo sapiens
gtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatttttgccatgaattttgagaaga

SEQ ID NO: 2875 - DNA, 124 bp, Homo sapiens
gcttaacgtgcagaacaagaacagcagctactttgtggaatggatccccaacaatgttaagacagccgtctgtgacattccacctcgtggccttcaggatggcagtcaccttcattggcaattg

SEQ ID NO: 2876 - DNA, 120 bp, Homo sapiens
gttggaggagcgagcagccatggatgccgtttgtgccaaagtggacggtgccaacaggctttggagaccctcttgaggctttcccagtgttcaagaaatatgatagaaacgggttgaatg

SEQ ID NO: 2877 - DNA, 125 bp, Homo sapiens
gaaaataatgggggtatttttctgccttgttttactccattgtcttagtacatggctatggtggagagaataatggcccaccccaaacatgtccacattcggattccccagaacctgtgaatatt

SEQ ID NO: 2878 - DNA, 330 bp, Homo sapiens
gaaaataatggggtatttttctgccttgtttttactccattgtcttagtacatggctatggtggagagaataatggcccaccccaaacatgtccacattcgaatccccagaacctgtgaatatggcaaaagggattttaaatttcaaaagactttgaagatatgattaagttaactatcttgagatgggggatggattttcatggattatgtggggggcccagtgtagtcacaggggtctttactggagggaggagggtcagaatcagagaagtaaatgtgatgagggagggagagagttgacagccacgagccaatgaatgcaggcagc

SEQ ID NO: 2879 - DNA, 115 bp, Homo sapiens
tctggctcactgcaagctcacctccaggtcaagcattctgctcagctttctgagtagctgggactacaggtgcccaccaccacacccggctaatttttttatatttttagtagag

SEQ ID NO: 2880 - DNA, 125 bp, Homo sapiens
gcccacttccacagcctacagcaccgagggcggcctcttacatgatgtgtcggcagctttcttgccttctgtgaagggacagcgctgttcagatttgatatttcaacttacaacttgtttttaaa

SEQ ID NO: 2881 - DNA, 206 bp, Homo sapiens
caggaagctgaagtctcagctgcccaagggaccacaggaacagctccaggagccaggggcccggaaacaggtcaagacagttaggtttccagacccctggacgcttttcgttggttttgcaagcgccggagagccttttggcacaattccccggttgccaaccctgccccaagagagttccccagggcaggagaggccaaggacct

SEQ ID NO: 2882 - DNA, 250 bp, Homo sapiens
caggaagctgaagtctcagctgcccaagggaccacaggaacagctccaggagccagggcccggaaacaggtcaagacagtgaggttccagacccctggacgcttttcgtggttttgcaagcgccggagagccttctggcacactccccggttgccaaccctgcccaagagagtccccaaggcaggagaggccaggaacctcagggtgctgagggccgaggccagagcagaagctgagcatggagagcacg

SEQ ID NO: 2883 - DNA, 159 bp, Homo sapiens
ctcgtccaattcggcagtcttgtaaagacagaactacaaaaactcaagaataagctgattagccttttatttacaaatgtgaaccttatagttgaaaaccttcccacagagaaactcccaggcccagatgaccttagtggtgaattctaccaaacatta

SEQ ID NO: 2884 - DNA, 119 bp, Homo sapiens
tgctcatgatggctggtatcgatgactgctacacctcagcccggggctgcactgccaccctgggcaacttctggcaaggccacctttgatgccatttctaagccctacagctaccttca

SEQ ID NO: 2885 - DNA, 257 bp, Homo sapiens
gagatttccagcaagagccccgtgcggtgcagagccaaaggtcaacctgctgtattcccgcgaccattcggtggccgagagcctcaactacgtggcgtcctcgaacatgagcatgctgcagacccaagacctcgtgaagtcggtccaggccacgactgagaacaaggaactgaaaaccgtcaccttctccaagctctgagagccctcgcgttccaggccccagccaaggggccgggccttgttccggctcatccaca

SEQ ID NO: 2886 - DNA, 128 bp, Homo sapiens
  misc_feature 36: n = A,T,C or G
cgacgttccgttcccccctgcccgccttcttccgcnaacgccgccgcggctttccgcaggccggtttccaccgaggaaaaggaatcggtatcggtatgtccgctatccagaacctccactctttcgac

SEQ ID NO: 2887 - DNA, 202 bp, Homo sapiens
ggcaacctgaaaaaggctgtcattctacagggctctaatgatgttgaacttgttgctgagggcaacagcaggttcacttacactgttcttgtagatggctgctcctaaaagacaaatgaatggggaaagacaatcattgaaatacaaaacaaataagccatcacgcctgcccttccttgatattgcacctttggacatcggt

SEQ ID NO: 2888 - DNA, 127 bp, Homo sapiens
gaagagtggaaactttggtggtagcaggaacatggggggaccatatggtggaggaaactatggtccaggaggcagtggaggaagtaggggttatggtggaaggagccgatactgagcttctttccta

SEQ ID NO: 2889 - DNA, 144 bp, Homo sapiens
cagaatggtccagcgtttgacataccgacgtaggctttcctacaatacagcctctaacaaaactaggctgtcccgaacccctgggtaatagaattggtttacctttataaccaagaaggttgggaaaagcaccaaaattttgca

SEQ ID NO: 2890 - DNA, 181 bp, Homo sapiens
atcctgtggagcatccttttggaggtggcaaccaccagcacatcggcaagcccttcaccatccgcagagatgcccctgctggccgcaaagtgggtctcattgctgcccgccggacttgacgtcttccgggaaccaagacttttcaggagaaagagaactagttctgagggccttaataaag

SEQ ID NO: 2891 - DNA, 201 bp, Homo sapiens
cagtggatcactgtttcactttggaaaagctgctctctgtcagggttgtgaaccgctttattgtttagttcatataaaggtcagtagctctaaaaatacacactttaatgggtgatgtaatagacattttatatgtgttgcaggtactttccctcagtgggtgaaatgaatacccttttgtgccttctggagaaggtgtct

SEQ ID NO: 2892 - DNA, 397 bp, Homo sapiens
cagtggatcactgtttcactttggaaaagctgctctctgtcaggtttgtgaaccgctttattgtttagttcatataaaggtcagtagctctaaaaatacacactttaatgggtgatgtaatagacattttatatgtgttgcaggtactttccctcagtggttgaaatgaataccttttgtgccttctggagaaggtgtctgtatgtatggtgtgggaatatgtgtgtgtctgtgtatgtgcacatcttgtttgaaagccccagtcttacaaacttacaaactggattcttcaatctctttcttatgaaatatcaacatctactgtgaatctatcatatatcattggagttgacagacattttgactgtttaacttgcaaatacaggctttgggtcag

SEQ ID NO: 2893 - DNA, 285 bp, Homo sapiens
cagccttgaagatgcaaaaaaagagggaccatatgatgtggtggttctaccaggaggtaatctgggcgcacagaatttatcttagtcttctgctgttaaggagatacttaaggagcaggaaaaccggaagggccttatagccgccatcttttcaggtcctactgctcttttggctcatgaaatagggtttggaagtaaagttacaacacaccctctttgctaaagacaaaatgatgaatggaggtcattacacctcctctgagaatcgtgtggggaaagacggcc

SEQ ID NO: 2894 - DNA, 327 bp, Homo sapiens
ctggcctcccgaattcccgtgcagggcctgctccaccctgcgccacccagaggctgaggacccctcagcggaacaaccctggtgtgcctcggacatcttttaagccttggcagagaaacgtggttacaagacaaccaaggcggctcggaatgatgtgtacagagcagccaacagtctctttcggcttgcagttgacggccgcctcagcctgtgttttcatccccccaggctacagtgaacagaaaggcacctcgggagtcccatccagagaccacgggagcttgtggtttttcagggcaagggtggggcccaccaggtgtacgagga

SEQ ID NO: 2895 - DNA, 255 bp, Homo sapiens
gctggccgaagagcagaagcgtcgggagagggagcagcacatcgcagagtgcatggccaagatgccacaaatgattgtgaacttgcagcagcagcagcgggagaacttggagaaggcccaggctgacaaggagaggagggccccacttcaggcttaggcccaggagctccttggctaccaagtggacccaaggagttccccttccaggagcttctccaggacctagagaagaaggagcgcaaaccctcaaggagg

SEQ ID NO: 2896 - DNA, 170 bp, Homo sapiens
atcccatggttgttgttagggatagtactaagcatttcagttccaggagaataaaagaaattcctatttgaaatgaatttctcatttggaggaaaaaaagcatgcatttttaggcacaacaagatgaaattattggaatacaaaagtgggctccttccccatgtgcaagt

SEQ ID NO: 2897 - DNA, 126 bp, Homo sapiens
gtacaataccacttccgctgtcacggtaaagtccgccatcagaagacttaaggagtttaaagaccagtagacggttctctactctttgagacaatacttgcctattataaattggttaatttatgt

SEQ ID NO: 2898 - DNA, 165 bp, Homo sapiens
gtcaaggccgcctggggtaaggtcggcgcgcacgttggcgagtatggtgcggaggcccttggagaggatgttcctgtcctttcccaccaccaagatctactttcccgcaattcgaccttgagccaaaggctctttcccaagttaaagggccacaggcaagagggt

SEQ ID NO: 2899 - DNA, 232 bp, Homo sapiens
gttcgatgaagtagaaactaaggagagtcgtgaagcagtttagaaagaatttgagcctctgctgaattggatgaaagataaagcccttaaggacaagatttaaaaggctgtggtgtctcagcgccttacaaaatttccgtgtgctttggtggccaaccagtacggatggttttgcaacatggagagaatcatgaaagcacaagcgtaccaaacggggaaggacatatttaca

SEQ ID NO: 2900 - DNA, 131 bp, Homo sapiens
gagcagcagatagatctgctggcgagctcgagcagctcaagggccaagcaagtcgcgctgggactctacgagaggagatgcggactgcgccgcagtgacagctaccacgacaaagccgcgtcgaggtgagc

SEQ ID NO: 2901 - DNA, 174 bp, Homo sapiens
ggctcacacacctgtagcacttactggtaggaccaagcatcttgggggggtgccgctgagttgcagggacagagtcactttgtttcgtggggaggtctaatctagatatcgacttgttttgcacatgtttcccttagttctttgttcataggccagtagaccttgttacttcta

SEQ ID NO: 2902 - DNA, 124 bp, Homo sapiens
cctctactggaggggtgaagaacctcatcgttacaggcctggtactgtcgcgctccgtgaaattagacgttatcagagtccactgaacttctgattcggaaacttccttccagcgtctggtgcg

SEQ ID NO: 2903 - DNA, 150 bp, Homo sapiens
cagtaactctttacattcaagaaataaagaacatcaatcaaagcacaggagatatgacagtacagcaacgtctgctagcacaagattcgagagggaaacagggagagaaggagccaaggcagtacaaacgagggaattggaagtttaaat

SEQ ID NO: 2904 - DNA, 515 bp, Homo sapiens
tgtcagaacaagttcaccagccgttgcttgaagaacagtgtagcattgacgagcctttatttgaagatcagtgtagctttgaccagcctcagccagaagaacaatgtattaaaacagtaaactcctttacaattccaaagaaaaataaaaagaaaacatcaaatcaaaaagcacaagaagaatatgaacagatacaagccaaacgtgctgctaagaaacaagaattcgagaggagaaaacaggagagagaagaagcccaaaggcagtacaaaaagaagaaaatggaagtgtttaaaatactgaacaaaaagactaaaaagggcaaccaaacttgaatgtacaaatggagtaccttcttcaaaaaatacaagaaaaatgttaaacattttgttcctacaggttaaaatatctgctgcctattaggttcttctgtgacatgtgcctcccagcagtgaactaaatttgtcgacataaactggattgctaaactatgctaaatataagatgttcacata

SEQ ID NO: 2905 - DNA, 175 bp, Homo sapiens
tgcgtgccttatgctgttatagaaggagctgtgcggtctgttaaagaaacgcttaacagccagtttgtggaaaactgcaagggggtaattcagcggctgacacttcaggagcacaagatggtgtggatcgaaccacccacctttggaatgattgctcaaagatcattcatcaaag

SEQ ID NO: 2906 - DNA, 155 bp, Homo sapiens
aggcactagtggttcttaaaagtaggaagtaagccctggtgtgatggctcatgcctgtattcccagcactttgggaggccagggttggaggatcacttgagtctatagagttcgagaccagcctgggcaacatagttagacccatctctactacc

SEQ ID NO: 2907 - DNA, 137 bp, Homo sapiens
agagtggtgaacagccctacaagatggctggtcgatgccatgcttttgaaaaagaatggatagaatgtgcacatggattcggttatactcgggcagagaaagagtgcaagtagatattgatgatttccgtagagtgt

SEQ ID NO: 2908 - DNA, 270 bp, Homo sapiens
cagagaatgtgtctatatcctccttctaacagcaccttccccctgcagctactcttcagatctggctctctgtaccctaaaacctagtatctttttctcttctatggaaaattcgaaggtctaaacttgacttttttgaggtcttctcaacttgactacaggtgtgctcataattgtgcttgccttttccagctttaattattttaagggacacatgtgaactctcgggcttgggagagtggctcatatctcgtgattcccagcactctt

SEQ ID NO: 2909 - DNA, 255 bp, Homo sapiens
cagaagcgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataacttgaggtccaaggctaaaagcggaataccaccggacttgtcgattaggcaccttaaattgtatatcccgagagtcacagatagggttccgtgaagggccac

SEQ ID NO: 2910 - DNA, 210 bp, Homo sapiens
tgcaatttatactgtatggcttctttttcatgtttcatctaggtttttagaagtgaagtatagtaaatttgggttcgttaaattgtgaaggcgctgggaattacatgaacataccaccctagtaaaggcaagttctgtaagcttacattgctatttggtaaagcgttgccttcacagcatttcagaatgctgtttggcttcatgtcccca

SEQ ID NO: 2911 - DNA, 240 bp, Homo sapiens
ctcggcctggctgcacaagctctaccaggagaaggatgcctttcaggaggagtactacaggacgggcaccttcccagagacgccatggtgcccccccggcggccctggaccctcgtgaactggcttttttgggcctcgttggtgctcttacccttttctccagttccttgtgaagcatgatcaagagcgggttttcctgtacgtctggcagattcatcctcgtgcttttttgtgctccgt

SEQ ID NO: 2912 - DNA, 125 bp, Homo sapiens
caagatgagattggcatggctttatttgttttttttgttttgttttggttttcttttttttttgggcttaactaaggattaaaacctggaacggtaaaggtaacagcaatcggttggaggcaagc

SEQ ID NO: 2913 - DNA, 155 bp, Homo sapiens
ggacacaccacggaaagagaaggcttcacgggaagagaagcagaagccccaggctgagcggaaggaggagaaaaaggcggcttgcccctactccttgaggaggagattggatgaattttaagcaggccttggctgctgagcccaaggccaaggac

SEQ ID NO: 2914 - DNA, 130 bp, Homo sapiens
cacaggtccatataagcatttgcggtctggacgtttcaaaggtattggccataattataataattatagtttggtcagaatgttcagtttgaagatcacccacattccctagactgctttattaacccag

SEQ ID NO: 2915 - DNA, 386 bp, Homo sapiens
cgaggcgccccaccctcgggctcctgaatatcagtcactgttcgtcactcaaatgaatttgctaaatacaacactgatactagattccacaggggaaatgggcagactgaaccagtccaggtggtgaattttccaaggaacatagtttaagttgattaaaaatgctttagaatgcaggagcctacttctagctgtatttgttgtatgcttaaataaaagtaaaggttcataaccaaagagaatccacattagcttgttagtaatgctctgaccaagcgagatgccattctcttagtgatggcggcttagggttttagagaaggaatttgctcacttcagttgagagggtgcagtcagacagctttacttcttttaattaccacggt

SEQ ID NO: 2916 - DNA, 320 bp, Homo sapiens
gagaacatgcctctcgcaaaggatctccttcatccctctccagaagaggagaagaggaaacacaagaagaaacgccttggtgcagagccccaatttcctacttcatggatgtgaaatgcccaggatgctataaaatcaccacggtctttagccatgcacaaacggtagttttgtgtgttggctgctcactgtcctctgcagctacaggaggaaagcaaggcttacagaaggatgttccttcaggaggaagcagcactaaaagcactctgagtcaagatgagtgggaaccatctcaataaacacattttggataaaaaaaa

SEQ ID NO: 2917 - DNA, 250 bp, Homo sapiens
ctttaaccctagaaggtgggacctagggggagggacagggcaggcgggcccatgaagaaagcccctcgttgcccagcactgtctgcgtcgctcttctgtgcccagggtggctgccagcccactgctcctgcctgggtgggctggccctcctggctgttgcgacgcgggcttctgagcttgtcaccattggacagtctccctgatggaccctcagtcttctcatgaataaattccttcaacgccaaaaaaa

SEQ ID NO: 2918 - DNA, 220 bp, Homo sapiens
ctgtggcaaaaccaagatgaagagacgagctgttgggatctgcactgtggttcttgcatgaagacagtggcttggcgggtgcctggacggtacaataccacttcgctgtcacggtaaagtccgccatcagaagactgtaaggagttgaaagaccagtagacgctcctctactctttgagacatcactggcctataataaacggggtaatttatgtaacaa

SEQ ID NO: 2919 - DNA, 255 bp, Homo sapiens
gaaaggtggagtctgggtctggcactagagaatcagtcctgtgtgggggtgtataaaagggaggctcatagtgggactaggagtccagacatttgcataagactcagatataaagcaggtctgtcaatatctcaggtaatgttataatgtaactcagacactgtgcagactgtattggacacccagacagtcaaaccacttctcagtactaattcatgtcttgccggcatcctctctccgccccttgacagcatt

SEQ ID NO: 2920 - DNA, 359 bp, Homo sapiens
  misc_feature 176: n = A,T,C or G
gaaaggtggagtctgggtctggcactagagaatcagtcctgtgtgggggtgtataaaagggaggctcatagtggaataggagtccagacatttgcataagactcagatataaagcaggtttgtaatattcaggtaatgttataatgtaactaagacactgtgcagaatgtattggnaacccagaaagtcaaaacaattcttagtactaattccatgttttgttgttatcctctctccgccccttgaaagcattttattatgaagttatcagtccactgtaggacactgtgtctgaaatattatctgtatataataatttttatataaatgaatacattgaaataatgagaacatgttca

SEQ ID NO: 2921 - DNA, 250 bp, Homo sapiens
atttcatggagcttttgaagtttgtgttataataattatataacttagtaatgatgtaaaaaaagtatttgatattaaaagtttaatattgataatgttgctgattgtaccatttccttagcttcagctgagtcataggccagacctgttgaaatgctgaaatgaagaaggctgttgcagcctcaaagtcagaggactcgtgcttcggacttcttatgcctctagtctctgtctttccagttcacagatg

SEQ ID NO: 2922 - DNA, 280 bp, Homo sapiens
gtgacttcacacgccataatggcactggtggcaagtccatctatggggagaaatttgaagatgagaacttcatctaaagcatacgggtcctggcatcttgtccatggcaaatgctggacccaacacaaatggttcccagtttttcattctgcactgccaagactgtagtggttggatggcaagcatgtgtgtttggcaaagtgaaagaaggcatgaatattgtggaggcatggagcctttgggttccaggaattgcaagacagcaaggagatcaccattt

SEQ ID NO: 2923 - DNA, 215 bp, Homo sapiens
gtctaaggccaaggtacaaggcttactggaccgctgccagaaggtgacagtggtcttcagggcatctggtctcaggtcacctgtgaagtcattcagcctttaccaatcttgtctgcaaaaaaacgagaagacatactgaaggcatgcaagcagatgcaggtgataatattctcgattactcggatggattggagaaatattttgttcctccattg

SEQ ID NO: 2924 - DNA, 225 bp, Homo sapiens
ggtcatacggcggttgtttgaattccgtcggaacttaagggaaactttcacaaatgtcggagccccttaatgtcctcaaaataaggaggaggaatgtcctaaggttccttcagcagatacccatctagggtggcaccattttgaacttccgatatgtaacacgtcacatcatataaaggaattgtaatggacatctatatcataatctacaagaggaccctgack

SEQ ID NO: 2925 - DNA, 143 bp, Homo sapiens
cggcagagggaaggtgctggaacgtactggaaagtgacgcgcatgacggggcccagctaggcgacaggacttgactacatacagaggacgagggacaaaatgatattgacacagggacattacatacataaaccaaaaacaaa

SEQ ID NO: 2926 - DNA, 273 bp, Homo sapiens
gcggaacgaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagttctttgttgactactgcaacaggcttttaaaggagcagttttttcacc

SEQ ID NO: 2927 - DNA, 141 bp, Homo sapiens
tgctttaaatttctccagtgtggcatgtagaaagattagcccttatacataaaggacagatgtttccagttcaaggctgattctcaagtgaaaattgaggaaatttcttctacctgagtggatttggcagtatttcttact

SEQ ID NO: 2928 - DNA, 230 bp, Homo sapiens
  misc_feature 143: n = A,T,C or G
gttgcacagatgctttaaaatttctccagtgtggcatgtagaaagattagcccttatacataaaagacagatgtttccagttcaagctgattctcaagtgaaaattgaagaaatttcttctacctgagtagatttagcagtanttcttactgtttctactcctgaggaatcttgctttctttccagagtgttgttcttactcattaatcagatttttgataaggatggta

SEQ ID NO: 2929 - DNA, 151 bp, Homo sapiens
cgtgcgaaattcggcagaggtctacccaactcaacgtcaagcgggccatcactattgctggcattccacaatccatcattgagtgtcatcaaacagatctgcgtggtcaaattggagaactctctcccagtcccccccgaaggcggtgacc

SEQ ID NO: 2930 - DNA, 128 bp, Homo sapiens
ctcgtgccgaaattcggcacgagccgctgcctgccacaatgtgtgcgcatgaatgtcctggcagaatgctctcaagaagtatcaacaatgctgaaaggggaggcaaacgccagtcgcttattaggccg

SEQ ID NO: 2931 - DNA, 106 bp, Homo sapiens
gctgaactcatgaagaccgattcactttcttggatctaaagagatgagcataggccttcatggatcgagaaaaaggattaaagacgctttgtggaaagcagaaaac

SEQ ID NO: 2932 - DNA, 723 bp, Homo sapiens
  misc_feature 43, 67, 86, 112, 126, 133, 136, 166, 182, 191, 315, 351,370, 381, 385, 388, 393, 429, 445, 464, 465, 475, 485, 499,501, 504, 511, 519, 520, 532, 554, 557, 558, 560, 564, 588,589, 590, 602, 605, 606, 607, 608, 614, 615, 616, 617: n = A,T,C or G
  misc_feature 618, 619, 623, 624, 625, 626, 627, 628, 629, 630, 631, 632,633, 634, 635, 636, 637, 638, 639, 640, 641, 642, 643, 644,645, 646, 647, 648, 650, 651, 652, 653, 654, 655, 656, 657,658, 659, 660, 661, 662, 663, 664, 665, 666, 667, 668: n = A,T,C or G
  misc_feature 669, 670, 671, 672, 673, 674, 675, 676, 677, 678, 679, 680,681, 682, 683, 684, 685, 686, 687, 688, 689, 690, 691, 692,693, 694, 695, 696, 697, 698, 699, 700, 701, 702, 703, 704,705, 706, 707, 708, 709, 710, 711, 712, 713, 714, 715: n = A,T,C or G
  misc_feature 716, 717, 718, 719, 720, 721: n = A,T,C or G
acaaaagctggagctcgcgcgcctgcaggtcgacactagtggntccaaagaattcggcacgaggctnaactcatgcagacgctccnatttcttggactctacacgagatgancatcaggattttanggatgancanaaacgactaaagaagcttcgtggaaagganaaaccaaagaaagganaagggaaangagcagcaaaaaggaaatagtgttggtccctcaagagggagactttcttcctcagtggcggacagaagaaagtgcatttattgtctttccacatattggaggaatgtcatcttcctaaatgaantttatttggaggaacacagtcatctccttggtgaantctaatccggttacattgnggctggtttcntgancanattcnaactgtgcaaaattatcttggccttggccgtgtaangtgaggtttacctggngtctccaaggacctaaatnnctaagttatnaaaagttatnaaaaaaaaccccgngngtnctccaanagcggccnngggcccaccggntttccacccggttggggcccanggnngntttnccaaattggcccaaaattgggccnnnttaaaattcccnttnnnngcgggnnnnnngggnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnntg

SEQ ID NO: 2933 - DNA, 184 bp, Homo sapiens
gttggtgtcttaatatatgtccaaaaagataaaagttgatgaatttgtgactcacaatctgtctttgatgaaatcaacaaagcctttgaactgatgcattctggaaagaggcatttcgaacctgttgtaaagatttaattcaaaagagaaaataatgtcccatcccctcgtgatgtataggggc

SEQ ID NO: 2934 - DNA, 144 bp, Homo sapiens
tggagaaactgaggcccaggccaaaaaatatctcactagagggctcaccgccatttcctggaaaaattggggacttggaactcaacggacgctcgtccagcagcagcgcggagctcccgaagtaaagggcgccccttgaccgag

SEQ ID NO: 2935 - DNA, 196 bp, Homo sapiens
ttgatttgtgtcaggcctctgctgtgtgctttacaaacattatctcagttaatccttgattacagtcctgagagttacttcttcttattgtccccagtttacagataagggaggcttagggamccagagaaattcaagtaacttgccccaggttcacacaagtggtaaggataagccagagttaatgtcatgaggt

SEQ ID NO: 2936 - DNA, 509 bp, Homo sapiens
ttgatttgtgtcaggcctctgctgtgtgctttacaaacattatctcagttaatcctgattacagtcctgagagttacttcttcttattgtccccagtttacagataaggaggctgaggaacagagaaattcaagtaacttgcccaagttcacacaagtagtaaagataaagccagagttaatgtcatgaagtacattgaacttaaccaagaacaaccccttcaatcttccaccacttagtcttctcatgccccacgtgcagtctctttaaattttaagatggaattagaacaggacatagtcttatttttgctaccccaagaacttgctagatgccagatgctccctcaagcaacagattaagaaaaagagaaaccagtaaagctcacacttgttaaatggcaattgggttagcacctcctaaaacagaatccacgagcttctatggataaagctacaaactcttacagcaaggttacttgaaacctgcatcagtagacgtcagtgctt

SEQ ID NO: 2937 - DNA, 315 bp, Homo sapiens
agcgagacttctcagaagccccctcattcacccagcccctggctgaaccacacctccacccctggctacagcacccagttgttctgcagtgtccgagcttcacccaagcccaagatcatctgtgatgaaaacaagatggagatccagggcaaccccaaataccgcgccctctctgagcaaggcgtgctgcaccctagagagtcccgaaacccagcccctttgattctcgggtctacaacctcaagggcataaatagtgctcgggggagggtactctggactctcccgtccgagggtaaaaactcaaacccgaaca

SEQ ID NO: 2938 - DNA, 270 bp, Homo sapiens
agctgctgaaacagctggacgacctgaaggtggagctgtcccagctgcgcgtcgccaaagtgacaggcggtccgacttccaagctctctaagatccgagtcgtccggaaatccattgcccgtgttctcacagttattaaccagactcagaaagaaaacctcaggagaattctacaagggcaagaagtacacagcccctggaactcgcggccttcaagaagacacggtgccatatcgccgccggctctaacacagcacgaggagaaccttt

SEQ ID NO: 2939 - DNA, 309 bp, Homo sapiens
aaaacttcctttctgagaagttagtgttaaggtcttggaatgtgaacacattgtttgtagtgctatccattcctctcctgagattttaacttactactggaaatccttaaccaattataatagcttttttccttattttcaaaatgatttcctttgctttgattagacactatgtgcttttttttttttaaccatagttcatcgaaatgcagctttttctgaaacttcaaagatagagatcccattttttaatgacctcgagtagcaaaatcatctttttcattctttaggggatagctctttccaaag

SEQ ID NO: 2940 - DNA, 325 bp, Homo sapiens
gaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtaatgctgggtctccacgtggtgtgtttcgtgggacaactgtggccttgggatggggcttactcctgtaacttcctcctcccaagggattttgggctttcttgaaaaaaagtccaagccctggataatgctttactttctgtgttgaagcactcttgggtgtttggtagtgactcatg

SEQ ID NO: 2941 - DNA, 210 bp, Homo sapiens
gctctgtcccctaggtatggaatcttgcggcatccacgagaacaccttcaactccatcatgaagtgtgacgtggacatccgcaaagacctgtacgccaacacggtgctgtcgggcggcaccaccatgttattccgggcattgccgacaagattgcagaaggagttcaccccccttgcgcccagaccattgaggtgcaagttcatcgcacc

SEQ ID NO: 2942 - DNA, 174 bp, Homo sapiens
  misc_feature 36: n = A,T,C or G
ctcgtccaattcggcaggggggtaaatcagtaagangtgttatttggaaccttgttttggacagtttaccagtaagccttttatcccaaagttgttgtaacctgctgtgatacgatgcttcaagagaaaatgcggttataaaaaatggttcagaattaaacttttaattcattc

SEQ ID NO: 2943 - DNA, 116 bp, Homo sapiens
gagttgctagatggataggtaggtgattggcagagttctggctggagccgcggcgccaatggtcccacaaggagaaggttaacttggattgattattgaggactattacatgtaga

SEQ ID NO: 2944 - DNA, 1034 bp, Homo sapiens
  misc_feature 36, 50, 54, 56, 58, 64, 67, 69, 71, 75, 78, 79, 87, 88, 102,103, 104, 106, 110, 112, 119, 121, 127, 133, 139, 144, 145,154, 155, 157, 158, 159, 165, 170, 173, 174, 175, 176, 179,187, 222, 225, 227, 229, 233, 241, 252, 255, 260: n = A,T,C or G
  misc_feature 262, 269, 279, 282, 285, 293, 301, 337, 339, 341, 344, 345,349, 351, 357, 369, 373, 382, 386, 399, 410, 411, 412, 425,444, 451, 452, 455, 461, 469, 480, 505, 507, 508, 510, 518,523, 531, 537, 546, 560, 564, 570, 589, 591, 593, 600: n = A,T,C or G
  misc_feature 611, 618, 625, 632, 640, 646, 652, 657, 673, 677, 686, 691,692, 695, 700, 708, 713, 714, 718, 737, 740, 741, 747, 748,749, 753, 763, 767, 773, 782, 783, 787, 790, 794, 806, 821,827, 835, 838, 842, 851, 852, 858, 866, 872, 879, 895: n = A,T,C or G
  misc_feature 911, 918, 919, 920, 923, 936, 948, 953, 955, 963, 974, 983,989, 993, 1000, 1004, 1012, 1014, 1020: n = A,T,C or G
tcgcgcgcctgcaggtcgacactagtggatccaaanaattcggcacgagnactncngnacaggnggnangnaggncanngccagganntgctccgctgaagnnncngagntncaatgtncnaaaggnagagtnacaacnggggnncaaacagcnngnnncttttngaagnacnnnncangttgcatnacataaacagtacaactggtacatcaattaaatanatngngnctcnaaccccgngggacaacggnganaaaancntcggacnctaaaaccanttntcnccgaattngtggatgnggcaatccggtcgaagtaatcccccggggtgaaccntngngannggcncncgttcncccctgaaaggnttcnggaagggantccnccttggaggtccntgggaaagggnnncccaagccttggnaatttggaaaccttatggnaaacccnntgngaaaanatgggganttttcccaaanccccttgggagggtggtccccaaantnncnaaaaaganacccnttttgggncccccnaaagggganttaaatttttaaangggntttacnggttgtaaattaaaaaggntntntttgccnatgcccccacntttaatnaaaacgnccaacantttcaccnggggtncctatnttttnccgttttttttttacnaaanttttttccnaaccnnagntcctncccaaagnggggnntttnccccaaaggggtatttccnaanntgcccnnnattngggccaaaangggnttttcnggggggccnnaaanggngggnaaaaccattttntgggccacccccccnaaagcnaaaccttntgngaanattctttannggggcnaaattccncccacnaaggggngggccccaaaattctnggggggttattttttnggggaannnccnccgggggaaaaanccaaaagggggnttttncncccaagtnttggcccaaanaattggggncccccngaantttttcngggnccccaaanangggggncaacccccccaatt

SEQ ID NO: 2945 - DNA, 262 bp, Homo sapiens
acctgtggtcacctggccctcctgtggtctgagtaccactcccctgccccaggagccactcccactccagctgcctgtttccagcaggttcccagtgtccccgacaagcccctgctggtgtctccatctcctgccaagcatcctccagtgcctcctcctgtgggcctggcctcagggctatggacagactcctgtcccatcccagagacccctcgtgatcgtgccctggcatgggcccgtgccgccctgggcggctgagaac

SEQ ID NO: 2946 - DNA, 170 bp, Homo sapiens
gatgctttggcaagatggcggggagcggcgtccccaaagctacttctaccgccagcaccttcgtgaagcccattttcagtcgggacatgaacgaggccaagcggagggtgtcgcgagctctaccgcgcctggtatcgggggtgccgaacactgtccaccaattccagctg

SEQ ID NO: 2947 - DNA, 130 bp, Homo sapiens
gcagaatacacatttttttcgtcagcacatgaaacattttctaggaaaaataaaggcaaacatacaatgtcaaagggaaagaaaagtaatgagaagtactgccaacccacatttatgaccatatgttgag

SEQ ID NO: 2948 - DNA, 180 bp, Homo sapiens
agaaagggagagccacactcccccagtgcagctgcagcccgtccggtaagaatacgaaacacccaggagccacagcaagggcacaggatttgcaaaatcatcttgccaaagggctgttcctcatttacacggtcatccagggcttagaaaaaggcttgattattggcgttttttacaaaa

SEQ ID NO: 2949 - DNA, 175 bp, Homo sapiens
gctgtggaggaaattcgtgatgttagtaaccttggcatctttatttaccaactttgcaataacagaaagtccttccgccttcgtcgcagagacctcttgctgggtttcaacaaacgtgccattgataaatgctgggagattagacacttccccacgaatttattgttgcagcacc

SEQ ID NO: 2950 - DNA, 180 bp, Homo sapiens
ctctcctgtcaacagtggccagccccccaactatgagatgctcaaggaggagcacgaggtggctgttctgggggcgcccaacaaccctgctcccccgacgtccaccgtgatccacatccgcagcgagacctccgtgcccgaccatgtcgtctggtccctgttcaacaccttctatatgac

SEQ ID NO: 2951 - DNA, 105 bp, Homo sapiens
attgtctctgtgtaagcacagtatacactattacatgcattaggtgtcaaatgcaaaaaaaggcattatttaaccactatatatgtttggtttagtcatctggca

SEQ ID NO: 2952 - DNA, 86 bp, Homo sapiens
ccaaaattgtcatactgttgttaagcaacagtataacaactatttacatagcattaaggttggtgcaaaaatgcaaaaaaaaaaaa

SEQ ID NO: 2953 - DNA, 175 bp, Homo sapiens
aggcaggttggagccgctgccgtcgccatgacccgcggtaaccagcgtgagtcgcccgccagaagaatatgaaaaggcagagcgacttaggttaagggaaagcgccgagatgacgggctttctttctgccggcccgcaagcagagggacttggagatcatgcagcagaggcagaa

SEQ ID NO: 2954 - DNA, 225 bp, Homo sapiens
gtggaagctcctatgagggaggaatatgcagacttcaaaccatttgagcgagtatgggagtgaaagatagtaaggaagatagtgatatgttggctgctggaggtaaaatcgagagcaacttggaaagtaaagtggataaaaaattgtttgcagatagccttgagcaaacttatcacggaaaagatagtgagagtagtaattatgatacttcttctcccagtacgc

SEQ ID NO: 2955 - DNA, 270 bp, Homo sapiens
gcgtaagtcgcttgtccgtggcttctctgagaagaaaagttgaaaaagggtaaagtttcaggaatattcgggctctctatttctaagcatagcgaggtgttcggttttctctctccaacagacatcgctattgcggttccgaggcagttgggagagatgccgcccctggacatcgtcgagctggcggaacccgaggaagttgaggtcttgagcccgaggaggatttcgagcagtttcttctcccggtcatcaacaaaattcccagacatc

SEQ ID NO: 2956 - DNA, 295 bp, Homo sapiens
gttccttgtcgggtgaccgtgctgtcggccaaagtcacgctccacagggtattccagccaaggagatcccagccaatggaacggacattgtttatgacatgaagcggggctttgtgtatctgcaacctcattccgagcaccagggtgtggtttactgcagggcggaggccgggggcagatctcagatctccgtcaagtaccacctgctctacgtggcggttcccagtggccctccctcaacaaccatcttggcttctacaaacaaagtaaaagtgggggacgacatcagtttctc

SEQ ID NO: 2957 - DNA, 275 bp, Homo sapiens
atcaacgccctgtgcttcagccctaaccgctactggctgtgtgctgccacaggcccagcatcaagatctgggatttagagggaaagatcatttgtagatgaactgaagcaagaagttatcagtacccagcagcaaggcagaaccacccagtgcacctccctggcctggtctgctgatggccagactctgtttcctggctacacggacaacctggtgcgagtttggcaggtgaccattggcacacgctagaagtttttggcagactttacaaataa

SEQ ID NO: 2958 - DNA, 285 bp, Homo sapiens
gtttgacaaaataagaatccatgagtccagactgatataaattaatgagtgaataatgaataggtgatttgagaagaaagggaaagcttctctttcacaatagaatgcccaattaacaaatacaaaggggaccaatggggttaggaaagagttaggacactacccttttgcagcaattacaataataattaggttaggtgaagatcatgaatgggggatacatttacggggacttttttatgaggaactggatattacatagcctcacagtgtttctcataggca

SEQ ID NO: 2959 - DNA, 664 bp, Homo sapiens
  misc_feature 14, 40, 41, 47, 83, 93, 123, 197, 249, 274, 282, 296, 300,302, 322, 365, 385, 400, 403, 427, 455, 470, 475, 479, 490,493, 501, 504, 505, 548, 561, 565, 569, 572, 578, 579, 580,581, 582, 583, 584, 585, 587, 590, 597, 598, 601, 603: n = A,T,C or G
  misc_feature 604, 605, 606, 607, 608, 609, 610, 611, 612, 613, 614, 615,616, 617, 618, 619, 620, 621, 622, 623, 624, 625, 626, 627,628, 629, 630, 631, 632, 633, 634, 635, 636, 637, 638, 639,640, 641, 642, 643, 644, 645, 646, 647, 648, 649, 650: n = A,T,C or G
  misc_feature 651, 652, 653, 654, 655, 656, 657, 658, 659, 660, 661, 662,663, 664: n = A,T,C or G
gtttgacaaaatangaatccatgagtccaagactgatatnnattaangagtgaataaatgaataggtgattgagaagaaaggnaagcttctcntcacaatagaatgccaattaacagatacanaaggaacaatggagttagaaaagagttagaacactaccattttgcagcaattacaataataattagtttaggtnagaatcaggaatgggtgatacatttacggagactgtttgatgaggaactggntattacatagcctcacagtgtttcncaaaggcnatttccaattctanaggnanaataggaacttcacagtaanaagcatggtgggcaccaccttaaccaaatgattcaagttatcnataacaacgggacaatctgncatgtgtttcccaanatnccgatgaaaaagagcatagcatcncaattttcaacatttatccaagcaatcnaaacaaaaaaaaacnccggngtcntctaaaacggnccngggcccancgnntttccccccgggggggggcccaagggaagtgttcccaaattcncccaaaagggggnccgnttanaantccccnnnnnnnngncgnggggggnnggngnnnnnnnnnnnnnnnnnnnnnnnnnnnnnnnnnnnnnnnnnnnnnnnnnnnnnnnnnnnnnn

SEQ ID NO: 2960 - DNA, 195 bp, Homo sapiens
ctgaaacatacaatattgtatttagtttcagtagtccgattagtatatacagaggtcttgtgccctcctccccctgaaaaaaaaaaaagccccttttttgtgtctatttactgatctgctcttcccttgtaactccccaaacccctcaacctactgggtaatatggaaggagttcatttagcccaatctgtttat

SEQ ID NO: 2961 - DNA, 550 bp, Homo sapiens
ctgaaacatacaatattgtatttagtttcagtagtcctattagtatatacagaggtcttgtgccctcctccccctgaaaaaaaaaaagccacttattgtgtctattactgatctgctcttccttgtaactccccacccccctcacctactgagtaatatgaagaaattcatttagcccaattctgtttaatacttagtctatctaataatttaaccaggtctcaggataaaatgcttagcctctcttacttctactttctttctcttacttgaacacgcatcctcctcaggttggcatcatggtttatgggaggagaggtgtcccctttcacagtattgttgagttggtgaatgacctcatggtagcctggtgaagcctcttgagttcttgtcgtccctctagatctttgccatttgagctataaagtggctggtctggcaaatagcctgctatgactgacctggtaacctgggcattttgctggaaccattgctgacacctgcagttgatgaactaacctgtgatctctttgttggcttgacaagggtc

SEQ ID NO: 2962 - DNA, 191 bp, Homo sapiens
tggatccaaagaattcggcacgagtgaaagcacatgtttcagtgccactcacataagaagtgcccggtaagtgttagctattattgtctactttgagttactacctttctaaaagtatggttgaagtcttttttctggtaattgcagatttgttgatcttgcatttgagtattttctatattttgaggctg

SEQ ID NO: 2963 - DNA, 240 bp, Homo sapiens
gatctaagcagcgttcccacagccccctctagattcttggagttccgcagagcttactatacgcggtctgtcctaatcttttgtgggtgttcgctatctcttgtgtcaaatctggtgaacgctacgcttacaaatattgtctttgtgctgctgtgtgacaaacgcaatgcaaaaccaatcctctttctctctcttaatgcatgatacagaataataataagggtttcatctttaaatgaa

SEQ ID NO: 2964 - DNA, 125 bp, Homo sapiens
ygcacggtagccagtggcgtgcagcacggctgaggttgcacgcagcgagaatgtcatggagttgaggcggcacgctacttgctcgagatgattttatgaagctgccgagtaagagtcgtccttca

SEQ ID NO: 2965 - DNA, 323 bp, Homo sapiens
tgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttaaaaaaaaaaaaaaaaaaa

SEQ ID NO: 2966 - DNA, 140 bp, Homo sapiens
acgcaagcatggttaacgtccctaaaacccgccggacttcctgtaagaagtgtggcaagcaccaaccccttaaagtgccacagtacacgaggggcaaggatttctctttccgcccagggcaaagcggcgttatgacagga

SEQ ID NO: 2967 - DNA, 100 bp, Homo sapiens
tgacttaggaaggagctacgccagagactggcttctctccggaggccaaaccaagagggtttgcaaagtaagctaaggagacctttccctcctaacctgg

SEQ ID NO: 2968 - DNA, 306 bp, Homo sapiens
gtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccattaaaaaaaaaaaaaaaaaaaa

SEQ ID NO: 2969 - DNA, 120 bp, Homo sapiens
cagccgctgaaccgtagagcatttctttggcttggacctggttggccgggttctaagaaaagccctttgtttacgtatatacgctttcccactcaggagccgtttccaagcctcggtaca

SEQ ID NO: 2970 - DNA, 480 bp, Homo sapiens
ggcagccggctggaaaccgtagggagcatcttctctcggactcgggacctggttcgggccggggtgctgaaggagaagcccctgtggtttgacgtatatgacgcctttcccccgctgagggagcccgtcttccaaaggcctcgagtgcgatatggcaaagccaaagctcccatccaagacatctggtaccacgaggatcggattagagcgaagttttattcagtgtatgggtctggtcaaagagcttttgatctattcaatccaaacttcaagtctacctgtcaacggtttgtggagaagtacactgagctacagaaacttggagaaacagatgaagagaagttatttgtggaaacagggaaggctttattggcagaaggtgtcattttaagacgagtaggcgaagcaaggactcaacacggaggtagtcacgtttcccggaaatccgaacacttgagtgtcagaccacagactgcgttg

SEQ ID NO: 2971 - DNA, 130 bp, Homo sapiens
acataattatgtagatattcaccctacccaagatcctgacacttaccatgtctattttcccgatcctcagtcccacattgtgcttggaattgaggtacttggaaggggctgagttaggaggggccagcac

SEQ ID NO: 2972 - DNA, 490 bp, Homo sapiens
cctgcctacatcaatttatgttagattattcccacccctaccccaagatccctgacaacttacccatgtgctattttccccgaatcctcagttccccacactgtgcttggcaatgaggtacttggaaaggggctgagtgaggaggggccagcacttccagtccaagggtctccacttctccctggcatgctggaagagaccagagctcactgtcccacccaggttctatgagactaggcatggggcaatgggctaggccatcagcctccaactatgtggctctgcaatgagcagaaatcccagccctggaagcgcacccacgaagcccatgctctgtgtccgaaaagacactcccagcaggcacggcgcctgcgcaatgcctgcagccagctgcctgtggtcccgggaatggctctgttgactaatttctgtacataattccacccaggatgagtcaacagtcagggcaagcaggactcctcacaggctg

SEQ ID NO: 2973 - DNA, 110 bp, Homo sapiens
gacataggagggcccgacaggaattcggtgtgacataggccggcttcttttgtaaaacctgacccagaacacacaatcgtgcaacccaaggcccaagtctttccaattta

SEQ ID NO: 2974 - DNA, 121 bp, Homo sapiens
ggaggcatcctcctgaccagcagaggttgatctttgctgggaaacagctggaggatggacgcaccctgtctgactacaccatccagagagagtccaccctgccacctggtgctgccgtctt

SEQ ID NO: 2975 - DNA, 114 bp, Homo sapiens
gagcctccagaacctgctttcctatgtttacccaggggacctcctttcagatgacctcgggaggagatgaaatgttttttcatatttaaataaataagggccattaaaaggcaa

SEQ ID NO: 2976 - DNA, 107 bp, Homo sapiens
aaggaggttgtattttctcctttcttaagagtcctcacagcgttttgcatgacagtaaatcaagagagattactcattgagggttgattgagtagatgccctaaaaa

SEQ ID NO: 2977 - DNA, 117 bp, Homo sapiens
gtttgaaactactttattttactaatttaaactattttgtactgatgtagccctgggtaggttcaatgaaaatggctgtggcactcattccatgggataaatgttggggaggctgga

SEQ ID NO: 2978 - DNA, 122 bp, Homo sapiens
gattttttggccttagctacaggagagaaaggattttgcctacaaaaaacagcaaattccatcgtgtaatcaagggccttcatgatccagggcggagacttacaccaggggagattggcaca

SEQ ID NO: 2979 - DNA, 225 bp, Homo sapiens
ccttatttaaaactcacctcccaatcaccccaaacaaatggaagagaagagaaaggacatggcgtattttgtatttaaaagtaattgtattaattatttaaagttgtggaaagcaaaataacaaaaaagagaaacgccaacaaaaattcagcagatttttgaagacaggggtttcgggggtgggcttccggcacccacatcctggagtcaggactttctcagtta

SEQ ID NO: 2980 - DNA, 104 bp, Homo sapiens
gagattgtaaatgaaaaaaatatagaaactatttagttttggtagattttttttcctgacaatgtgaccagactgaatttcctcataaagaaaaaatggcgtgc

SEQ ID NO: 2981 - DNA, 320 bp, Homo sapiens
actgctctcttccaaaacaaaactcagcatgatactttgagattgtgttctgagagatgatatgactacataaaatacaattaaaaatgttataatataatgaaaatgtagtaatttaagagaacaccagatgagttaggaataaacctataacatttacaaaaagagcaaaactaagtgatagaaaatatttcacacatgttcttatagatcatgtatcacttgcaagttttaggagttcatatcctatatcatttcaaattaggtccataataaggtaaatttttgaaatgaccactttgggttttttcccaagttta

SEQ ID NO: 2982 - DNA, 181 bp, Homo sapiens
cccgttccacggaggccgcggggtgggggcttgggggggggccgccgaccgttccgctcttccggccaggtgcttttctgtcaatttctatggaatgcaaaaggaggtttttgttttattttgtttttttgtaaagcttaagaaaaaaatctacatctttatacttgagcctcccatactt

SEQ ID NO: 2983 - DNA, 275 bp, Homo sapiens
gtggagtgatcccacaacgtaagacggccgtttcgacaatccgccccggcccttaagatgtcggccaccttaatggcaacagcacggccatccaggagctgttaagcgcattccgagcagttcacggccatgttccggcgcaaggccttcctgcactggtacacgggccagggcatggacgagatggagttcaccgaggccgagagcaacatgaacggccttggtgtccgagtaccacagtaccaggacggcaggccgacgacaaggggagttcg

SEQ ID NO: 2984 - DNA, 235 bp, Homo sapiens
agtttcgtcagattctccaggggttccaagggcgaaagaaccttaagcctaggccttttgagattggaagacttcactaatactaggcacactgtgattcttcactctacacaacaacttactcttggacatccggcatttctttctttgtgtgtcttctcggtcttgtttcagggatcttgagagaagcaaacgtaactttcttcatgcctacatatttcctttcggttggctt

SEQ ID NO: 2985 - DNA, 217 bp, Homo sapiens
aagaaatgtaggtggataaattaatatgtaattaaaggtgaaaaggcagaagatatgtaaacacaaacatacttcatagacctaggaattttgaaggagtaactcgtgctgtaaggagggaggttaaggtttcatcctctgaaacctctttcaaatttagcaggctataactctcaccctcacttttaggtcaatattggagaatatctcgctagga

SEQ ID NO: 2986 - DNA, 288 bp, Homo sapiens
ccagcactactggaaaatcagccaatcttaacccagatggccatgaattcctgtatgtgaagacggtcttaagggtgttttgtttgtttaatcaagcctcttgttttgagattttggcatacaattctgttttctagggaatttctgtgtcctatgggaggaggtctaataaggattggatgcttccatttctgataggaggaccaataggattattggaggctacaaaggcttttggtgagacacctcgtggtagtgtactatctggactctgagctgcattataac

SEQ ID NO: 2987 - DNA, 265 bp, Homo sapiens
cttttactaaatatacaagatttactactagaaatttcgagaaagaacactaacacatgtacttgtgatttgttcatgttatattaaaacttgagatttgtgtatttatgtagagtctgtattgacaagactgttgttttttgctccttgagctatataataatctgtgtattggattgttgtcttgatttggtctaaatttgatatatatgagttacttgaatatacacaatgaattttgtttgatagatttatattgtacctt

SEQ ID NO: 2988 - DNA, 130 bp, Homo sapiens
gttcaggattcctggtcccccaggaaagccagttatatacaatgtgacttctgatgggcatgtcactaacttgggatggctccaggtttatgatgggtggttcagaggttactgggattgccatgtttga

SEQ ID NO: 2989 - DNA, 280 bp, Homo sapiens
gacaaagccaaggcacccctagagagcttctccgagagccgggcagagaagatgggccagaatctcaaccggtattccatacaaggacacattctggagggggaccacccgcactcggccccgaaatggaacctgaacaacactctggcattgacttcaaacagcttaacttcctgacgagctcaacgagaatcactctggagagctatggagggccgctgcagggcaatgacattgtcgtaggtcctgaaggttcgagctggagtacaaggaagagcag

SEQ ID NO: 2990 - DNA, 290 bp, Homo sapiens
ctagaagtcccactcctaaacacatccgtattactcgcatcaggagtatcaatcacctgagctcaccatagtctaatagaaaacaaccgcaaccaaattatttcaagcactgcttattacaattttactgggtctctattttacctcctacagcctcagagtacttcgagtctcccttcaccatttcgacggcatctacggctcaacattttttgtagccacagcttccacggacttcacgcattattggctcaactttcctcactatctgcttcatccgccaactaata

SEQ ID NO: 2991 - DNA, 305 bp, Homo sapiens
gagaaacaaatatttacttagagtggaaggactgattgagaatgttccaatccaaatgaatgcatcacaaccttacaatgctgctcattgttgtgagtactatgagattcaaatttttctaacatatggaaagccttttgtcctccaaagatgagtactagggatcatgtgtttaaaaaaggaaaggctacgatgactgggcaagagaaagatgggaaactgataaagcagttgatcagcatcattgggacatggggacgagttacggcaggaggaccacgaggaatacctcaaaactaacttgt

SEQ ID NO: 2992 - DNA, 190 bp, Homo sapiens
  misc_feature 38: n = A,T,C or G
cttctcagatactggaaactttggttttgggatccagnacacatcgatctgggtatcaaatatgacccaagcattggtatctacggcctggacttctatgtcgtgctgggtaggcaggtttcagcatcgagacaagaagcgcaggacaggctgcatttgggcaaacacagaatcagcaaagaggaggcat

SEQ ID NO: 2993 - DNA, 190 bp, Homo sapiens
gtgagtcagcatttacattcccaccagatgtgttccaggttcttgtcatactgcgttcttgccagcgctttggtgctgtcagtcttcttagtttccatttagagattcagtttttaaacttttgaacgtcttgggttacaccttggttgagaaagtaagaaaagggcctgctttctattggccattttga

SEQ ID NO: 2994 - DNA, 245 bp, Homo sapiens
cggcggcgtcggcagcagtttcgacggcagccgcggcggcgggtgggaaattgcggagtatcttggcctccatcttcggcacccagaaagacaaagtcaactgttcattttatttcaaaattggagcatgtcgtcatggagacaggtgctctcggttgcacaataaaccgacgtttagccagacattgcctcttgaacatttacgtaacctcaaactcttccagtctctgacggtttgcgctgtg

SEQ ID NO: 2995 - DNA, 205 bp, Homo sapiens
aaataattttattctatataagtgtaaattattgataccagattcactggacagtttcacctgataatttatgacaaagacatacctctaatattgaaattaaaaggtgaaatttgtcataaagatttcttttatttttgaaatcgagtttgtaaatgtcctttaagagggagatatgaatccataaataactcaagctttgcta

SEQ ID NO: 2996 - DNA, 105 bp, Homo sapiens
ccagtatattattttggaggagttaagttaattcatgtaccactagaacgcaggcaacacagagttatatctcctacctttaaaggcctcatagattcatctcca

SEQ ID NO: 2997 - DNA, 325 bp, Homo sapiens
ccagtgcgtctgtcgcacgtccccgggccgtgctgctggcgtcactttctttgatatgtagctttttcttaaagacttttgaatgtttaataattttgtaaatcatgctctttacacagagtaccacttatttaataagacgggatgtaaatttacaatgacaaatgtgtattttaagaagaaaatgacattattttgaatggtactttgtggaaagaggggagaataaagttatgctgtgtacatcacttgcagatcaccaaaaccactcgctgcccgtgaccgcgggggtgtgtcccgctcccgtcgtccgccaacctaaacc

SEQ ID NO: 2998 - DNA, 180 bp, Homo sapiens
cgcacgagctttgcccgggtgccagtgcaacctacaccactctgacaacccttccgctagagagcgcagtttagccggcagtatgccacatttatgccaaccgcctcatccaaatgagacccttcctggagagccgggcccagcagcactggggcagtggagtggagttaagagctgttt

SEQ ID NO: 2999 - DNA, 305 bp, Homo sapiens
caaggatgcactatggatgctatcaaagtatactgtgatttctctactggcgaaacctgtatccgggcccaacctgaaaacatcccagccaagaactggtataggagctccaaggacaagaaacaagtctggctaggagaaactatcaatgctggcagccagtttgaatatatagtagaaggagtgactcccaaggaaatggctacccaactcgccttcatgcgcctctggccaactatgctctcagacatcacctacactgcagacagcattgcatacatggtgagggactggcacctgaaaag

SEQ ID NO: 3000 - DNA, 269 bp, Homo sapiens
gttttacatggctaattcaaagtacagcttattgatttaaggataaaacatcatacctgttaaacaatgtagcttggcacccatttgacttaggagaaatctaattcaatacagccaaatgttttatatatacaaaggaaagtactaagacactacgatgaagattaacaagtagtttttaaggctacattgcagacatgtttacatcactaagtatgttttgcttaaagtgttctagatttcctgagttattaaaatatataacccaa

SEQ ID NO: 3001 - DNA, 279 bp, Homo sapiens
acgtgcgtgcatgagtgggagagcacagcgagatgcctattctactgacatcactgtgggtgaacagagatttccaggttttccctcttaaaatatttgtcccacaccgacaagagtccagtcaccaggcctcaaaggaacttctgcttgtagcagccgcctcccctgtgccccagcctccttaatgtgtgcactctcagagggcacagctcacgaggctgggttttgggggccaagtcgcttgttcattccagcatctaacatcataaaggtgggccc

SEQ ID NO: 3002 - DNA, 139 bp, Homo sapiens
gagtccttgccatcctaaagccacccacttctctctaaggagaatgccagtcctctccaagtccacacaggggaggtgatagcattgctttcgtgtaaattatgtaatgcaaaatttttttaatcttcgcctcaatact

SEQ ID NO: 3003 - DNA, 102 bp, Homo sapiens
ggcggaggtgcaggttcttgtgcttgatggtcgaggccatcttcttggccgctgcgattcgttgctaaacaggtactgcttggccggaaggttgttgttcgt

SEQ ID NO: 3004 - DNA, 126 bp, Homo sapiens
gtaataatgtaatacatttttagattttagcagtacagaaaactccttcatataaggtcatgtttgagtcttataatacctcatatgttgaggcaggccgaaatttttctgatattatagacaagg

SEQ ID NO: 3005 - DNA, 130 bp, Homo sapiens
ctagctatatccagcactttggagccagcagcagatcatttaggtcaggttagacagctgccaacatgtgaactgaacccacttacaaaaataaaaattagcagtttgtgtgcatgcttagtccagctac

SEQ ID NO: 3006 - DNA, 170 bp, Homo sapiens
cttgagcgagctgaaggttgccgggcatgaaagggaagaagagcaggcaaattaggtgcatggggaaccttgggtgagaggtcttaggggcggaggagctctggggggatttcagaaggcaagggaaggagctagtcctccccccaggaaagcagcaaggaggagcccct

SEQ ID NO: 3007 - DNA, 135 bp, Homo sapiens
gtaacttagcagatggttctaggacgtccgctgaccaccgcgttacgccgcatattggtcccgggaaagcatttgcaaatatgacgaattaaggggacaattgttccacagagcggccccagaccccaactttgt

SEQ ID NO: 3008 - DNA, 169 bp, Homo sapiens
ctcgccaatttgggggagggaaaaagggttccagtccccgaaggcctgggacctggacgcctgggatacaatgaggccactctcggacagcgagtacagagggacggagaggcccagggcttctttccacggaggaggaggcaggcggctgtcccaagagacccagccc

SEQ ID NO: 3009 - DNA, 200 bp, Homo sapiens
tcaacccggccatgtctgaccccaatcggccaccatgtcgcaagaatgatgatgacagcagctttgtagatggaaccaccaacgggtggcttttggtacagcgtacctgggagggatgcaagacttcaattaccttagcagcaactgttttgagatcaccgtggagcttagctgtgagatgttcccacctgaagagactc

SEQ ID NO: 3010 - DNA, 270 bp, Homo sapiens
cgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatcccgagatctcagccatattggagatgctgttgtaatttcctgtgcaaaagacggagtgaaattttctgcaggtggagacttggaatggaacattaattttca

SEQ ID NO: 3011 - DNA, 165 bp, Homo sapiens
atggtttaaagcttgcagtaaaaatgccaaacactgtagtaccttggaacccaggtttattcttggtgctaagcagaactgtaaaatagttaaaatgtcttatcaagtaattcggcgattacaaagacaccattttgttttttattcaattctctgttttaactc

SEQ ID NO: 3012 - DNA, 290 bp, Homo sapiens
aggtcgacactagtggatccaaagaattcggcacgagaagctatggaataccctgggtgtktgcaaatacactktccaggatgagagccactcagagtgggtgtcttgtgtccgcttctcgcccaacagcagcaaccctatcatcgtctcctgtggctgggacaagctggtcaaggtatggaacctcggctaactgcaagctgaagaccacccacattggccacacaggctatctgaacacggtgactgtctctccagatggacccctctgtgcttctggaggcaaggat

SEQ ID NO: 3013 - DNA, 175 bp, Homo sapiens
cggacattcagactgagcgtgcctaccaaaagcagccgaccatctttcaaaacaagaagagggtcctcctgggagaaactggcaaggagaagctcccgcggtactacaagaacatcggtctgggcttcaagacacccaaggagcgctattgagggcacctacatttgaaagaaat

SEQ ID NO: 3014 - DNA, 395 bp, Homo sapiens
tgtttatcttgtcatattgccacaaactcaaggaactagagagaaagagaaaccagaagagccacctcaaaggagatagcagggcagtgaagaaaatgtttgagggtcttgaaaacaaaccatctggttacccagaatagaacataaggatattactgtccacatggctcattttagtttttgaacactgaggtdacagagataaaatataaaggaaaattgggaaatatacatcacaggcacaggtttgtgttcttactatgatacaagtattttgatcttagattagttgttctctagctatcaaagaaagctttgctttcagaccaggtcactatgcagtgagtcaatgttcttttacattataatttatggcctcctttgaaaagcttctg

SEQ ID NO: 3015 - DNA, 292 bp, Homo sapiens
gtcggggaaaatttagtgttatccaatgtatgatgaaatattcagctctcacaaaaactggatgtttggctattttaaaatggctgttcttcacaataaaactacaaacagacactgtcgaataaattgagtgataagtatgtctatttactaacatgagccaatttgaactttagttttgagatctaaaaatattttaatccacatgcatttagtgactaagaaattgaaggcagtgtccttttgacaaccaagcttattgaaaactttggcattaatgtccacaaccatg

SEQ ID NO: 3016 - DNA, 257 bp, Homo sapiens
taatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacacttgaccaaaatttgtcacagaattttgagaccattaaaaaggtaaatgag

SEQ ID NO: 3017 - DNA, 372 bp, Homo sapiens
atttcggcagggaaggacatgaggcttccctgaagcaaggatttcagccagatgccatagaccctcagatcttgacctggaagtccagacactgaacgcaggcctcaaaactgctgcggccttccaactcctggtatctgcatcggcgaatggcccttcttgccttgatccacagggatggggaagggaatgtcattaatgttttgttaatactgattctttcatgcaatgatgtgtattttccattctggaggctgtgggagatgacaagacaatgaatgggaggtctgacacagaccaaatcagcggttcttaaagctttggggatctcagactcctttgagattattggaaatggccccctatacttgg

SEQ ID NO: 3018 - DNA, 210 bp, Homo sapiens
gaggtgacgggcactcactcccatgagccctggctgtgtgctgttgtgtgcctatcggcagatccatccttcctgcctccaaggaggatacacagagaatggcttcctgttgttttgtttattttcttaacgtgtacagatggaaacttcatttaaaaataaaaacaaaacactcaaaaaggataaaatttaatcactgttttgtttgtg

SEQ ID NO: 3019 - DNA, 333 bp, Homo sapiens
tgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgactgtcttaaggatttgtttaaccagctaagttacttgattaaattatgataaattgt

SEQ ID NO: 3020 - DNA, 290 bp, Homo sapiens
atggtgtggatctcctaatgaagtatatttataaaggatttgagagcccgtctgacaatagcagtgctatgttactgcaatggcatgaaaaggcacttgctgctggaggagtagggtccattgttcgtgtcttgactgcaagaaaacctgtgtagtctggcaggaagtggattatctgcctcgggagtgggaattgctggtacaaagaccaaaacacccaaatgccaccgttgccctgtgggtaggatctgtttctctcactttgccttcttgcttttccatatctgtaa

SEQ ID NO: 3021 - DNA, 103 bp, Homo sapiens
  misc_feature 96: n = A,T,C or G
gtacttctagagcggccgcgggcccatcgattttccacccgggtggggtaccaggtaagtgtacccaattcgccctatagtgagtcgtattacaanacacttg

SEQ ID NO: 3022 - DNA, 272 bp, Homo sapiens
ccttgtctgtggagacggattacaccttcccacttgctgaaaaggtcaagggccttcttggctgatccatctgcctttgtggctgctgcccctgtggctgctgcaccacagctgctcctgctgctgctgcagccccagctaaggttgaagccaaggaagagtcggaggagtcggacgaggatatgggatttggtctctttgactaatcaccaaaaggcaaccaacttagccagttttatttgcaaaccaaggaaataaaggcttacttcttt

SEQ ID NO: 3023 - DNA, 420 bp, Homo sapiens
ctcgtccaaattcggcacggaaaacttttgtacctaatgaccgccccacctggcatatactggctggcctcttctctgtcacaggggtcttagtcgtgaccacatggctgttgtcaggtcgtgctgcggttgtcccattggggacttggcggcgactgtccctgtgctggtttgcagtgtgtgggttcattcacctggtgatcgagggctggttcgttctctactacgaagacctgcttggagaccaagccttcttatctcaactctggaaagagtatgccaagggagacagccgatacatcctgggtgacaacttcacagtgtgcatggaaacatcacagcttgcctgtggggaccatcagcctgtgggtggtgatcgcctttctcgccagcatccctcgcttcatctcagctgtggtc

SEQ ID NO: 3024 - DNA, 318 bp, Homo sapiens
gcagtcatcttcatcaacacccggagaaggtggactggctcaccgagaagatgcatgctcgagatttcactgtatccgccatgcatggagatatggaccaaaaggaacgagacgtgattatgagggagtttcgttctggctctagcagagttttgattaccacttacctcctggccagaggaatttatgttcagcaggtttctttagtcatcaactattaccttccaccaacagggaaaactattatcacagaatcggtcgaggtggacgttttgccgtaaaggtgttgcttttacatggtgacagaggagacagagg

SEQ ID NO: 3025 - DNA, 290 bp, Homo sapiens
ctgtattctccaggaacttgtccttctggaatcatattgaatgatatttctatatcgaagtgaggtaggtgcggtattaaagtgaaagggaaggtgatgcatttattctgggttatgcttgcaagtgttagatggctaagtattaaaattatccaaattaaatccttagcagtcagaacacttgcttcactagagtatgccacctgccactcatgttggactgagctaatttgttcctctttctgaaactattaaggtaaataattaacaataaaaatctcttataaagg

SEQ ID NO: 3026 - DNA, 168 bp, Homo sapiens
gcacgagcagaggtggaggtgggctgatggcctggctgcctggtggttgatggttttgctccccctaccttttttttttgagtttattctgattgattttttttcttggtttctggataaaccaccctctgggacaggataataaaacatgtaatatttttaagaggg

SEQ ID NO: 3027 - DNA, 220 bp, Homo sapiens
cctatatcccccgcccgcgtccctttctccataaaattcttcttagtagctattaccttcttattatttgatctagaaattgccctccttttacccctaccatgagccctacaaacaactaacctgccactaatagttatgtcatccctcttattaatcatcatcctagccctaagtctggcctatgagtgactacaaaaaggattagactgggctgaat

SEQ ID NO: 3028 - DNA, 105 bp, Homo sapiens
gtcggggaaatttgatgtttccatgtatgatgaaatattcggctctcacaaaactggatgattggctatattaaatggctgttcttccaataaaactccaaccgg

SEQ ID NO: 3029 - DNA, 220 bp, Homo sapiens
ttgaccctttggccacaggagaacgtgcccagtttttcttaaagaccacgtgggaactcagcagcccatgattgtaggttcctytttccctcatagagtggccttcaagggcaggttcttgttatctgcgtttcagagaccaaagggacacaggcatttctgctcctgggaatttgcggactttgaatcttgagctcagattttggtctctgttggttgc

SEQ ID NO: 3030 - DNA, 200 bp, Homo sapiens
gttcattattctttataacatttgagagaatcagatgtagtgatatgacagggcttgggcaagaacaggggcactagctgccttattagctaatttagtgccctccgtgttcagcttagcctttgaccctttccttttgatccacaaattacattaaaactctgaattcacatacaatgctaattttaaggccaatagat

SEQ ID NO: 3031 - DNA, 130 bp, Homo sapiens
aaacttaccttttgttattgagcaggcctatctctttcagatagttttatgattcacacaggtttgaggatgctggggagagggggagggggctgttggtggtgttctgttggttacaagaaagttatac

SEQ ID NO: 3032 - DNA, 179 bp, Homo sapiens
aaaggaggaggtgggcgtagaggtgaagctgcgctccgatgagaagcacagaagatgtctgctactccatcgggctcattatgaagcataagaggtatggctataactgtgtgatctacggctgggaccccacctgccatgatgggacacgagtggatccggaacatgaacgtccacag

SEQ ID NO: 3033 - DNA, 250 bp, Homo sapiens
caggaggagcggcttgctcgctggccttgcggcgctcctcagggagctgggcgccacgagagatcctcacccgggtctctcctcagggatgacatcatccgttcacctccttgtcttcaaggaccacctcctctccattcttagctgctgccaaggggcctcctgccatctcacttacgagggcactaggagcacggttcctggatccaccacattcaaagcagccacttacttacccccaggaccagga

SEQ ID NO: 3034 - DNA, 100 bp, Homo sapiens
  misc_feature 70: n = A,T,C or G
ccactgtgggcctctccaagcgtcctgcacgtgtcccccgtagctttaccatttagtgagggagcagccnagcggtcggagggggtcttgtcttgggtct

SEQ ID NO: 3035 - DNA, 120 bp, Homo sapiens
gtgacctacggagcagttgtgagctctctgaccagaattcaaaatagcagttttacagagactcagggatcaacaaggacacagaattcaccttctgaaatttatcagagaaatttaaca

SEQ ID NO: 3036 - DNA, 159 bp, Homo sapiens
ttttcatttcatcttcagacaccacaagctttattatcaaggagtcttgtggctcctacttgagtcttaccccataccaggaagagtttaagaacccagggtcttagtccaaatttggggccaggctgggtgcagttgcttattgcctataatcccacc

SEQ ID NO: 3037 - DNA, 160 bp, Homo sapiens
gaacctagtctcgagttgtttttaatcttgtaaaacatgcttggtggttgtgccagtatacgtgaatatttgtatggtgtttggtgatttgtattctaggggtgcaggttggttaaatacatgagccattttcccattggcattcaaggtacttttgaca

SEQ ID NO: 3038 - DNA, 433 bp, Homo sapiens
gtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaaaaaaaaaaaaa

SEQ ID NO: 3039 - DNA, 145 bp, Homo sapiens
gtcaaatgaaggtgaattcaaggctgaagggaaatagcaaattcacctacacagttctggaggatggttccacgaaccacactgggggattggagccaaaccagtctttgattatcgacacacgcaaggtctgtaaagactccct

SEQ ID NO: 3040 - DNA, 121 bp, Homo sapiens
ggagaaaagtatggcatccccgagccgccagagcccaagaggaggaggtacgccggcatatccacagcctcttttaggacttccgagccagccttacttcgggaacgggcttggccaattm

SEQ ID NO: 3041 - DNA, 121 bp, Homo sapiens
caccagccgtgtgcagcctatcaagctggccagggtcaccaaggttcttggcaggacggttctcagggacagttcacggaggttccgcgttggattcattggaccgcaaggaacgattcct

SEQ ID NO: 3042 - DNA, 127 bp, Homo sapiens
tctaaacttctgggaacaaacaggacacattggagcttgagaacccctcgctgacattcaccccagttttcaggcaggaggttgttgtcaacacacacaattcaacctggacaagacaaccctgtca

SEQ ID NO: 3043 - DNA, 164 bp, Homo sapiens
ctgacctgacctgatgtccattcattccaccctctcacagtttggacttttcttccctctctttctaagagacctgaactgtggcagagatgcaaaattaaaaatctcggtgtgtctctattatattatatgtgctcttcccgtaaagagcccctcgcggtcam

SEQ ID NO: 3044 - DNA, 128 bp, Homo sapiens
gttcgacagtcagccgcatcttctttttgcgtcgccagccgagccacatcgctcagacaacatggggaaggttaaggtcggagtcaacggattttggcggattgggcgcgcttggtcacacacaggct

SEQ ID NO: 3045 - DNA, 102 bp, Homo sapiens
ctcaggagggaggatggtgcaaggcaggggttaggagcgcacgggcggcgagcggaggcacttggcttcaagaggcccttggcaaggcgggccttggggccg

SEQ ID NO: 3046 - DNA, 252 bp, Homo sapiens
catttatattgcccatctccttgttgtcttcaaagggtgttgagagcttgagggaattattgttgttccctattgggaacttatgttttgaagtatgttgcaggttttcaacaattttgggcacatgaaagccttgacaagttttttaagagggcagaagcttttatttttttgcacaggaaaacatgtttttttaaattcacatgtttgtattgagtacttttgcgagaggggcatgcactgctagggttt

SEQ ID NO: 3047 - DNA, 316 bp, Homo sapiens
cttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacaatacggaggataagatcaatgccctaattaaagcagccggtgtaaatgttgagcctttttggcctggcttgttttcaaaggccctggccaacggtaacattgggggccttaacttcaattagggggccgggggacccttcctcaagcagctgg

SEQ ID NO: 3048 - DNA, 250 bp, Homo sapiens
aaatttaactgttagtccaaagaggaacagctctttggacactaggaaaaaacctttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccttatagaggatctaatgttagtataagtaacatggaaccaattttcctc

SEQ ID NO: 3049 - DNA, 145 bp, Homo sapiens
cgaccagctgctggacatgtcctacgagcagctgatgcagctgtacagtgcgcgccagcggcggcgggcttgaaccggggcctgcggcggaagaagcacttcctgctgagggactgcggaaggccaggaaggaggcgccgcccat

SEQ ID NO: 3050 - DNA, 210 bp, Homo sapiens
acaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtggaaccctgtctctacttaaggttgcaattagccaggtgtggcggctaatcccagctgggcctgtg

SEQ ID NO: 3051 - DNA, 200 bp, Homo sapiens
ctcatcttgtgcccactgatggcagccgtgacctacatcgacgagaagcgggacttccgcacataccgcctgagtctcctggacggagtacggctgctgcaaggagctggccagccggctccgctacgcccgcactatggtggacaagctgctgcagctcaaggtcggccagcaaccgtctcaaggcctcctaatagctg

SEQ ID NO: 3052 - DNA, 155 bp, Homo sapiens
cgggtcgcattggcgctcctacgtcagccagcctagcatggatgccctggatcaggcatgctctcgtggcatctccacaagtctccgcaggaggtgcaagcacacctgagcaagaggagctgaaggagctgatcagaggagctaccatgctcgag

SEQ ID NO: 3053 - DNA, 78 bp, Homo sapiens
atgtgatctcagatacgtgaagctgcatacagaggggcccatccactcctaaacgggtctccaggaggcttggtttga

SEQ ID NO: 3054 - DNA, 215 bp, Homo sapiens
cctcaatctcccttcaaacaagatgctgatttgtagggtacttggcaggttaaattaaaccagaggaggtgacttaataaaaagggaatgacatttagggtataacgatctcataagaaatgtaatatgtaaattatatctgctttatgttgtaaaatatacattgtttgcgctagaatagaatgattcttttcaataaaaaggagagggctctc

SEQ ID NO: 3055 - DNA, 240 bp, Homo sapiens
gcgcggtgaggttgtctagtccacgctcggagccatgccgtccaagggtccgctgcagtcggtgcaggtcttcggacgcaagaagacagccacactttggcgcactgcaaacgcggcaattggtctcatcaaggtgaacggcgccctgagatgatttagccgcgcaccgtacaatacaagctgcttgagccagtctctcttcttcggcaaggagcatttcggttgagcaatccgtttcca

SEQ ID NO: 3056 - DNA, 280 bp, Homo sapiens
ggcacgaggaagaggccaaggcaccttccagaggctttgtggtgcgggacgcacccttggaccgccagcagcagttagaaggctcctgacatgagcagctctgaggaatttcccagctttggggctcaggtggctccaagacctcccttggggccccaaacgataatgatcaaaaagaacagaaccctctcagcctgctgaccaaacaacaaaaatggtttgtctaaatctgaccagcggtgggacctgcgtaaattgttgaggtttcacgcttgcgagg

SEQ ID NO: 3057 - DNA, 205 bp, Homo sapiens
ctttacaagaggttctgaagactgccctcatccacgatggcctagcacgtggaattcgcgaagtgccaaagccttagacaagcgccaagcccatctttgtgtgcttcatccaactgtgatgagcctatgtatgtcaagttggtggaggcctttgtgctgaacaccaaatcaacctaattaaggttgatgacacaaggaacctagg

SEQ ID NO: 3058 - DNA, 325 bp, Homo sapiens
tacacgatatgaatttcagcaatgaggacatgataagagaatttgacaatatggctaaggtgcaggatgagaagagaaaaagcaaacagaaattggggcgtttttgtggatgcaaagaaatttacaggaccccttctaccctagaggtccaagggaattcaggggtggctgcaggcccacgaaggacatttaagacattccttatgtttagtgtcctgcaggcatttaccaggccatgtgctttaacgttacggtaatactttactttaggcatcctcctttactagcagcctttgactatctcaatcagttccttgagtaggaa

SEQ ID NO: 3059 - DNA, 210 bp, Homo sapiens
ctcgtgccgggagcggagctcaaggctgcggaggcggaggtggagctgagcgcaagacgacttcgggcgtggggggcccgggtgcaggcccaaggccacaccctgcaggtagccgggctgagaggccctgtggctgcgctcggagccgctgggtgtgctggctgtggtgtgtccggacgagtggccctgcttgcttcgtgtccgtgctgg

SEQ ID NO: 3060 - DNA, 215 bp, Homo sapiens
gcctccgcaaagactgggagtaccatggagtaccgggggggaaatatggagtactgccgaggaacgtgggagccacagagagaggcgccgcactggtgagggcagggaccgcagccctcccacgcgccccagcaagtacagtgttccagcgaagtggagtaactgagccgggggaacaccaggagagagaacgatgcgggattggatgcaattga

SEQ ID NO: 3061 - DNA, 201 bp, Homo sapiens
ctggaattgaccgctacccccgcaaagtgacagctgccatgggcaagaagaagatcgccaagagatcaaagataaaatcttttgtgaaagtgtataactacattcacctaatgcccacagggtactctgtggatattcccttggacaaactgtcgtcattagggatgtcttcagagattcttgctctttaacgcagggccg

SEQ ID NO: 3062 - DNA, 216 bp, Homo sapiens
cccactctgtcaagtggaatccttccctttccaactctacctccctcactcagctcctttcccctgatcagagaaagggatcaagggggttgggaggggggaaagagaccagccttggtccctaaggctccagaaacgttcttcttaatccccacctttttcttacttccaaaaaaggattgaacaccttgattttggagtgtgtatactgcacat

SEQ ID NO: 3063 - DNA, 238 bp, Homo sapiens
ggaaaatgcaaggaaatactgagttaaaatacctgacatcacccttgtgacccaaggctagttacctgtgtttctatggaccattgactcaaatattttaatagatggcacccactgatctgatagttcgaaacatggtttcaggggtatatttaattactagatgtcttctgcttactgaaaaccattttgggctgggcacggaggctcacgcctgtaatcccaacactttggggag

SEQ ID NO: 3064 - DNA, 197 bp, Homo sapiens
ggacgctgcagtgcagttgtgagggcagttagcagccgcctcttctgcatcctgtcaactctgattagttagagtttaggctcaaaagagttggtggacttagattgaaatttggttgtgacaagaagaaaggaaaggagacacttagtaccaccagtttcagcaataaagaagggtcattttgtatttaaaattgt

SEQ ID NO: 3065 - DNA, 131 bp, Homo sapiens
cttgttccgaatttggcacgaggccagcttaagatgtagttgggtataaccccagacgccatgtaagctgtcatgtgccctttgagaaagatgctgttaccaggcccttttttgatcttctatgctcttgt

SEQ ID NO: 3066 - DNA, 118 bp, Homo sapiens
aagacttggaagttgaaaccaaggaagaatgttaaaaatatggcaaagttggaaaatgttttatatttgaaattcctggtgcccctaatgatgaagcagtacggatatttttagaatt

SEQ ID NO: 3067 - DNA, 192 bp, Homo sapiens
atgtgatctcagatacgtgaagctgcatacagaggggcccatccactcctaaacgggtctccaggaggcttggtttgatctactagatttggtgcctcttaaagggaagcaatacagcttttctgctgtgggttggtttgccactaggggaagattcatttctattccagccataaattagaccaaagagag

SEQ ID NO: 3068 - DNA, 260 bp, Homo sapiens
  misc_feature 215: n = A,T,C or G
atgtgatctcagatacgtgaagctgcatacagaggggcccatccactcctaaacgggtctccaggaggcttggtttgatccactagatttggtgcctcttaaagggaagcaatacagcttttctgctgtgggttgtttgccactaggggaagattcatttctattccagccataaattagaccaaagagagggatttgggttattgcgagtgcanaagtttaaaaccatcttcctttcccgagtgggctctcaaatagat

SEQ ID NO: 3069 - DNA, 355 bp, Homo sapiens
caatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctgtaaggatggtttagaaatggaaaatgttaacaaatgtggcaattattttggatctatcacctgtcatcataactggcttctgcttgtcatccacacacaccaggccttgagacaaatgggcctgatgtcatcttgagctcttcatttattttgactgtg

SEQ ID NO: 3070 - DNA, 102 bp, Homo sapiens
agttttaagttattagtttttaaaatcagtactttttaatggaaacaacttgaccaaaaatttgtcacagaattttgagacccattaaaaaagttaaatgag

SEQ ID NO: 3071 - DNA, 354 bp, Homo sapiens
ctcgtgccgaattcggcacgagaggccatgtacaagaggaagtactcagccgctaaatccaaggttgaaaagaaaaagaaggaggtcaggttctcgcaactgttacaatcaccagttggtggtgacaggaacggcggtacccgggtggttaaccttcgcaaaatgcctagatattatcctactgaagatgtgcctcgaaagctgttgagccacggcaaaatacccttcagtcagcacgtgagatactgcgagccagcattcccccggggccattctgatcatcctcactgggcgccaccggggcacgggggtggttttctgggcggctggctgtggctcattctgtggctggcm

SEQ ID NO: 3072 - DNA, 369 bp, Homo sapiens
tcgacttcagcttactgccccagccacctcaagagaaggctcacgatgcgtggccgcatactaccgggctgatgatgccaatttggttcgtgaccgtgacctcgaggtggacaccaccctcaagagccttagccagcagatcgagaacatccggagcccagagggcagccgcaaagaaccccgaccgcatcctgcagttacctcaagcatgtgtccactcttactggaagagatggagagtactggattgaccccaaccaaggctgcaacctggatgccatcaaagtcttctgcaacatggagactggtgagacctgcgtgtaccccactcagcccaggtgtggtccagaaggaactggtacatgagac

SEQ ID NO: 3073 - DNA, 214 bp, Homo sapiens
ctttggtggggagtgtggaggattgcatgaatctccctgaagccagtccctagtgcatggtttagtattctcgttgtctagggatctgtgagggctttgatttgggggcagtacctttctttttacatccccattttatttttgtgagaacttggggagcctgaactccatccataccactgaatagagattttgagtaatgatacctgttttc

SEQ ID NO: 3074 - DNA, 250 bp, Homo sapiens
cttcagagtacttaactaagcagaataactatcattgtcaataatttaaaattatgatttatgaacatgttctacaataataaaatgtttgtagaatttgatatgccaaaatatcagaaaatattttgaaccatccattgtgctacatagcaagtatgctatttataatttttggtgaataataagcatcctgccatatacctatgttggcagttaggacctctagggtgggcccaatggtcgcttccct

SEQ ID NO: 3075 - DNA, 476 bp, Homo sapiens
  misc_feature 145: n = A,T,C or G
cttcagagtacttaactaagcagaataactatcattgtcaataatttaaaattatgatttatgaacatgttctacaataataaaatgtttgtagaatttaatatgccaaaatatcagaaaatattttaaaccatccattgtgccnacatagaaagtatgctatttataatttttgtgaataataagcatctttcatatacctatgtggcagttagaactctaggatggaccacatgatcgcttcctcctgatatacacactctgtgtaatcctatcccagtaatagtgggtggacccaggaatgtgatgaagtatcactcccatggttatgttacattgtttgtcaaaagggattttgtagacataattaaggttcataaacagttgacactgtgtgtattagtctgttttcacattgctgataaagacatacctgagactgggtaaatttatgaagaaaaagacgtttaatggac

SEQ ID NO: 3076 - DNA, 130 bp, Homo sapiens
caaggattcaaaagataatttattagtctgagaagaggagtcacatactatacccagtaatacgcttgcsttgtattcttgtgcctttatcttaaaaactatattcgaccaacaacaaaggataatattc

SEQ ID NO: 3077 - DNA, 295 bp, Homo sapiens
gggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcccagcaaggaagggaaaagttgcccattgtaaattaagattgatgagcttgtgccattcattggcccggacagacctaaggaaggattcgggacttaccaactagcctccaaagatgccaagaaacagcttactgttt

SEQ ID NO: 3078 - DNA, 190 bp, Homo sapiens
ctcgtgccgaattcggcacgagcatggttaatgttgtgcgtatgtttgtatgtttttaaaggaaacttgcattttcaatagttgatcctaaatttcatatactgcacttctttactctggtaaagctgatgttttagttgcttattgtgaattgccgtaggacctctggatatgtctacacatttattta

SEQ ID NO: 3079 - DNA, 270 bp, Homo sapiens
ctcgtgccgaattcggcacgaggggaaagtcagtattttatatagctaaaatatgaacctcaaactggaatcctctaaagggcccatagcaatgaagtagacattggtgggaacatttacacccagtcagcttgaagagtttcaaatggaccctaccactgagaaatcaagatggcagtctactatggggaaattgaaggaaaaatgggattaataacaaggagttctgtgataatatacaaccaggacagggttctcttcacatggagt

SEQ ID NO: 3080 - DNA, 190 bp, Homo sapiens
ctttggtatccatggaggattggtttcaggactccagagaataccaaaatccatggatgcccaagtctcttttataaaatagtatataatatttgcatataacctaagcatattctcatatatttaacattatctctagagttactgagaatacctaatacaatagacatagttgttatactgtgtctta

SEQ ID NO: 3081 - DNA, 504 bp, Homo sapiens
  misc_feature 121: n = A,T,C or G
ctttggtatccatggaggattggtttcaggactccagagaataccaaaatccatggatgcccaagtctcttttataaaatagtatataatatttgcatataacctaagcatattctcatanatttaaaattatctctagattacttagaatacctaatacaatagaaatagttgttatactgtgtcttaaaatttttgttttttaaattgctgtgttatttttaaaattattttccccaaatattttccgtctaccgttggttgaacctgtggatatgtaactggtgaatactgaaggctgagtgtatattacattatgactaagtggaatttatcatagagatacgtggtaggttttacatttggaaattagctagtgtagtttaagatatcagtataataaaagagaaaaatcataggattatcccagtagttggagaaaaagcatttaataacatttaacatccatcgatgataaaaacggtcagcacactaaactaaaaa

SEQ ID NO: 3082 - DNA, 310 bp, Homo sapiens
ccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttcacaggtccaacaaccgcagcgaggagtttctcattgctggaaaactgcagggtggactttggcacatcactacctacagtttcggggcttcctgggacagccttaagttagg

SEQ ID NO: 3083 - DNA, 238 bp, Homo sapiens
cagcagcaagcattatacggtcatcttgaatgatccctttgaaattttttttttgtttgtttgtttaaatcaagcctgaggctggtgaacagtagctacacacccatattgtgtgttctgtgaatgctagctttcttgaatttggatattggttattttttatagagtgtaaaccaagttttatattctgcaatgcgaacaggtacctatctgtttctaaataaaactgtttacattc

SEQ ID NO: 3084 - DNA, 189 bp, Homo sapiens
aattcctcaccctcacccttccaccgttgttagtatcatggtgtttttgtttttgtttttgttttaagaacctgcagtttgactcttcatcgttcatctaggggaagacatctgatgttgtttccctatggaaatatatatctattatatatatattccccgcaaatctcacaaggtgcggcagcccag

SEQ ID NO: 3085 - DNA, 221 bp, Homo sapiens
ggtctggccaccaaccagcccttcttctgggaagcacaggccccggtgagcaccgtggagcagctggaccagcgctacctgctggtgcctgagaaggtcaaggacgcctacctggtccacctgatccagcgcgttccaggatgagcacgaggactggtccattatcatcttcaccaacacgtgcaagacctgccagattctgtgcatgaatgctgcggaaa

SEQ ID NO: 3086 - DNA, 246 bp, Homo sapiens
ctcgtgccgcagcactttgggaggccgaggcgggcggatcacgaggtcaggagttcgagaccacggtgaaaccctgtctctactaaaaaatacaaaaaattagccgggcgttgtggcgggcgcctttagtcccagctactcggagaggcttaaggcaggagaatggcgttaaccccggaggtggagctttcaggttagccgaggtcgagccacttcagcctgggtaacaaagccggactccctctc

SEQ ID NO: 3087 - DNA, 220 bp, Homo sapiens
ccacttactaatataactaccttgttttaaagaaaggaaaagcagaattgacatttagcaactactctgtgacagttaccatgctaggtgactcaaataacttagtgcttatatcagccctttgctgtagggaggatcttcattttacagatgaggaagtgagtttcattgcttatgtaacttacccaaggcacacacaggtaggttggaggcaggattc

SEQ ID NO: 3088 - DNA, 520 bp, Homo sapiens
accacttactaatataactaccttgttttaaagaaaggaaaagcagaattgacatttagcaactactctgtgacagttaccatgctaggtgactcaaataacttagtgcttatatcagccctttgctgtaggtagtatcttcattttacagatgaagaaagtgagtgtcattgcttatgtaacttacccaaggtcacacaacaggtaagtattgaagccaggattcaaacatacatctgaatgatgccacacaccccccacccctgactgtatcatactacttcatgtggacctgatccagtataataacttctgcattcctgtaatttctattttttctgctttttgtacacctttaaagaacaaccaatcagaaaaagattttggaaaatcctttgaaaatacatagtttttagatataatgattttgtaagttgaatgctcattttaaatttaactcgagtaatcttcaaaaatgcactgtgattgtgccagcatgtagatgtgctaatgcatagac

SEQ ID NO: 3089 - DNA, 135 bp, Homo sapiens
tgatgtgtcctcggtaggctaagaggaccttggaatttcctgggcagggaagagttgagccaatctttttttgagttcctcctaggttccaagtactgggaggggcgctcagcatcgctgattctgttatttcta

SEQ ID NO: 3090 - DNA, 260 bp, Homo sapiens
gtgaccacacatttgagggaagacgtggcgttaggtgaagcagaagcaaaccctgctcttaggggctcacctaggtgagtgcacagcctgtgacgctacagggagaggctgagtaaaccgagatccagcgttctgtatggcaggggtattgcttatcacagaggttctagagtagggaggtacataatgagagggctttaaaattgccaccaagtagtaccagggctgcagtggtattacgagactatcctagctatagg

SEQ ID NO: 3091 - DNA, 340 bp, Homo sapiens
gactctgcactgaatggctgacctgacctgatgtccattcatcccaccctctcacagttcggacttttctccctctctttctaagagacctgaactgggcagactgcaaaataaaatctcggtgttctatttatttattgtcttcctgtaagaccttcgggtcaaggcagaggcaggaaactaactggtgtgagtcaaatgcccctgagtacttcccccagcccaggccagaggacctccttaaggtgccgggcgcaggacctgtgtgtgtcctaacaatggtgctatctgtgtaaaacacttgtattttttaaaccatcattggtattagagtgggagg

SEQ ID NO: 3092 - DNA, 175 bp, Homo sapiens
aaagaaaagaataaataaaagaatgaatccctagtctttcctagaataaactttcattcagtaatgaggttgctgcatggctcttggcatgtacaaagataaagtgataaagagaaaaataaacacttgttgtacttaagcataggaaagtgatcaaatgagataattgcacatg

SEQ ID NO: 3093 - DNA, 74 bp, Homo sapiens
taaagaaaagaataaataaaagaatgaatccctagtctttcctagaataaactttcattcagtaatgaggttgc

SEQ ID NO: 3094 - DNA, 125 bp, Homo sapiens
gtaactgatgttattcgtcttgtatggcttttagtatgtttatcaagtggctaacaaatgcattctgaaaatgtatttaacatagctgttttaacaaatgaaaaagagcggagaaaaatgtttag

SEQ ID NO: 3095 - DNA, 250 bp, Homo sapiens
aaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttgagagtgaggcaatgtttttaaggaaaacaagtcatgtagggtgtctaaaaataaaatgcatttacactcaattgagagaagtccctaaggttacgcacat

SEQ ID NO: 3096 - DNA, 210 bp, Homo sapiens
gccgcgttcgcaccaaaaccgtgaagaaggcggcccgggtcatcatagaaaagtactacacgcgcctgggcaacgacttccacacgaacaagcgcgttccaggagatcgccattatccccagcaaaaagctccgcaacaagatagcaggttatgtcacgcatctatgaagcaattcagaaggcccagtaagagtatctccatcaagctca

SEQ ID NO: 3097 - DNA, 250 bp, Homo sapiens
ggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttgtttgctttagtttatattttctcagtagtttgttattgctggtattatacggacggaga

SEQ ID NO: 3098 - DNA, 215 bp, Homo sapiens
caaggttcggctttttcagctgatatgtctggtgatgcagtgttgctgaagcagtggataatgtgcttttcatgtgtcttgtcgctcatattaacaaagcttcctaggccctatgctatagttagatggtgccagttttttagtatagataccataatgcaacttgatgcttggtcagcctgataagagtgctattgagtctaagctttctggtg

SEQ ID NO: 3099 - DNA, 191 bp, Homo sapiens
ctacattgacaagaaatgccccttcactggtaatgtgtccattcgagggcggatcctctctggcgtggtgaccaagatgaagatgcagaggaccaatgtcaaccgccgagactatctgtcactacaaccgcaagtacaaccgcttcgagagcgccacaagaacatgtctgtacaactgttcccctgcttca

SEQ ID NO: 3100 - DNA, 146 bp, Homo sapiens
gattaagacactatgtcactttagtagttctttcaataaagccagaagggattaaaacctagagcttttttaatcattgcccatgacattagtaatagacttccaatcctacccctatcacaatgatttctttcacagaaatgtgt

SEQ ID NO: 3101 - DNA, 447 bp, Homo sapiens
gattaagacactatgtcactttagtagttctttcaataaagccagaagggattaaaactagagcttttttaatcattgcccatgacattagtaatagacttccaatcctaccctatcacaatgaattctttcacagaaaaatttcccatactgctttcagcaatctaagtgagctggtcagcacttaggacaactgacagattctattataaaaattaatacacatttttcttagtagcagaagaaaaggaaactgatttccattttataaaacctaattgatcaaacatagctatattttgaacataaaacagcttctcgtttcaggtctactggttttaacaatagctataaagctgtgtgactttgaaatggtgtttatggtattttgaatatgctgcttgctttaaacatgtcctgtgataaaatgcgtaaataatccagtga

SEQ ID NO: 3102 - DNA, 120 bp, Homo sapiens
ctgatatttatggaaaagtactttcaagtacaaggtcaatacataagccagagtgaatgatactacaagttgagcatctctaattcaaaaatctgagatccagaggctcaaaatcttgaa

SEQ ID NO: 3103 - DNA, 234 bp, Homo sapiens
gcgagctggacgccactgtggggctctgagagtcctgaattcttactgggttggtgaagattccacatacaaattttttgaggttatcctcattgatccattccataaagctatcagaagaaatcctgacaccagtggatcaccaaaccagttcacaagcacagggagatgcgatgggctgacatcttcaggccgaaaggagcgttggcctttggaaggggcccaagttccccc

SEQ ID NO: 3104 - DNA, 234 bp, Homo sapiens
gaaagatcaaaatatatttgtccagaaactcttgggccagttctctgagaaggaactggctgctgaaaagaaacgcatcctgcactgcctggggcttgcagaagaaatccagaaatattgctgttcaaggaagtaagaggaggaggtgatgtagcacttcccaagattggcaccagacatttgagatcttctcaagagagacagaccagtgatctctattcctagaaaactaaa

SEQ ID NO: 3105 - DNA, 145 bp, Homo sapiens
tcttgcctccccaccccggaagctgaacctgagggagacaacggcagagggagttagcaggggagaaatagcagaggggcttggagggtcacataggtagatggtaaagagaatcaggagaaaaggagaaaagggaaaccagaaa

SEQ ID NO: 3106 - DNA, 257 bp, Homo sapiens
gccattaccaagcaaaactctttcactggaaacaagggggcagtctagaagtaaaagtgaccttaagaagactctttacaggcaacaaatgaagcttttctaagggatttttgcatcagttcagtcataagaatacttttttccagggtaattaggcaatagcttcactgaaaatgacagcttttcattgcattatttaatccttatatttggagttgaagtcgttaacttcttttaaagaatgtactattagaaaa

SEQ ID NO: 3107 - DNA, 110 bp, Homo sapiens
ggttggggcgtccgcatctaggcaggaagattgtgccgcaaagaagacgaaaaagttgcatgagatgaataacatgtggcatcaacactgataataaaagaaggaagatc

SEQ ID NO: 3108 - DNA, 480 bp, Homo sapiens
ggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccaagaacagactggtgaaaagtaaaccttttcacctacaaaatttcacctgcaaaccttaaacctgcaaaattttcctttaataaaatttgcttgttttaaaaacaaaaaaaaaaaaaaaaa

SEQ ID NO: 3109 - DNA, 285 bp, Homo sapiens
aaagaacactcgtggcagtagaacggcctctggatgacatcattgctcagctcccaccacccattaaaaaggaggaatttggaacctaaacagggcactgtctgtgtccttccttgaactgtctaccctgttggctttttacaaatcatggtaataaaacaggttattcttgaggactagtcattataaatgttttctcccaaattatggacagtcatttccttcattgattgaattgattggaattccactggggtatttgtattggggatatgtgctcagtag

SEQ ID NO: 3110 - DNA, 265 bp, Homo sapiens
ctgctgtagtactaaagtgtacttaatgttactaagcttaatgcctggccattttccatttatatatatttgtgaggaggctagagtgcttttagccttttttaaaaactccatttatattacatttgtaaccatgatactttaatcagaggcttagccttgaaattgtgaactcttggaattgttatagtgaggtcgcactaactaacctgtaaattatgatgattgtatcaacgattagtgaaattacccattctgtcccctg

SEQ ID NO: 3111 - DNA, 415 bp, Homo sapiens
ttgattccttctatttgcacaagtcaccttggactgcagggagctgttttgcaaaagcagtttagtaggcttagatctcaaattcatcttgagaacatttttttgaggtagtaatttcctcagaaggctctttgtgttttgttttgggttttttttctgagctactcggacttccttattaggacattcaatcattttcctttgggcctccaatttttggcttttctgcagcaccttgtgtggtgagattatatgtgtgtgtgtaacacagggcgtgcgtgtgtatgtcgcgccagggccaggttgtgggttgtgtgtgtgtgggtaacctcagctgttctctcttatgtgtgtgagctctctctctgcgttcccgggtgcgcatgcctgctgataggcttgctgcttacgcggc

SEQ ID NO: 3112 - DNA, 199 bp, Homo sapiens
ctcgtatccccaagattcagaagcttctccaagacttcttcaatggaaaagaactgaataagagcatcaaccctgatgaagctgttgcttatggtgcagctgtccaggcagccatcttgtctggagacaagtcttagaattgtccaagatttcctcctctgggatgtaactcctctctccttgggaatgaacctcctgg

SEQ ID NO: 3113 - DNA, 369 bp, Homo sapiens
ccatcatgggtcgcatgcatgctcccgggaagggcctgtcccagtcggctttaccctatcgacggagcgtccccacttggttgaggttgacatctgaggacgtgaaggagcagatttacaaactggccaaggagggccttactccttcacagatcggtgtaatcctgagagattcacatggtgtcgcacaggtacgttttgtgacaggcattatattttgagatttctaggtctaggggtctcgctcctgatctccctgagatctctaccatttattgagaagcagttgctgttcgaaggcatcttgagagcacacagggataggatgctaaattccgtctgattctatagagagccggattcaccgtt

SEQ ID NO: 3114 - DNA, 229 bp, Homo sapiens
gatgaccacgtcttaacccccaaatctaccatcaaataaattggacgtgataaacatgcatgtgagattcttaaattcggatgccattctcagcctatcttatgcctgcttggtgcaagaaacatgagtcttagggtcaagtgaacaggggctggaatcctggctctccccttatttacttacaggtctggtccaagtcactccccctctttgtctcagcctctcaatt

SEQ ID NO: 3115 - DNA, 337 bp, Homo sapiens
cgccgccggaggttactggaactgcagaaatccaagcggctggattatgtgaaccatgccagaagactggctgaaggatgactggacagggatggagagttaggaagaaaataagaaagatgatgaggaaatggacattgacactgtcaggagttaccaaaccactatgctaatcaattgatgctttctgagtggttaattgacgtccttcagatttggggcaggatggattgtggtcgtgtccctgtggaaaaagacccttatcgtggctcaggggttctaccagtcctacacaagagtcgctactgtgtcacaggttttcttcacttctgcgagg

SEQ ID NO: 3116 - DNA, 229 bp, Homo sapiens
tccaccttactaccagacaaccttagccaaaccatttacccaaataaagtataggcgatagaaattgaaacctggcgcaatagatatagtaccgcaagggaaagatgaaaatttataaccaggcataatatagcaaggactaacccctatacctcctgcataatgatttaactagaaatactttccaaggagagccaagctaagcccccgaaccagacgactcctagag

SEQ ID NO: 3117 - DNA, 317 bp, Homo sapiens
agatcgccatcatgacgacaccgtaactatccgcactagaaagttcatgaccaaccgactacttcagaggaaacaaatggtcattgatgtccttcaccccgggaaggcgacagtgcctaagacagaaattcggggaaaactagccaaattgtacagaccacaccggatgtcatctttgtttttggattcagacctcattttggtggtggccagacaactgtcttggcatgatttatgatccctggattatgcaaggaaaatgacccaacatggcttccagacatggcctttttagagaaagccctcaggaggcacga

SEQ ID NO: 3118 - DNA, 255 bp, Homo sapiens
aagagatcacctgtcacccagaagcgtattctctcctgggtgtaatttggggcaacagggacagggcaccagagggagatgttatagtgcggagttcttgctaacatctttctgacaatagcatctgatttgcctattgctaaattcaatcctctccttataggtggttaattaaatataaactaagatgcctgttggaccatacccattatgcataagaaacaatccgcattcaatggatttaaacgctgtatt

SEQ ID NO: 3119 - DNA, 579 bp, Homo sapiens
aaagagatcacctgtcacccagaagcgattctctcctggtgtaatttgggcaacaggacaggccaccagaggagatgttatagtgcggagttcttgctaacatctttctgacaatagcatctgatttgcctatgcctaaattcaatcctcctcttataggtagttaattaaattataaactaaaatgcttgtggaccagtacctattattgcataagaaacatccccgaattcaatggattaaaacgatgtattatcatgtctcatagttggacttgtttaagctcatctgggtggtcctcacttggggtcattcatgaagtcgtagtcagactgctgctgggcctggagtcatctaaagacttccggtcttagtctatttgtgttgctgtacaagaatacctgaggctgagtaatttgtaaagaataaaggtttagccgggcgctgtggcttacgcctgtatccccagcactttgggaggctgaggtagccagatcacaaggtcaagagttcgagaccagcctgggcaacatggtgaaaccccgtctctactaaaaatgcaaaatttagccaggcgtg

SEQ ID NO: 3120 - DNA, 115 bp, Homo sapiens
ctttagtggttggaattttgtaattcttcgggagagacgctattgaaaggccagactagcattgtgcagaccatatttggtctgtggacatgtttactttgactacattaaaaaa

SEQ ID NO: 3121 - DNA, 125 bp, Homo sapiens
ctttagtggttggaattttgtaattcttcgggagagacgctattgaaaggccagactagcattgtgcagaccatatttggtctgtggacatgtttactttgactacattaaaaaaaaaaaaaaaa

SEQ ID NO: 3122 - DNA, 215 bp, Homo sapiens
gtcaaccttgtggagccatcgcgagttagagggtgaaagatggcagaaaaaaaagtcttgtgtgttaagttttttttttgagtttgcatcaatcttaatgtctcttcataatacttttatattacattgaggcctcttgtctacatatttggagagaatatgactttactaggcagagaaatacaatatatctgtctactggactttaaatattt

SEQ ID NO: 3123 - DNA, 190 bp, Homo sapiens
cctggggtgggagttttctagttactagaccatctccatttttagcacttggcagcctcatgatccttttataatgtgagattaacaggagagcagcaatacgattttgccaatggaataacagatttgccggcattcacttaaagaggcagattattgggtccttgttacttcaacttacttttccaat

SEQ ID NO: 3124 - DNA, 240 bp, Homo sapiens
ctcatcccaggtattgttgtgggtgggcagaagtctgtttgcttcatggttttctgacctttgcctctcccctcaggaaatcctgacttttaacccacacagcgaatctctcctttcgagctctgccagcactcttatctacataaggatgaggtaatccggagtagcaatggagtgctgccatggaaggaggaaagctgccatttcccttcttggcacttaaggcaatctttgccttat

SEQ ID NO: 3125 - DNA, 155 bp, Homo sapiens
gtgtgcttcttaggggctctagggactgcaggctcctttagtaggcaggtaaataagagtagatgtagaaagttgtaaaatagacaaagtggagttgtgaatgcttctcctttgttacatttgatgattgttatagcctttaggatgtttttcct

SEQ ID NO: 3126 - DNA, 315 bp, Homo sapiens
ggcagccatcaggtaagccaagatgggtgcatacaagtacatccaggagctatggagaaagaagcagtctgatgtcatgcgctttcttctgagggtccgctgctggcagtaccgccagctctctgctctccacagggctcccgcccacccggcctgataaagcgcgccgactgggctacaaggccaagcaaggttacgttatatataggattcgtgttcgccgtggtggccgaaaacgccagttcctaagggtgccacttacggcaaggcctgtgcatcatggtgttaaccagctaaagtttgctcgcaggcctt

SEQ ID NO: 3127 - DNA, 330 bp, Homo sapiens
gaggagacagtctcgagtgcaatgtagtggaatggaatgctgtggaatggaatggagtggagtggaatggaatggaatggaatggaatggaatggaatggagtggaatggagaggagtggagttgagttgaattgaatctaatggactataaacggttgcaatgattggaatggagtggagtggaatgactcaaatggaatggactggaaaagaatggactcgaattgaatggagtcgaatgatgaatcaaaaggaatggagtcaaatgcaatgcacaggtgggattggatcgctcgctccgagattcgcacgaggggcctacacgccgc

SEQ ID NO: 3128 - DNA, 105 bp, Homo sapiens
caaaggaggaagtaaggcgaattctggggctgctggatgcttacttgaagacgaggacttttctggtgggcgaacgagtaacattggctgacatcacagttgtct

SEQ ID NO: 3129 - DNA, 147 bp, Homo sapiens
ccggccgcggcttcagcctggaggagctcaggggtggcccggcattcacaggaagggtggcccggaccatcggcatttctgtggatccgaggaggcggaacaagtccacggagtccctgcaaggccaacgttcagcgccttaaggag

SEQ ID NO: 3130 - DNA, 167 bp, Homo sapiens
cgcacacgagaacaatgcctctcgcaaaggatctccttcatctcctcttccagaaagaggagaagagggaaacaacaagaagaaaccgccttggtgcagagcccccaatttcctactttcatggatgttaaattgccccaggattgctataaaattcaccacggtct

SEQ ID NO: 3131 - DNA, 107 bp, Homo sapiens
ttaatgcaaggtcatttatatttgttaagaggaataatcaagatcactcatatccacctgaatcttgaggtttataaatccctcaaccggttccttgagccttgatt

SEQ ID NO: 3132 - DNA, 122 bp, Homo sapiens
ataatagctcttttggtttaaggcatctccagacatggtcctcctggtaggaaccaggtattagttagcttattgaggccaaaattggattgggaccctgggcctccacctttccattccat

SEQ ID NO: 3133 - DNA, 543 bp, Homo sapiens
caaaaatcctgtccatccattaccctgatgtgaagcctgtttatatagctctttttggtttaaggcatctccagacatggtcctctggtaggaaacaggtatgagtagactaatgaaggacaaaatgggatgagggacctggagcctccacccttgcattccaataccacccttaccccacaaaaggagggtattgacccacacagtagtgctgacctgtggccagggctggggaggtccaatttctaatctgtgctttgtcccatctccactgttccccacccctaggttttcgtaacaccccaaggcctgtaaggtttggtgtttccctttcaagatgccactttcagactttattctggctctgaaggacaatccctactttggggctggatttgggctggtgggtgtgggcacagccctgggcctggcccggaagggtgtccaactgggcctggtggcattccggcgccattacatgatcacactgggaagtccctgctcgagacaggagctatgcctggtttgcttagctggctcacc

SEQ ID NO: 3134 - DNA, 120 bp, Homo sapiens
tgcgctatctggcatcctaaccggcgttagaagtacattgcctcctcagggaagggctggcaacgcgaccatcaaaagtagcaaggaggtgacgcatgaagtccaaggttagggtctcac

SEQ ID NO: 3135 - DNA, 550 bp, Homo sapiens
agaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgagggaaatt

SEQ ID NO: 3136 - DNA, 107 bp, Homo sapiens
gacaagcgcgattctgacatactctgcgttcgtttctcgacaagatggccctgtaaccgttggccacacctccttatagctgggtgcataccatcagtcgcggaccg

SEQ ID NO: 3137 - DNA, 525 bp, Homo sapiens
gtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtac

SEQ ID NO: 3138 - DNA, 270 bp, Homo sapiens
gttcaagcctcccatgatcaaattcacaaccaagatctaccaccccaacgtggacgagaacggacagatttgcctgcccatcatcagcagttgtaactggaagccttgcaccaagacttgccaagtcctggaggccctcaatgtgctggtgaatagaccgaatattagggagccccttcggattgaccttgctgaccttctgacacagaattcggagctgttcagaaagaattccgaagagttcaccttcgattcggagttgaccggccc

SEQ ID NO: 3139 - DNA, 155 bp, Homo sapiens
aattagaaatgcacgtttacagcaagaggttggagatcatgctccaggacatatttggagaagactgtgtaagtataaagggtggactctattcttagcgtcacagtggaccgggaaaactgccaaccttaacctttgaggacacggcctgtgga

SEQ ID NO: 3140 - DNA, 285 bp, Homo sapiens
gctcagcggcggccgcggcgcgtgcgtctgtgcctctgcgcgggtctcctggtccttctgccatcatgccgatgttcatcgtaaacaccaacgtgccccgcgcctccgtgccggacgggttcctcttccgagctcacccagcagctgtgcgcaggccaccggcaagcccccccaagtacatcgcggtgcacgtggtcccggaccagctcatggccttcggcggctccagcgagccgtgcgcgctctgcagcctgcacagcatcggcaagatcggcggcgcgcaga

SEQ ID NO: 3141 - DNA, 315 bp, Homo sapiens
tgcctctcccgtgagtctccagcctgcccagcaccagcagctgtggagcacgtggatgctgcctaccccggcgcccgcgtcttccacgggcacaggtgttggaggccgtggtcggaccctggtgtcctggttactgctgcccgggtgtctttttttttgagtaactgctctctgagttttgacacgaagttgccctcatctgtctggagatcgataaggaaggcacaagacgttcttctctgccccgtgaggagcttccccgcagccgcttggcccagactggggcacgttctgcgagggatgtgtctctctcgc

SEQ ID NO: 3142 - DNA, 255 bp, Homo sapiens
caacatggtgttcaggcgcttcgtggaggttggccgggtggcctatgtctcctttggacctcatgccggaaaattggtcgcgattgtagatgttattgatcagaacagggctttggtcgatggaccttgcactcaagttaggagacaggccatgctttcaagttcattcagctcacttatttcatcctcaagtttccgcacagttcccaccagaagtgtttctccacaaggcttgcagaagtcagacatctattc

SEQ ID NO: 3143 - DNA, 166 bp, Homo sapiens
aaaaagggagccaagaagaaagtggttgatccattttctaagaaagattggtatgatgtaaaagcaccttctatgttcaatataagaatattggatagacgttcgtcaccagggcccaaggagcccaaagttgcatcttattggtctcaaggttcgtctcgtttaa

SEQ ID NO: 3144 - DNA, 180 bp, Homo sapiens
ctcgtgccgaattcggcacgagatgccacactcaagtccctcaacaaccagattgagagcatccgcagccccgagggctcccgcaagtaccctgctctgcaccttcagagacctgtaaactcttccacccttgagtggagagagttggagacttcttggatttaccccaaacaaaggctg

SEQ ID NO: 3145 - DNA, 100 bp, Homo sapiens
ccttagcctcccaggttataagctccctgcaggctcctcctctccagagccaggatggagaggcactgggctttcccaaagcaggcttggattgtcccac

SEQ ID NO: 3146 - DNA, 132 bp, Homo sapiens
tcatccgccgagactatcttcactacatccgcaagtacaaccgcttcgagaagcggccacaagaacatgtctgtacacctgtccccctgcttcagggacgtccagatcggtgacatcgtcaaagtaggcgag

SEQ ID NO: 3147 - DNA, 117 bp, Homo sapiens
gtttcatcatgtgggtgttattcataacagacactgtgtggtctagaagtgtaaggcaggtctatgaagtccatgattccagatgattgggcctattcatgacttccgagtgtccca

SEQ ID NO: 3148 - DNA, 322 bp, Homo sapiens
aataaatatgcctgggaagagactgggaaggttctagggtgaggcacctcagtaactcatggtaccttggccaagttggaaggaagcagtttgttaatgaggcacagtaatcctggctgcagggtctaggaggtaagaccagctgggatgaccttccctgggttaatcaatttccctctagacaacacaaactgcaggcatgtgactaactttgaaagaccacccatcatgtggctgctgtcacccttgaccagctgtggtggtggttactccatctgtggttggagcgcctctttggattcacttcaaggtcttgtgccta

SEQ ID NO: 3149 - DNA, 320 bp, Homo sapiens
accagtcagtggcctggcaggacgcagccacgggcagctacgacaaggccctccgcttcctgggctccaacgacgaggagatgtcctatgacaacaacccctacatccgcgccctggtggacggctgtctaccaagaaaggctaccagaagacggttctggagatcgacaccccaaagtggagcaggtacccatcgtggacatcatgttcaatgacttcggttaagcgtcacagaaatttggatttgaagttgggccggcttgcttcatgggctaggagccgccgagcccggctcccgagacaacctgttgacctaagca

SEQ ID NO: 3150 - DNA, 168 bp, Homo sapiens
aggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaagtcatac

SEQ ID NO: 3151 - DNA, 310 bp, Homo sapiens
cggcacgagggatattaaggccctggtgtcttacagaaaccatcacgtatgtcgcagcagcatttcacccctgaagtctctaaactctgagcctgaaaagatttgtatttaatacacataacattttttagttcattctgcctttcctatttgttccagtttttgcttggttttagtttggaggggacttaagtacacagatccttatctctccccatcccctagcctcacaaaacacagttgagagcttttaaggacctcagctctcgaaggtacccagaacttaactagacttccctaccttagactg

SEQ ID NO: 3152 - DNA, 230 bp, Homo sapiens
gaaaagagagaatctagaacatcttgcagttgaaatacaaattttattcttttggtcttgggagaatttaagcagtctatgcaactcatcaaatggtgagaaatagccctccgaggttccagtaagctttcagtgactttgatacctccccaaggttcttgagttctgcttgttaacacccagcttttaacttagtgtttgctcctgatgggttaggggattttcatgtt

SEQ ID NO: 3153 - DNA, 230 bp, Homo sapiens
  misc_feature 73: n = A,T,C or G
gtcatgaaggagcgggggtttggcaggcgggtgacgtccaggagagggagcgccccttgctgcccctcggccnccgacttgacgcgcgggccttgccagcaagcgaccctcatcgggctgtcgcctgacaacatacctcaaaaggccctagctaataaaccctgtaagcccagcatttgagaaaaggtagggtgtgtatatataaaaggttgtgtacaactccacgaggt

SEQ ID NO: 3154 - DNA, 260 bp, Homo sapiens
agaaatctctctataaaatgaataaaatgtttaagaaaagagaaagagaaaggaattaattcagttaaggatgattttgctcctagttttggagtttgaatttctgccaggattgaattattttgaaatctcctgtctttttaaactttttcaaaataggtctctaagggaaaccagcagaacattagcctgtgcaaaaccatctgtttggggagcacactcttccattatgcttggcacatagatctcctgtgggggga

SEQ ID NO: 3155 - DNA, 310 bp, Homo sapiens
ggaaaatggtgaagaaaattgaaatcagccagcacgccaagtacacttgctctttctgtggcaaaaccaagatgaagagacgagctgtggggatctggcactgtggttcctgcatgaagacagtggcttgcggtgctggacgtacaataccacttccgctgtcacggtaaagtccgccatcagaagacttaaggagttgaaagaccagtagacgctcctctactctttgagacatcactggcctataataaatgggttaatttatgtaacaaaaaaaagtacttcttgggcggccggggccatcgatttt

SEQ ID NO: 3156 - DNA, 310 bp, Homo sapiens
cccacgtattttcttttttgtcagtattgtttgggaaggagacatgccgggatgtgtcatcgtgccaaataccacatttcctgttggcacagtttcacagaagtaaacataagcatgttttaacaggtttttcttttcttttttcttttttaaaatgttttatttatttaacccgccattgtgtgtttttaagtattttctttttttaaggaaaggaaaagcttgtcacaatctaactggctatggtgattattattaaatttatgttttgcaccttaggaaccagctacagtattggccacttaataaa

SEQ ID NO: 3157 - DNA, 310 bp, Homo sapiens
aggtcgacactagtggatccaaagaattcggcacgaggtctcgagtttttttgtttttttttttacaaattgaaggtttktggcaaccttbcctmaagcamatytwttggksccatttttccaacagcatgtsctcactttgtgtctctgtgtcacataatattcaataattttgcaatatttaaatttgttcatcattattatatctggtatagtgctttgtgatcaatgatctttgatgttactatggtaattgttttggggksctgatatggtttggctgtgtcccccccaaatctmaacttggact

SEQ ID NO: 3158 - DNA, 295 bp, Homo sapiens
gcagcgcggaggccgcacgatgcctggagttactgtaaaagacgtgaaccagcaggagttcgtcagagctctggcagccttcctcaaaaagtccgggaagctgaaagtccccgaatggttggataccgtcaagctggccaagcacaaagagcttgctccctacgatgagaactggttctacacgcgagctgcttccacagcgcggcacctgtacctccggggtggcgctggggttggctccatgaccaagatctattgggggccgtcagaaaaccggcgttatgcccagccactt

SEQ ID NO: 3159 - DNA, 347 bp, Homo sapiens
cgcagtgaagtggacatgttgaaaattaggtctaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtcccgtggccatcctgtgaggtgacgttagcattaccccaacctcattttagttgcctaagcattgcctggcttcctgtctaggctctctgtagccaaagaattgacattcaaggggttggagtaa

SEQ ID NO: 3160 - DNA, 320 bp, Homo sapiens
catggctgcgtccagtaccaagagttggtgggagacgggtgaagtacaggctcagtctgcggccaagactccatcctgcaagatattgtggctggagacatgagcaagaaaagcctcttggagcagaagggaggctccaagacctcatcaacaattaagactctttggcagttgcactgggtactggctgagttctggaaaccaggaatgtgagcagagtgctgcagatctccttgtcaggagcacctaagaactggcatgactctacacctctctccttctgcaatgacctcgtgtcagatggcagactccagagatga

SEQ ID NO: 3161 - DNA, 325 bp, Homo sapiens
gcctggtggaacgtcctgggcttggatgtggcaccggagccttgactggattctgttccactactgggcttcctgggcatctaccttggacctagcgtggagtctcacgttcaagttgtcttgcctgaagaagacagctagtgggcctgccttgggtctctgttgaacaattaaaggagcaccgagatcccctctgttgaataattaaagaagggagagagagaccctcgctgcaggacgccttgcattgtaacctcttggaagcataagccctgctcgctataaatgagaatgtcacttccacatctctctgagcatattggtc

SEQ ID NO: 3162 - DNA, 562 bp, Homo sapiens
gcctggtggaacgtcctgggcttggatgtggcaccggagccttgactggattctgttccactactgggcttcctgggcatctaccttggacctagcgtggagtctcacgttcaagttgtcttgcctgaagaagacagctagtgggcctgccttgggtctctgttgaacaattaaaggagcaccgagatcccctctgttgaataattaaagaagggagagagagacccctgctgcaggacgccttgcattgtaacctctgggaagcataagccctgctcgctataaatgagaatgtcacttccacatctcctctgagcatattggtccagaaaactacctcccacattaattttcatatggctatcagacatgggagatttatcagagagaaggaaaagtgtaaggatcaaacacgtgagtttgggagaatacaggaactaatactaatgcaaaattagaacgggatttagggaaattcagtgcagcagcacagagtactacaaaataaaagaagctttgttcctctcgaaggtaatctgtgtgttggttccctaattttaaa

SEQ ID NO: 3163 - DNA, 323 bp, Homo sapiens
gtgatatgagacagacagttgcggtgggtgtcatcaaagcagtggacaagaaggctgctggagctggcaaggtcaccaagtctgccagaaagctcagaaggctaaatgaatattatccctaatacctgccaccccactcttaatcagtggtggagacggtctcagactgtttgtttcattggccatttagtttagtagtaaagactggttaatgatacaatgcatcgtaaaccttcagagggaaggagatgtttgtgacactttgtttctttttgcgtgtgcagtttaggtatagttttaaatcagtacttttatggaacact

SEQ ID NO: 3164 - DNA, 104 bp, Homo sapiens
tgaaacagttgtgctgacttgagtggcatgaaggggttgttcaaggcaatgacatagaagggggactgttttcaggaatcacctcagtgatagatttaacatcc

SEQ ID NO: 3165 - DNA, 143 bp, Homo sapiens
ctcacacgttggctttggacaaccaggccccaacttggtcccttgccctagggaccttccagcctggtgcccagtgctcaggccacctcctggtccagtcaccacctgcagcctcggcagggcaggtacaggggccacctcgg

SEQ ID NO: 3166 - DNA, 139 bp, Homo sapiens
cttgaggaccaatgactgaggtctatgccagttcctgatcccatctcactctctggacctaccaggtgactgctgctgggtgacttccctgaggcggctatacccttaagccagccccactacttccttccctgccttc

SEQ ID NO: 3167 - DNA, 186 bp, Homo sapiens
gagaattgggtttgatgagcaactagcctgtcttccactttagttatttaaaagaacacctgtgtgagagtacctggtcagatcaggaagattatttttagattgagagaattgatactgcagattggcctgacccatgatattggtgaccacaacccaactttaatctctgtcattagtcacttt

SEQ ID NO: 3168 - DNA, 203 bp, Homo sapiens
gagaattgggtttgatgagcaactagcctgtcttccactttagttatttaaaagaacacctgtgtgagagtacctggtcagatcaggaagattatttttagattgagagaattgatactgcagattggcctgacccatgatattggtgaccacaaacccaactttaatctctgtcattagtcactttcttttttttttttttt

SEQ ID NO: 3169 - DNA, 110 bp, Homo sapiens
ctcgtccaatttcggcacggggccacgggatgatcatgagttcatccaacaccagccatttccaccatgccatcgaggaaaaggttaattaaattatttatcccattttt

SEQ ID NO: 3170 - DNA, 622 bp, Homo sapiens
ctcgtgccgaattcggcacgagcggcacgagatgaatctgagttcatacaacaccagccatctccaccatgccatcgaagaaaaaagttaaataaaataattaatccaatattctgccttaggaaactagaaaaagaagagcaaattaaatccaaataagcagaataaaataaatgaaaattatagcagaaatcaatgaaactggaagcagaaaaccaatagagaaaaataacacgaccaaaatctagtttaaaaaaaatcaatatagttgataaacctctagccaggcttactaagaaaaagagaagacacaattactaatatcagaagtgaaagagaagcatcactacagatcccatggacactaaaagaataataaaggaatattattaataactctatgtccacacatttgataacctacttaaagacacaatctgccaaaattaacacaaaaagaaatcaatacttttaataaacatatattgatttaaaaaattgggttaataactaataaacttccaaaacagaaatcaccagactcacatggattcattagtgaattcatcaaacatttagggagaaattatacaatcctatacaatctgttccagaagacaga

SEQ ID NO: 3171 - DNA, 130 bp, Homo sapiens
atcacttcgtcatatgtaaggagatgctagttttggcagccatgaaagttacacatacacaccacatacaggcagccttacctttacatacgtgcacacacacatccattttcatccacattcatccaca

SEQ ID NO: 3172 - DNA, 370 bp, Homo sapiens
aatcacttcgtcataatgttaagggagatgctagtgtgtggcagccatgaaaagttacacatacacacccacatacagacagacctacctatacatacgtgcacacacacatacatattcatacacaattcatacacatgcaatcatacatgcacactgactctgaactgggtgaactctgtggagggaggcccagaatgggtgctttcaccaagaatttgtctgtgtacaactctagatggagtgggccagcagtagctgccagtctttctcccctgcagcttcctctgcttctggaatgaaccatgtatcctggagaccctcccaatggatgagagtggaaagacatcagtacaactggccttggttc

SEQ ID NO: 3173 - DNA, 105 bp, Homo sapiens
cgagtttgacctctggtgtcctgagttaccagtgtgatttgtaagttttcacgtcatgcttgccactatagtgacagactccagcatgcatcacgtggatgccag

SEQ ID NO: 3174 - DNA, 504 bp, Homo sapiens
gaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttgggatgtgaccgtctgtccttcaggagaggacacca

SEQ ID NO: 3175 - DNA, 125 bp, Homo sapiens
caggtatgacttcatagacagccttttctgatctgaccttcatacttgcctctgctttgcctttatctccacctctctacactagtgcttctgccctgttggacttttttaaaacttttaatcat

SEQ ID NO: 3176 - DNA, 180 bp, Homo sapiens
gttcagttgtggcggttcctggtcagtaacagccaagatgctgcggaatctgctggctctccgtcagattgggccagaggacgtaagacatgctttcccgcagcattttaaaaataaagttccggagagcaaaaacttttccagggggttgtgaattcccctgatttaaagggtggggta

SEQ ID NO: 3177 - DNA, 110 bp, Homo sapiens
agtggcatcaattcagagggagtttcctgatgcactcaagctgactgatgagttctactcggagctggctgaagatggctactctggagttgaggtgcgagttaaccacc

SEQ ID NO: 3178 - DNA, 140 bp, Homo sapiens
gccaaatcccgtactccttgccaccggctttcctagagcagcgtagacagctggtaaacttaaggagcacaactatattcttatgagggaatttgtacctttgggggtattattttgtggccccttaccctggttattgt

SEQ ID NO: 3179 - DNA, 255 bp, Homo sapiens
agcctcttcccccagttctggtctgacccaacagaggggctctatgatattaagaaggggcccttcctgctctgtgcctcaacctattctccataatagggagtctaatcctattcctcccctgcctcgatgaggatggtgtaaggatgaggaggccggcatctcatttggggctttttggcagtgggcctcattttaatcctccagggctgcctccaagtggatctatccagctgcttccttgtggcaagaatt

SEQ ID NO: 3180 - DNA, 230 bp, Homo sapiens
catggatgtaaccacaacctccaccaggattggcaagtttgaggccaggttcttccatttggcctttgaggaagagtttggaagagtcaagggtcactttgggaccatcaacagtgttgccttccatcctgatggcaagagctacagcagcggcggcgaagatggttacgtccgtattccattacttcgacccacagtacttcgattttgagtttaggcttaagaagctg

SEQ ID NO: 3181 - DNA, 120 bp, Homo sapiens
gccagtgtggccagagactggtacatcagcaagacccccaggacaaggggcatgtctggttcggcgagacattgaccgatggattccagttcgagtatggcggccaggcttccgaccctc

SEQ ID NO: 3182 - DNA, 104 bp, Homo sapiens
cattgcctgaggcctgggctcgccttggaccacaagtttgaacctgaatgtatgccaagcgtgcctttgtttaacttgtmacgttggtgaggggatgggaggca

SEQ ID NO: 3183 - DNA, 301 bp, Homo sapiens
tcaagattcacagcatctcagacgcagcctaggccgcaccaggatgtcggacaccgaggagcaggaatatgaggaggagcagccggaggaggaggctgcggaggaggaggaggaagaagaggaacgccccaaaccaagccgccccgtggtgcctcctttgatccgccaaagatccagaaggggagcgcgttgacttcgatgacatccaccgcaagcccatggagaaagacctctggagcttcagacactcatcgatgtacatttcgagcagcggaagaaggaggagaggagctggttgcct

SEQ ID NO: 3184 - DNA, 160 bp, Homo sapiens
aaaatgacagattattctggaggagatgacctccatttatggttatgtgtgtgtgtctgtgtgtctttggaaaaatatatataatttcctcacataggaagccaacatatcaagtgatgagttacagtatgctgcagcatatatattctacacctacaac

SEQ ID NO: 3185 - DNA, 228 bp, Homo sapiens
gttgagagaagttgcaaaaagaattagtcaaaagaattagtcaaaatttgtcctctgacctaggtctgaaggacatttaacacattgattgttctcttcatccagcctttgagccctatgagttagtgcccttagcctttgagtcccacaggtatggaggagctacctgtcgggacctcagccatcactattcctgcttcaagttacactggtgctctcactagcact

SEQ ID NO: 3186 - DNA, 470 bp, Homo sapiens
  misc_feature 32: n = A,T,C or G
gttgagagaagttgcaaaaagaattagtcaanagaattagtcaaaatttgtcctctgacctaggtctgaaggacatttaacacattgattgttctcttcatccagcctttgagccctatgagttagtgcccttagcctttgagtcccacaggtatggaggagctacctgtggggacctgagccatcactattcctgcttcaagttacactggtgcctctcactagcactgctctgaaaagccagctggaaaaatcaatgcatttgagtacataaattctttggctccaaagaaatgccatagcaatattgcttttaattcagttttgtttagatgttagaattggtatttgttcttgctttttggttgcgatgggagttatatactaagttacttatactaaggcattagtagctcatatctgaggagcaattgtatttttagttcagctaaattaatgcctctttttta

SEQ ID NO: 3187 - DNA, 122 bp, Homo sapiens
ggatgtgttcaggtgacctcatgaacacaggtgcatcaagcctaatgttctggctgcagttagagggcaatctcttcagaaccagtgagggacctgatatttagtcatttctgtgcacccct

SEQ ID NO: 3188 - DNA, 490 bp, Homo sapiens
ggatgtgttcaggtgacctcatgaacacaggtgcatcaagcctaatgttctggctgcagttagagggcaatctcttcagaacagtgaggaactgatatttagtcatttctgtgcacccctggtcacgcagttgcgcccccccccccttttttttccttaactttgttgttttttgctttgtttgaaaatgttctgatttccttttgaaagtgttgaaagtgttctgatttcctttgtcactatcaatatgtaatggcttttgtagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaagggcaggccaacaacgccgggcctaccgcaggcgaaggtccc

SEQ ID NO: 3189 - DNA, 182 bp, Homo sapiens
gaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaa

SEQ ID NO: 3190 - DNA, 121 bp, Homo sapiens
taatactggaaaataatgtctttcagaaaaaggtttctttggtttttgtttctaagacagaggaggccaattggatttcaagttatatgatgacattctgaattaatgacactggaaaact

SEQ ID NO: 3191 - DNA, 152 bp, Homo sapiens
cggcacgagagacagggcaggatccacgtgcccattgtggaggcagagaaaagagaaagtgttttatatacggtacttatttaatatccctttttaattagaaattaaaacagttaatttaattagagagtagggttttttttcagtattct

SEQ ID NO: 3192 - DNA, 160 bp, Homo sapiens
ctcgccttttcggggcgagtaaacttggcgaaacctgkatccgggcccaacctgaaaacatcccagccaagaactggtataggagctccaaggacaagaaacacgtctggctaggagaaactatcaatgctggcagccagtttgaatataatgtagacgg

SEQ ID NO: 3193 - DNA, 153 bp, Homo sapiens
tttggcaaaagtgatatattatgaataagcaataatgatccaacacattccagttaaaaatatacttgtaaaaattgttcaggatgcacttaaatttcattgaccggtgcaataggttgttggaatgattaggccgcttttaccagctctata

SEQ ID NO: 3194 - DNA, 119 bp, Homo sapiens
agtaagccaagtaccactgcactctagcctgggcagcagagtcagactctgtcacacataaataaataaataataaatatcagatctttttgctttctccttccttcctgcttgcctcc

SEQ ID NO: 3195 - DNA, 134 bp, Homo sapiens
gtaaacaccagagtagctattacaagggaacacaaataagaatggtttagaaatggatatgatgaattgacatgtaagggtccatgtaaatcctgtttggctctctaaaagaatgtttacctaaagctattcat

SEQ ID NO: 3196 - DNA, 171 bp, Homo sapiens
gcggatctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccatttcacatttgag

SEQ ID NO: 3197 - DNA, 161 bp, Homo sapiens
aggaggctgaggcgagaggatggcttgagctcaggaagtcaaggctacagtgagctgtggtagtgccactgcactccctcatggttgacagagcaagaccctgtctcaaaagattctaatatagatactctttttatgcatatgtaatttatatatatcac

SEQ ID NO: 3198 - DNA, 160 bp, Homo sapiens
ggcctctggtgggtttcaagttgaggttgatcttgatctacaattgttgggaaaaggaagcaatgcagacacgagaaggagggctcagccttgctgagaacactttcttttgtgtttacatcatgccaggggttcattcagggtgtctgtgctctgactg

SEQ ID NO: 3199 - DNA, 245 bp, Homo sapiens
ctggctcctccgtagacccctgttcttttcaacctctgcccacccgtgcatgtcatcacaaacatttgctcttaagttacaagagaccacatccacccagggattagggttcaaggtagcagcttgctaacccttgaaccagcccttgtgggactcccaacacaagacaaagctcaggatgctggtaatgctaggaaggatgtccctccctcacttccccaaattctccagtggctctaccagcc

SEQ ID NO: 3200 - DNA, 155 bp, Homo sapiens
gtgactgccagtgccgagggctaccattcagtgacacggaactgtcgggtcacctttgaagagggccccttcccctgcaatttcgtgctcaccaagactcccaaacagaggctgcgcgagttcctgggcagtggggcccaaggtgcccccggacc

SEQ ID NO: 3201 - DNA, 125 bp, Homo sapiens
atgaaggagatgggtgggtcaaaaagggatatcaaatgaagtgataggggtcacaatggggaaattgaagtggtgcataacattgccaaaatagtgtgccactagaaattgggtaaaggctgtct

SEQ ID NO: 3202 - DNA, 110 bp, Homo sapiens
ggacgaatggcttcaaggttacttcgcggcgtggaacgctagccgcgcagccctgaaggctccgccggcccagtggcgcggccgaattggcttccatggcatcttgaggt

SEQ ID NO: 3203 - DNA, 170 bp, Homo sapiens
cggacttgggattggagagaaacaggaactgagcattctcctggtgtgcagcctgcagatgtgaaggaagttgttgagaaggggtgtacagactcttgtgattggcccagggatgagtgaggcctttaaggggccttcatcaactgtggagtacctcaagagacatggca

SEQ ID NO: 3204 - DNA, 195 bp, Homo sapiens
gggcatctctcgggacaactggcacaagcgccgcaaaaccgggggcaagagaaagccctaccacaagaagcggaagtatgagttggggcgcccagctgccaacaccaagattggcccccgccgcatccacacagtccctgttccggggaggtaacaagaaataccgtgccctcagggttggacgtggggaatttt

SEQ ID NO: 3205 - DNA, 140 bp, Homo sapiens
tggcatctacttcgtgggtcttcaaaaatgttttatcaaaactcagattaaagtgattcctgaattttctgaaccagaagaggaaatagatgagaattgaagaatttaccacaacttttttttgaacagtcagtgttttg

SEQ ID NO: 3206 - DNA, 203 bp, Homo sapiens
gcaagttttcttacagttaaggcctgcttagtttactgattctcagggagccctctgtggccttttgctttgcgtgctgtttcccttgtaccagagggcggcaccctggaaattctgttttccctgtagcatattgtgttggagttgcattactggcagagaaagggacaaggtgccactctaagtcccagggggggggctcc

SEQ ID NO: 3207 - DNA, 110 bp, Homo sapiens
ttcagagagacatttaaggtaatattttgaacgtttcagatatattattgatatgtgctctattgaatgtgtctaaataaatgctgtttatttaaatattcctataatct

SEQ ID NO: 3208 - DNA, 130 bp, Homo sapiens
gagacagaggcgccggacctccagcaagcgcaatcccccgtcgtgaattcagtgaattcagaggcaggacgggatcatccggagtcgggagctgcttccacaggaggcgaggctccccagggctcatagg

SEQ ID NO: 3209 - DNA, 373 bp, Homo sapiens
ggagaagtacggcattccagaacctccagagcccaagcgcaagaagcagtttgatgccggcactgtgtatgtgatgtgcacattttccagttcgtaagctggggccctggctgttttaagtaactgtgtgtttgccactggcaggaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatagtttgtcgggcgccgattcctacaaagatgctgtccggaaagccatg

SEQ ID NO: 3210 - DNA, 374 bp, Homo sapiens
ccgggggccgacccgccactatccgcagcagcctcggccaggaggcgacccgggcgcctgggtgtgtggctgctgttgcgggacgtcttcgcggggcgggaggctcgcgccgcagccagcgccatgcaaaactacaagtacgacaaagcgatcgtcccggagagcaagaacggcggcagccgggcgctcaacaacaacccgaggaggagcggcacaagcgggtgctgctcatctgcctcgacctcttctgcctcttcatggcgggcctccccttcctcatcatcgagacaagcaccatcaagccttaccaccgagggttttactgcaatgatgagagcatcaagtacccactgaaaactggtgagacaataaat

SEQ ID NO: 3211 - DNA, 367 bp, Homo sapiens
gccggatgcactagccctgaagaggggtgtcatgacatggcctgagctgggcctccaccgactgcctgctcacccctgggctgagggaagggagaggagaggaacaagggcctccgaaaccccaaccctgagggagactggattggtcttggggcccaggacccagacgcaggacagagtgtgactctgcctgtgatggggtggccttctgctgtcccccctccaccagtgcccttttgcagagagatattttgtgtacacagaagccattccgagtctgggacctgcccctgtgcggatcctgacccagccaacagctgagctgccgggctcctcgaggccctaagccaccccagaggtgccatct

SEQ ID NO: 3212 - DNA, 148 bp, Homo sapiens
cagaattgtaaatgtttagttgtgaccatgacgtattgtttgggtcaatgtccctttccaatgcatactaatatcattatgggtattatatatgaatatatttgatgacatcggaaaagttgtggattttctttctttcctttttttt

SEQ ID NO: 3213 - DNA, 330 bp, Homo sapiens
cttggtgtgccttggatttctgaggatagacttacagtcatctgatgagctatttttcatatttttaaggatcagagaaggctataatatttattccctcagcctttttatttctggcaatatggagcattagaaaattttcaggaccctacagctataaaggacacaagtatgttggacaacatatatacacacatttcattgagatgcatacccacaactccgttgagagggaaagagctctacggacagagacagagcagccgcaggcgcggcagtagctcacacacaggagtgccacactcgcgatatagagtgagaggttaaagc

SEQ ID NO: 3214 - DNA, 292 bp, Homo sapiens
tcttattcacgttttttttaaccataagtggcaaatattttaaaatatttgacaaacactccagaatctagtacgctttatttttagacctgaccctaaagtaggttgttcttttaacaaagggtttaattcgggttgggaatataacatatcacaatacatgacaccaatgggaaagttacttctagagaagccaagagattgggtatcatattttgtctcttggggagctaattttgttgagtgtgtagagttgagcacagatgtatatttttgaagggcagtttagaga

SEQ ID NO: 3215 - DNA, 388 bp, Homo sapiens
ccagcaccatggcggttggcaagaacaagcgccttacgaaaggcggcaaaaagggagccaagaagaaagttggttgatccattttcttaagaaagattggtatgatgtgaaagcaccttgcttattgttcaattattaaggttattatttggaaagacgcttcgttcacccaggacccaaggaaccaaaatttgcatcttattgggttcaaggggtcgtgttgtttgaagttaggcttgctgatttgcagaatgatggaaggttgcatttagaaaattcaagctgattactgaagatgttcagggtaaaaactgcctgtactaacttccatggcatggatcttacccgtgacaaaatgtgttccatggtcaaaaaatggcagacaatg

SEQ ID NO: 3216 - DNA, 362 bp, Homo sapiens
ttttgtttgtcatgtacgaaacaagagggctggcaaggaagaacccgttgttgtccattgcagttctggaatcggaagaactggggttcttattactatggaaacagccatgtgtctcattgaatgcaatcagccagtttatccactagatattgtaagaacaatgagagatcagcgagccatgatgatccaaacacctagtcaatacagatttgtatgtgaagctattttgaaaggttatgaagagggctttgttaaacccttaacaacatcaacacataataggagagcaaaaagagtctgggatatgtgttggaaactgctttcctcatgtgcactgtgccataatgctgctcgcagga

SEQ ID NO: 3217 - DNA, 338 bp, Homo sapiens
ggttttctgcctttggagaaggaaagaagactgatgtaattgaccaactggggttactgagcattgaatctcaacttaatttagctgtgctgtttcagtcttctactcacacgtgtatgggaaagttcattgtggtttgaaaatgaattttcaatggataaacattaattaattattaacccattaataatcttgaaagtgcaaggcaccttacatatctttacaccagtatcattgattttctaaaaggacactgattgactgaatgactagagtaagggcacacactcactataagtgtcaccctatgacttctgcttgaaaatttcacttaagct

SEQ ID NO: 3218 - DNA, 540 bp, Homo sapiens
tggttttctgcctttggagaaggaaagaagactgatgtaattgacccaactggggttactgagcattgaatctcaacttaatttagctgtgctgtttcagtcttctactcacacgtgtatgggaaagttcattgtggtttgaaaatgaattttcaatggataaacattaattaattattaaaccattaataatcttgaaagtgcaagggaccttacatatctttaaaccagtatcattgattttctaaaaggaaactgattgactgaatgactagattaaggtcacacaatcactataagtgtaaccctatgacttctgcttgaaaatttcacttaagcttttccctgaatgattaaatttccaatcagatcataattgggatttgttgaggggctgtgactacaaattctgacagtcacatatttctaggggcaaaatgaaaacatagaaaatcctagatcaagccactggttggtgccttgacttttggaccagaacagctgaactgtgtgttaaatatcatcatgagaaacttaaat

SEQ ID NO: 3219 - DNA, 320 bp, Homo sapiens
cctatctggacgaagcagctggcaacctcaagaaggccctgctcatccagggctccaatgacgtggagatccgggcagagggcaatagcaggttcacgtacactgccctgaaggatggctgcacgaaacataccggtaagtcgggcaagactgttatcgagtaccggtcacagaagacctcacgcctccccatcattgacattgcacccatggacataggagggcccgagcaggattcggtgtggacatagggccggtctgcttcttgaaaaacctgtacccgaaacaacacaatccgttgcaaacccaaagggcccagt

SEQ ID NO: 3220 - DNA, 295 bp, Homo sapiens
atcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaaatcatgttgcagagccagcaggtggatagtatatagggtttatgcctgtgtttctttttctccatgagagagctaaacatgagatataatggatatagtatta

SEQ ID NO: 3221 - DNA, 250 bp, Homo sapiens
gtcaccagcagctgtactggagccacccgcgaaaattcggccagggttctcgctcttgtcgtgtcttttcaaaccggcacggtcattgatccggaatatggcctcaatatgtgccgccagtgtttccgtcagtacgcgaaggatatcggtttcattaagttggactaaatgctcttccttcagaggattatccggggcatctactcaatgaaaaaccatgataattctttgtatatataatacacacttt

SEQ ID NO: 3222 - DNA, 210 bp, Homo sapiens
tcgtgccgaattcggcacgaggtcgccttctaccttgctggcttgcccttagggggcaacttcttcccccagcggccaagggacaatcaaaggaaggtcttgtgacaagcctttggtatcttgatgcggacgacggcccggcttaacaagggttatcagtgtagcttattggaaaacattttaagggcggcaatttcccaaggggatttg

SEQ ID NO: 3223 - DNA, 200 bp, Homo sapiens
agaaggagcggcacaggcgccagggcagggaagtcagacctgacaacccagtacaaccggccgcaagcgcaagccccgctttctaagtcaaccacgcggttcctggaaaggcacttgccctctccacttttcctatattggtccagctgaccaaggtagtattttggaaaaggtcctaaggtatataaaaatgtttctct

SEQ ID NO: 3224 - DNA, 300 bp, Homo sapiens
cggcacgagatcctggtgtcgccatgggccgacgccccgcccgttgttaccggtattgtaagaacaaggcgtacccaaagtctcggttctgccgaggtgtccctgatgccaagattcgcatttttsgacctggggcggaaaaaggcaaaagttgatgagtttccgctttgtggccacatagtgtacagatagaatatagagcagctcgtctctcttgaagccctgagaggctgccccgaattttgtgccacataagcacataggtgaaaaagttgtgcgcacagatggccttccatatcc

SEQ ID NO: 3225 - DNA, 310 bp, Homo sapiens
ggacaccgtggcttcactggtctgcagggtctgcccggccctcctggtccttctggagaccaaggtgcttctggtcctgctggtccttctggccctagaggtcctcctggccccgtcggtccctctggcaaagatggtgctaatggaatccctggccccattgggcctcctggtccccgtggacgatcaggcgaaaccggccctgctggtcctcctggaaatcctggacccctggtcctccaggtccccctggccctggcatcgacatgtccgccttttctggcttaggcccgagagagaagggccccga

SEQ ID NO: 3226 - DNA, 310 bp, Homo sapiens
gaaccgtgctgcatactatcctcctagccaaattgctcaactaagaccaagtcctcgctggactgctcagggtgccagacctcatccattccaaaatatgcccggtggctatccgcccagctgctcctagaccaccatttagtactatgagaccagcttcttcacaggttccacgagtcatgtcaacacagcgtgttgctaacacatcaacacagacaatgggtccacgtgctcgcagctgcagccgctgcagctacttctgctgtccgcaccgtttccacagtataaatatgtctgcaggaggttcgga

SEQ ID NO: 3227 - DNA, 290 bp, Homo sapiens
gaagctgtagcgtatggtgctgctgtccaggctggtgtgcctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggcacatatagatctgactggaatt

SEQ ID NO: 3228 - DNA, 330 bp, Homo sapiens
cgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggacttaagagttcgagagatccaagaggaagaatccagctgcctattaaaatgacaaatgagcaacgcatcccgatgacgggttccctgtctcttaaagacctttctcttggaggaggagtcttcattttag

SEQ ID NO: 3229 - DNA, 208 bp, Homo sapiens
gacagatccagacacttgccaccaatgctcaacagatttacacagacagaggtccagcaaggacagcagcagttcagccagttcacagatggacagcagctctaccagattcagcaagtcaccatgccttcgggccaggacctcggccagcccatgttcatacagtcagacaaacagaccttcgacgggcaggacccccaggtgtacc

SEQ ID NO: 3230 - DNA, 215 bp, Homo sapiens
ctcgtgccgaattcggcacgagcgcatcccatccggctgggcctggccctcaacttctccgtgttctactatgagatccagaatgcacctaagcaagcctgcctcttgagccaaacaagccttcgatgatgccatagctgagctggacacactaaacgaggagttctatataggactccacgctcgatcatgcagattgctgcgagacaaactca

SEQ ID NO: 3231 - DNA, 115 bp, Homo sapiens
ctcacacttcatctaagatgttcctctttgcgctcaaacaaaatggggagtctcaatgagtttttaaaagatttctttcttccttttttttggggggggggtaaataaatgagcc

SEQ ID NO: 3232 - DNA, 105 bp, Homo sapiens
ctcacacttcatctaagatgttcctctttgcgctcaaacaaaatggggagtctcaatgagtttttaaaagatttctttcctccttttttttggggggggggtaaa

SEQ ID NO: 3233 - DNA, 174 bp, Homo sapiens
ttaagcaaaggtatttttgaagtggtgtagaacccttccaagctttcctgctcagtgttctaccagacttaccctggggcctcgcttaaaagcaggattgaagaaaagggactcggggaaggaacttattgggaaacttgatagcgaatgagtttctgcttggcacagtctctg

SEQ ID NO: 3234 - DNA, 245 bp, Homo sapiens
gttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgagctctttaagttgcctttagtgttggtgctgatttttctttttacaattaccaaaataaaatttattaagagaaaggg

SEQ ID NO: 3235 - DNA, 257 bp, Homo sapiens
aatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagttttaaaatcagtactttttaatggaacaacttgaccacaaatttgtcacagaattttgagacccttaaaaagttaatgagag

SEQ ID NO: 3236 - DNA, 306 bp, Homo sapiens
tgggatgagaggccagggcaggtgcaagctatgccttcactcctttgtccctgccttcctccttcctgtaccccagctacagccccgttgggaagaatgtgtcgttagtcacaaagcattgcagatgtgtctaagaaatgccacgctggggccgggcgttgtgctcacacctgtaatcccagcacttcgagaggctgaggcaggcggattgcctctagctcaggatttcaagavcaccctcgggtaacataggtgaaaccctcgtctctactataaatacacaaaaaattagctctggtgttgtgg

SEQ ID NO: 3237 - DNA, 215 bp, Homo sapiens
ggcgatatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgttgggatcttgcactgtgtggtcctgcattaagacagttgcttgcggtgtcttga

SEQ ID NO: 3238 - DNA, 210 bp, Homo sapiens
atcaatagaaaactaatacagagtataaagaaagtataggaagtaattcaaatataaattccaactctacaattccaactgcaggttacactagaataattaaaacaaagtcaggagatattctgctaatccatgttctttttaaactcctgtagggccttcagagtgacaagttctatggccaaggggtttactcctatttaccatggg

SEQ ID NO: 3239 - DNA, 305 bp, Homo sapiens
agatgctcctcccctggaccattgcaagtccatccttcaaatgaccactccataatataacatttcatccagtaaactggcctctactatctttaactcatgcatggccactgaacctctctctagtagcctggatttatcattctctctgcctgcccacccccttttttggtatagcccaagaaccacttccatgccatactgtaacattccaacatctttagctgatcagatctctccatatactctcttgccagcttttttccgtgctcccccaactatgtatcagataagagtctctgatc

SEQ ID NO: 3240 - DNA, 295 bp, Homo sapiens
tctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaatttgaatttttttttcaacactcttacacctcttatggggaatgtcaaccctg

SEQ ID NO: 3241 - DNA, 277 bp, Homo sapiens
ggaaactgtgcaaatacatggaaattaaacaacatgcttctggatgatcattaggtcaataaagaaattaagaaaatcaaaaacatttttgaaacaatggaaaatggaaacacagcatacctaaacctatgcgatacaggacaagcagcactaagaggaaagtttatagcaataagcacctacaccaaagaaagtggaaggatttcttataaaccaccttaatgatacacaacctcaggaaagcagggattaaccattcccaaaattagtagaagga

SEQ ID NO: 3242 - DNA, 240 bp, Homo sapiens
tataattgtaagcccatattacttgtgttagtagttttgtctctataggtaacataatgacagtggtgtaaagtttctgttcaagaaacatatgttgtaaagttactttatacaagatacctgccaaaggaaatggtcttactttcaaatgactttgaaagcatgtataattgcaaacagagcaggagaagactttaatcagaatttcttgtgtccttttccttactaagtgttttgaat

SEQ ID NO: 3243 - DNA, 228 bp, Homo sapiens
gctagatggcatgatattagaagggaaagatcttttggttttcatttgatgattatcaggtttctttaagtctaaaaaatgccttaaaacttaagtaataaaagaaggtgttctttttggctcatgcagtgtgtcgatctctgtctctcccaagcatttttagactttatgccagagaccacctggaggcaaaaggcaccatttatttaattccttccatactagtac

SEQ ID NO: 3244 - DNA, 236 bp, Homo sapiens
agcagcaacaagcctctgaggggagaccctggagtgatcaagcagaaggtcctgagggagaaggtgccatgcctttgtttggaagacccaagaaaaggactcttgggagcgttctccaggccaccccagaggcagccagtcagctctcggaacgccctcagaggggtggagttagaagccagcccagttaagacaggaccctgaggaaacagacacattgttgaggaggttagagg

SEQ ID NO: 3245 - DNA, 217 bp, Homo sapiens
ctcgtgccgaattcggcacgaggttacattgattattctgaatttgtggctgctcttcatcccaacaaggatgcgtatcgaccaaccaccgatgcagataaaatcgaaggtgaggttacaagacaagttgctcagtgcaaatgtgcaaaaagggttcaggttgagcagatcggagagaataaataaccggtttgggatctcaacaagtgccgcttgt

SEQ ID NO: 3246 - DNA, 234 bp, Homo sapiens
aaaaaccttgtaaaaaaagcaaaaatgacaacagaaaaacaatcttattccgagcattccagtaacttttttgtgtatgtacttagctgtactataagtagttggtttgtatgagatgggtaaaaaggccaaagataaaaggtttctttttttttccttttttgtctattgaggtgctggttattttttttggcctgtttgatgtatgtgttgaaacaatgttgttccacaatw

SEQ ID NO: 3247 - DNA, 178 bp, Homo sapiens
gatcacagtgttttcatcagaactaagtagagggtcggttcctgccctggttttggggtagctagaaaaggaaatcatgaatgcactggaaatgttggctcgagagaaaagacttgcatagctcttcctcgcagtgggtgagagcgtattgatcggagggaccttgcagaggttctat

SEQ ID NO: 3248 - DNA, 125 bp, Homo sapiens
agaagtaagattttaatggttatgataaggaatttgttttggaggtttggaaaatggaattgtttttttttttggcgtctaataatcctggttttgggaggaaatttgtgggttatcttgtttaa

SEQ ID NO: 3249 - DNA, 377 bp, Homo sapiens
agaacccagactcccatggttatgacaaggaccccgttttggacgtctggaacatgcgacttgtcttcttctttggcgtctccatcatcctggtccttggcagcacctttgtggcctatctgcctgactacaggatgaaagagtggtcccgccgcgaagctgagaggcttgtgaaataccgagaggccaatggccttcccatcatggaatccaactgcttcgaccccagcaagatccagctgccagaggatgagtgaccagttgctaagtggggctcaagaagcaccgccttccccaccccctgcctgccattctgacctcttctcagagcacctaattaaaggggctgaaagtctgaaaaaaaaaaaaaaaaaaaa

SEQ ID NO: 3250 - DNA, 241 bp, Homo sapiens
gacgagtccaaccatgaccctcagtttgagccaatagtttctcttcctgagcaagaaattaaaacactggaagaagatgaagaggaactttttaaaatgcgggcaaaactgttccgatttgcctctgagaacgatcttccagaatggaaggagcgaggcacttgtgacgtcaagctcctgaagcacaaggagaaaggggccatccgcctcctcatgcggagggacaagacccttaagatct

SEQ ID NO: 3251 - DNA, 208 bp, Homo sapiens
tcttgatctgcagcttctctgaagtttggaaaagaaaccttcctttctggagtttgcagagttcagcaatatgatagggaacaggtgactgatgggaccaagagtgacaagcatacacaactacttattatactgtaggagttttgactttgttgatactgagacttactatgaaagtttaaatatgtaaacggattaatgaatttac

SEQ ID NO: 3252 - DNA, 257 bp, Homo sapiens
ggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaattcagtttcattaactccttccctcg

SEQ ID NO: 3253 - DNA, 138 bp, Homo sapiens
aagaatatgaagggggccgaggcgagtcttctaagagggacaagtcaaagaggaagaagaaagtaaaggtaaagatggaaaagaaatccacgccctctaggggctcatcatccaagtcgtcctcaaggcagctaagcc

SEQ ID NO: 3254 - DNA, 183 bp, Homo sapiens
ctgtgggggaggggttgtattcgggttgtttttgtttttttcttgccaggtagataaaactgacatagagaaaaggctggagagagattctgttgcatagactagtcctatggaaaaaaccaggcttcgttaggatgtctgccttactgggttccccaggaaggaaaaatccattcccaccct

SEQ ID NO: 3255 - DNA, 167 bp, Homo sapiens
aaaactcttgacttaattgagtaaactcttcatgccatatacatcattttcattatgttaaaggtaaaatatgctttgtgaactcagatgtctgtagccaggaagccagggtgtgtaaatccaaaatctatgcaggaaatgcgggagataggaaatatgtcacttga

SEQ ID NO: 3256 - DNA, 190 bp, Homo sapiens
ctcgtgccgaattcggcacgagcccactgcaagctcttctcaaattttagtttaattggcattgcttgttttttgaaactgaaattacctgagttttcattttttctttcgaatttataggggttagatttcttgaaagcagcatggaatatatcaccctacatcctgacaattaatttccattccggtg

SEQ ID NO: 3257 - DNA, 120 bp, Homo sapiens
cccctagggaagaaacggaatagtgggtgggttgcgcagggcgtcactccgcagaagggcgggataattaaaaatcctttctaatattggcggggaaaatggccatgtcctcgagccatc

SEQ ID NO: 3258 - DNA, 296 bp, Homo sapiens
ccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccaaaaaaaaaaaaaaaaaaaaaa

SEQ ID NO: 3259 - DNA, 232 bp, Homo sapiens
gagatgcaaaggaaataaaacccgaggcttctgcctttggtgcgtgtacagccaggtttcagagacccatatggttttagctttagaaaggatgttggagattatttagttctcttctcccagtttataaagaagactgcggtccagaaagactgaaaattcaggcaaccagtcaagtgctcttaaaggatatgcatacccaggaaaacttggaaactgtaaaactgccagt

SEQ ID NO: 3260 - DNA, 202 bp, Homo sapiens
tgcactttgaagatgagttactccttgtcatcttacaaatatgtgatatggtaattttcataacagatgtcagttttgaaccaagaattggtgatttgtttataagaaaaaaactgggcttcatttctgtgaaattgctctttgaaaatttctttttacacgtgttaagccaactgaggataccgtgatggtgttgatttct

SEQ ID NO: 3261 - DNA, 176 bp, Homo sapiens
gctggctccctcttagattcttgtaccaagcttcttcagaaagggattcatccaaccatcatttctgagtcattccagaaggccctggaaaagggcattgaaatcttgactgacatgtctcgacctgtggaactgagttacagagaaactttgttaaatagtgcaccacttcactg

SEQ ID NO: 3262 - DNA, 312 bp, Homo sapiens
ctcgtgccgaattcggcacgagcaggaatggcgagttgcaagtatggctcagtcagctcctagcgaagccccgagctgcagtcccttttggaagaagaagaagtacatagacaaatatcttggccaagcacagctcgattttttgatcagttggatgttgtttcctacgaggaagtcgttcggctccctgcattcaagaggaagaccctggtgctgatcggagccagttgggttggtcgcagccacattaagaatgcccttctcagccagaatcccgagaagtttgtgtaccctgtcccatatacaacacgg

SEQ ID NO: 3263 - DNA, 119 bp, Homo sapiens
ttggatgcagatgcaagcggagtaggacccctccacggtctcgaactcggctgcagtaaagtacgtgaggctgtctctcggggcctagaagttgcacgcatacagattgctctttctta

SEQ ID NO: 3264 - DNA, 141 bp, Homo sapiens
tcggttagcagctggattgaggactttcataaaatcaaaataactggatgcagagtcctactcagcattaggggctagagggaatgcttaacctggagagagtaagtagccggtagcattactcagctggtaaaacagatc

SEQ ID NO: 3265 - DNA, 235 bp, Homo sapiens
ctcgtgccggtttgagaccagcctgggcaatatgacgaaacctctctccactaaaaaatacaaaaaataaactggggcatggcagcatgtgcctgactcccagctattcaggaggctgaggcaagagaatggcttgaaccctgggahgvaaaagttacagtgagccgagatcacgccaatgaactccahcctgggtgacahahcgagactccgtctcaaaaaaaaaaaaaaaaaa

SEQ ID NO: 3266 - DNA, 136 bp, Homo sapiens
ccttagcattcccccagtccctccctcttcaccttgctcccctctattgtctttccagctcagcctttttccccactcttaaatactgtactacttcactgtaagaacgaaagaataggttaggatacccattgag

SEQ ID NO: 3267 - DNA, 156 bp, Homo sapiens
cctcaggaaattctacaagggcaagaagtacaagcccctggacctgcggcctaagaagacacgtgccatgcgccgccggctcaacaagcacgaggagaaccttaagaccaagaagcagcagcggaaggagccgctttaccccctgcggaagtacgs

SEQ ID NO: 3268 - DNA, 176 bp, Homo sapiens
acccgaacactgatcgctgggtggccacgggcatcgtgtcctggggcatcgggtgcagcaggggctatggcttctacaccaaagtgctcaactacgtggactcgatcaagaaagagattgaaggaggaaggactcagcccagaattcactaggttcgaatccagagagcagtgtgg

SEQ ID NO: 3269 - DNA, 213 bp, Homo sapiens
accagctggcctcagcctcagagctccccctgggctctcgacctgcgccccagcccccagtacctcgtccggagcactgtgagggagctgcagtaggactcaaggcagcccaggggccacctgctcctcgctgtgcctcctaaatacagatgtcatggcctgcacacagacagccctcttgcagaagctgacctcgggatcttctgaacttgk

SEQ ID NO: 3270 - DNA, 110 bp, Homo sapiens
cacatggaaactaaacaatgttcttccttaattgaccagtgagtcagttgaaaaaatttaagaagggaatttgggaaatttttctttgaaggccaattgataattgggag

SEQ ID NO: 3271 - DNA, 434 bp, Homo sapiens
aacacatggaaactaaacaatgttcttcctaatgaccagtgagtcagtgaaaaaattaagaaggaaattggaaattttcttgaagccaatgataatggaaacacagcatacaaaaacatgtgggacacaatgaaaacagtactcagagggaagcttatagctataagtgactacctcaaaaaagaaaaagaacttcaaataaacaacctaccaatgcatcttaaagaattaaaaaagcaagagcaaaccaaacccagaattagaaggaaagaaataatgatcggagcaaagataaatgaaaatgaagaaaacaatacaaaaaatcaatgaaaccaaaccttggttttttttattttgttttcattttgttttgttttgagaagataaaattgacaaactgtaacccagactaactaataaaaaaaaaaaaaaaa

SEQ ID NO: 3272 - DNA, 188 bp, Homo sapiens
tgacgtgggtggccagcgcgatgaacgccgcaagtggatccagtgcttcaacgatgtgactgccatcatcttcgtggtggccagcagcagctacaacatggtcatcccgggaggacaacccagacccacccgccttgcaggaaggctctgaacctcttacaagagcatatcgtggaacaacagatggg

SEQ ID NO: 3273 - DNA, 216 bp, Homo sapiens
ggcaagcttgccagtgtacctgctggtggggctgtagccgtctctgctgccccaggctctgcagcccctgctgctgggttctgcccctgctgcagcagagggagaagaaagatgagaagaagggagggagtctgaagagtcagatgatgacatagggatttggcctctttgattaaattcctgctcccctgcaaataaagccttttttacacatca

SEQ ID NO: 3274 - DNA, 341 bp, Homo sapiens
gtcacctcagtgcaacagctgggagggggccgtgttaagattttttttgctacaaagaggaggtggcaatggtagatccacccttatgcttctcagtttagcataacctcttatggattttcatcaaattcagcgtgttggtcactggagagagccttttccttctccttttcttactctcccctcatggtgtttccctcttaaaggagaggagcttttaatttacacttaccacctcatttgcttttctggaggccatgcaatataggcgggactacagagttaatctcctctttacacatgaggccacgagaggcctcatttggttcacagtcatgcag

SEQ ID NO: 3275 - DNA, 270 bp, Homo sapiens
acccggcgaacctggaagtggaccatgatttcttccaggacaaggtgtggccccatgtggccctgagggtcccagcttttgagactcttaaggttcagagcgccttggccggctattacgactacaacaacctttgaccagaattgcgttgttgggccccacccgctaggtgtcaacatgtactttgctacttgcttcagttggcacgggcttcagcaggccccttgcatttggcgagctctagcagagatatggactctaagggcagag

SEQ ID NO: 3276 - DNA, 225 bp, Homo sapiens
ttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaactggtaatttttttaatttacaaaattaaattgaggcataaccgttgcctctgcgtgcaata

SEQ ID NO: 3277 - DNA, 200 bp, Homo sapiens
aacaatataggcttcaagaagggctggtcctaagagggggcagaaatgaatgaccaggttaaatccctctacatgtggtttctgtttgaaaaaaagaaaactgacatttgaacagggcttttaatttgtttaaaactctgtgtaattacttgtaaccagtaggaaattggaggcattcttattttaggaaaagtgacaga

SEQ ID NO: 3278 - DNA, 231 bp, Homo sapiens
ccaggagaacaaggggaaaaaggtgaccgagggctccctggaactcaaggatctccaggagcaaaaggggatgggggaattcctggtcctgctggtcccttaggtccacctggtcctccaggcttaccaggtcctaaggcccaaagggtaacaaaggctctacttgacccgctggccaaaaaggtgacaatggtcttcacaggctcctcgggctctcaggtgcacctctgt

SEQ ID NO: 3279 - DNA, 191 bp, Homo sapiens
ggggaattgaggaaaaatggattaatacaagagtcctgtgataatatacaaccaagacagggttcttttaacatggattccatgcagtgaatgaagacataggtttcttacccaacacaaatggacagtgggatttgactttcttaaagactttttttgtgggacaattttacaatttggagaaggaaaga

SEQ ID NO: 3280 - DNA, 282 bp, Homo sapiens
caaaaatagagtgggcttcctcaaggagatgggcacacctggctatcggggtgaccgcatcaatcagctcatccgtcagctgaactagacccaggtgaggcaggctgaaaactgcccttggctgacttttgataggccatgccttgccactttacaagttctttttgcatttactagtatttagagtaaccttgagattgggaggaatagaggaggctgcacacatagatgagacctcctggacagtaattccttattagacatgggctatcatagcctaga

SEQ ID NO: 3281 - DNA, 113 bp, Homo sapiens
cgtgaggaaggttgcaagccaacacaaaagttcaaggatctagaagacgattaagggaaggtcgttctcagtgcaaattccaaactcccagacacatatgtttatacaaccct

SEQ ID NO: 3282 - DNA, 187 bp, Homo sapiens
attagttatttacatcaaaaagcttttagaaaatggtacgaggtaaccaattcttgtcatggtgaaatctgattgagtaaccaagcagttttactattctggtgcctgcttcataacacaaatgaaaagctgcatgcatctacagcaggcatggattgtttatgtcgtatgatatcctttattaagt

SEQ ID NO: 3283 - DNA, 273 bp, Homo sapiens
ggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactcatctttgctgtgcaagcagctgtgaagatggacgtacttggtctgactacaatattcaaaaggagtctactcttcatcttgtgttgagactccgtggtggtcctaagaaaaggaagaagaagtctt

SEQ ID NO: 3284 - DNA, 251 bp, Homo sapiens
ataaattttggtggagacaaaccacatccagcccataacaactacccaccttctttctgcttcattctctgccctttctttctgctggctcccctcactcttggttcctttccctttctgatctttctctcctattctttctccttcccttctgtgctccctctagtcctctccctgctcaccagatgacttcagcctctgtgtctccatttcctgtctgcatctgcatggtgtttgtttcctcgggctct

SEQ ID NO: 3285 - DNA, 280 bp, Homo sapiens
agtcactctaggactctgcactgaatggctgacctgacctgatgtccattcatcccaccctctcacagtttggacttttctcccctgctctttctaagagacctgaactgggcagactgccaaaataaaatctcggtgttctatttatttattgtcttcctgtaagaccttcgggtcaaggcagaggcaggaaactaactggtgtgagtcaaatgccccttgagtgactctccccagcccaggccagaggacctccctacaggtgtcgggcgcaggaact

SEQ ID NO: 3286 - DNA, 263 bp, Homo sapiens
cagatgctgaagaggagaaatgtaagctcatttcctgatgatgctacttctccgctgcaggaaaaccgcaacagccagggcactggtaaattggtctgttgatgacattgtcaaaggcataaatagcagcaatgtggaaatcacgctccaagctactcaagctgccaggaaactactttccagagaaaccagcccccatagacaacatatccgggctggtttcattccgaaatttcgtgtccttcttggggagaactgattgt

SEQ ID NO: 3287 - DNA, 88 bp, Homo sapiens
ttaaaaaataaacacatttttaaagatgttgaatttttccccccttattgggaattcttaaaaataaatgcatgcatgttttcccctg

SEQ ID NO: 3288 - DNA, 310 bp, Homo sapiens
catgcctgggccctgctgggctctcccactccaggcggaccctgggggccagtgaaggaagctcccggaaagagcagagggagagcgggtaggcggctgtgtgactctagtcttggccccaggaagccaaggaacaaaagaaactggaaaggaagatgctttaggaacatgtttttcttttttaaaatatatatatatttatacgcgatcctcttcccatttatttctgggaagatgtttttccaaactcagagacaaggactttggtttttgtaagacaaacgatgatattaggccttttgtaagaaaa

SEQ ID NO: 3289 - DNA, 136 bp, Homo sapiens
gaaccccggcatatatggctggcaacgagagcaatttctcttgccaagaaacaaagccaaaggagccaaagaacgagatggggaacaacaccgtgactaaaacaaacagtatcagtaaggaacgggatccgttccc

SEQ ID NO: 3290 - DNA, 563 bp, Homo sapiens
cggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggacaaagccaaagggcccttgttagctggccatccctgcccattttttcccctggtcctttcccctgtggccacagggaagtttggcctgaatacccaacccggctctctgcaccagagctgggggcaactcagaagtgtatctctctctgagcacgcattccctgcagcatcaggatgacagattgagtatgctggg

SEQ ID NO: 3291 - DNA, 253 bp, Homo sapiens
gccttgtgaaatgcgcctgctctatggacataagggtgcgggtactgggcggcgccaccctctggacagggggcgcagaccggggctgccctccctgcaagcctgagggtcatgtttgtccacagtggtcgtggtccacagctactcgggaggctgagggagggaattgcttgaaccaaggaggcggaggttgcagttagccgagatttcaccactagactcaggtctgtattacaaacccagactctgtctc

SEQ ID NO: 3292 - DNA, 137 bp, Homo sapiens
tgaatacaaaacaaataagccatcacgcctgcccttccttgatattgcacctttggacatcggtggtgctgaccaggaattctttgtggacattggcccagtctgtttccaaataaaatgacctcaatctaaattaa

SEQ ID NO: 3293 - DNA, 109 bp, Homo sapiens
actcgtgccgaattcggcacgagtcaagaatctttctcagtagttttttgttcttaattctatgaaactggaaatctaagccaaatcaggttatttagactactaaaat

SEQ ID NO: 3294 - DNA, 280 bp, Homo sapiens
ctcgtgccgaattcggcacgagccagaatctttctcaatgtttttgttcttaattctatgaaactgaaatctaagccaaatcagaaattatttagactactaaaattattacctaaatgattaatgttaagttgcctcacaatagcaaatctcagtatcaaacattcccatgctttgggaggctgaggcaggaagatcatttgaggtcaggagtttgtgaccagcctgggcaacatggtgaaaccccatctctactaaaaatacatcaaaaaaaaaaaaa

SEQ ID NO: 3295 - DNA, 234 bp, Homo sapiens
gaaataatggctgaaaaggaaaacaaaacaataatatttgtggagacaaagagacgctgtgatgatctgactcgaaggatgcgcagagatggttggccagctatgtgtatccatggggacaagagtcaaccagaaagggattgggtacttaatgagttccgttcttggaaaggcacccatccttattgctacagtttgtggcctcccgtggctagatgtggaagttgtcaagtt

SEQ ID NO: 3296 - DNA, 300 bp, Homo sapiens
gcgcgacagaggacacttccttttgcgggtggcggcgaacgcggagagcacgccatgaaggcctcgggcacgctacgagagtacaaggtagtgggtcgctgcctgcccacccccaaatgccacacgccgcccctttaccgaatgcgaatctttgcgcctaatcatgtcgtcgccaagtcccgcttctggtactttgtatctcagttaaggaggatgaagaggtcttcaggggagattgtctactgtgggcaggtgtttagagagtcccccttgcggtgaagacttcgggatctggctgcg

SEQ ID NO: 3297 - DNA, 300 bp, Homo sapiens
cccaaacccacttccaccctactaccagacaaccttagccaaaccatttacccaaattaaggtataggcgatagaaattgaaacccttggcgcattagatatagtaccgcaagggaaagatgaaaatttatacccaggcatattatagcaaggactaacccctatacctcctgcatattgaattaactagagatatctttgcagggagagccaaagctaagaccccggaacccagacgagctacctgagcacagctaagagagcacaccggtctatgtagcaaaatagtgggagatttat

SEQ ID NO: 3298 - DNA, 276 bp, Homo sapiens
gctcaacaagactatgcgcattcgcatgacagatggacggacactggtcggctgctttctctgcactgaccgtgactgcaatgtcatcctgggctcggcgcaggagttcctcaagccgtcggattccttctctgccggggagcccgtgtgctgggcctggcaatggtacccggacaccacatcgtttccattgagggccagagggagattcttaccgggcttccgtatctcttaccacgatggcgcttacctttcagacttcattaaacttatacc

SEQ ID NO: 3299 - DNA, 280 bp, Homo sapiens
ctgaacccgtccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaaggtctgttaaaaaaggaatctgtttcaacagttgacctgtacaataccgtgtggtgaaaatgaattcaggcttatataaatgatgga

SEQ ID NO: 3300 - DNA, 220 bp, Homo sapiens
agctgtcacagtgacacacaaacaacttacagacttccacaagcaagtcactagtgctgaggaatgtaaacaagtttgctgggccttgcgagacttcaccaggttgtttcgatagctcacactcctgcactgtgcctgttcacccaggaatgtcttttttaattagaggacagggaggaaaccaaaacccgactgtgttcccacaatcagaaaccttcgt

SEQ ID NO: 3301 - DNA, 194 bp, Homo sapiens
ctcgtgcgaattcggcacgagctttaaaccctgcgtggcaatccctgacgcaccgccgtgatgcccagggaagacagggcgacctggaagtccaactacttccttaagatcatccaactattggatgattatccgaaatgtttcattgtgggagcagacaatgttggctccaaggcagattgcagcagattccc

SEQ ID NO: 3302 - DNA, 195 bp, Homo sapiens
gcctgccactccaggctcacacaccctggacagtctccacgtgggagacctggtgggaggcttgggcacgggtgggctggaggctggagggagggttttttcatttgggcgggtttctctgggaacttggagggaccctcttcctattgtaccgggatacccagggattcctttcaagggggggaacggccttaa

SEQ ID NO: 3303 - DNA, 530 bp, Homo sapiens
gcctgccactccaggctcacacaccctgacagtctccacgtggagacctgtggagcttggcacggtggctgagctgaggaggtttttcattggcggttctctggaactggaggacctctcctatgtacggataccaggatccttcaagggggaacgcctgagccgctttggactccgcacagagaccacaggcactgtcaccttccgcttgcactgtctgcagcagtccagggccttcatggaatcgagctcccttcagaaaaggatggtgagtgtgttggaccgtctggaagggttcagccagcagagttccattcacactgtgctagaggccttccgtcgagcccggcgccgcatgcaggaggcccgggaaagcctcccgcagggacctagtgagcccctctggaaccctggtctcctagctcacagcagccctggcccacagtgcaagaggacaagatgggggatatctgagggcagtgctctcctgcctcttcgtctttctgattagagaccacgttggtctgctg

SEQ ID NO: 3304 - DNA, 258 bp, Homo sapiens
gccatccagactgaggaagacccggaaacttaggggccacgtgagccacggccacggccgcataggcaagcaccggaagcaccccggcggccgcggtaatgctggtggtctgcatcaccaccggatcaacttcgacaaataccacccaggctactttgggaaagttggtatgtagcattaccacttaaagaggaaccagaggctttctgtcccaactgtcaaccttgacaaattgtggagtttggtcagtgtaacaag

SEQ ID NO: 3305 - DNA, 194 bp, Homo sapiens
ctggccagtcctacaaccagtattctcagagataccatcagagaacaaacactaatgttaattgcccaattgagttcttcaagcctttaggatgtacaggctgacagagaaggattccgagagttaaatcattctttccaatccagaggaccaggcgttctctctgccaggatccatctaacctggagtaagtt

SEQ ID NO: 3306 - DNA, 184 bp, Homo sapiens
ttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgcgacaagatgcagaggagatacactgccctggcacccag

SEQ ID NO: 3307 - DNA, 155 bp, Homo sapiens
ccaggccacacctagacaaacaaggagaggaggtctcagaatcagaatcatggagaaaattggccgggggtggtttgggttatgggactcattttagaaaggaggccttcctcattctttgagggcaattaaggtttttcggaactcccaagggt

SEQ ID NO: 3308 - DNA, 296 bp, Homo sapiens
ttcggtgtggacatagggccggtctgcttcttgtaaaaacctgaacccagaaacaacacaatccgttgcaaacccgtaaggacccaagtactttccaatctcagtcactctaggactctgcactgaatggctgacctgacctgatgtccattcatcccaccctctacacagtttggacttttctcccctctctttctaagagacctgaactggcagactgcaaaataaaatctcggtgttctatgtatatattgtctcctgtaagaccttcgggtcaaggcagaggcaggaaacta

SEQ ID NO: 3309 - DNA, 257 bp, Homo sapiens
tcttggcatcgactgtttgcacaaggggacaaatgatatgaagcaacagcatgtcatagaaaccttgattggcaaaaagcaacagatatctcttgcaacacaaatggttagcatgattttgaggattgatgacattcgtaagcctggagaatctgaggaatgaaggacattgagacaactatgtagcaggatccacttctgtgattaagtaaatggatgtctcgtgatgcgtctacagttatttattgtcacatcct

SEQ ID NO: 3310 - DNA, 283 bp, Homo sapiens
gaaccagttgttttgtcttgcgggtctgtcagggttggaaagtccaagccgtaggacccagtttcctttcttagctgatgtctttggccagacaccgtgggcttgttactttgctttgaggttggaggcggtttgcatttacgcctgtaaatgtatccattcttaatttatgtaaggttttttttgtacgcaattctcgattctttgaagagatgacaccacattttggttttctactgttatgtgagacattaggcccagcacacgtcattgtgtaaggaaa

SEQ ID NO: 3311 - DNA, 210 bp, Homo sapiens
gaactgggaacagccaggtgccccaaagcaaatacgcggagcttgcttggccattcatttgaaggagcttggggaagggagattcagacccaccgtaacgcaggggaggccaggagttccccattggaggaggcttaaggcgcggcaatcattcacgctagaggactctggttcggggagtccttggcagaaacggaacgcaatgccaga

SEQ ID NO: 3312 - DNA, 206 bp, Homo sapiens
tcatcctgtactgtgtggtgacgtcccctatgttgctggtggctctggctgtctttttcggcagcctgttacaatctctatcctgcgcaaccttgggagtccaaggcttgtgctctttgggccgagaggtgaagcccagcgaatcaagtatgctctggctggaggcatctccttcccttcttctggctggctggtagcgggctcgg

SEQ ID NO: 3313 - DNA, 310 bp, Homo sapiens
gagtcctggccttgtctgtggagacggattacaccttccacttgctgaaaagggtcaagggccttcttgggcttgattccatctgccctttggtggcctgcttgccctgtgtggctgcttgcacccacagctgcttcttgcttgcttgcttaggccccaggcttagggttgtaaggccaagcgtaggatctggaggagtctggacgaggatatctgggattttgggctctctcacctatctacccaaaaggcaaccccactatgcgcaggtttattcgaacacaacggggataatggcgcatctctcctt

SEQ ID NO: 3314 - DNA, 340 bp, Homo sapiens
  misc_feature 41, 42, 43, 86, 87, 88, 89, 90, 109, 110, 111, 112: n = A,T,C or G
ctcgtgccgaattacggcacgagcatggacttttcctattnnntcatcaggaccagtctcagtctggtcaagttgttcctaatttnnnnngcagttcaggctatctccnnnnggggaatgaggccaaggctttctaatctcttggttgtctctgctatatggagagcctgccctaggatggagctctgctatagatctcacatcacactcaggattgaggctgtgatctctctctctgacctctctgaatatgtacagtagtactctagatcgtctgcaatgtgtgagcagatgatatctgaatgtagtagtaatctcttagccatcaaaaaaaaaaaaa

SEQ ID NO: 3315 - DNA, 148 bp, Homo sapiens
catcccaccctctcacagttcggacttttctcccctctctttctaagagacctgaactgggcagactgcaaaataaaatctcggtgttctatttattaattgtcttcctgtaagaccttcgggtcaaggcagaggcaggaaactaact

SEQ ID NO: 3316 - DNA, 341 bp, Homo sapiens
cacgcttgtagtcctagctccttgggagtctgatgtgagaggttgctgagcctaggagttcgaggccgcagttaagctatgactgagccaccgcattccagcctgagcaccagagcaagaccctgtgtcaaaataaaaaggacctatagaggcattagtgcttggggtaacctattagcatgtcctgccagagaggttctagtgccttaacctgggtgctaagagccccccagatgagtggcttccccgtcccttcctctctctggctgctaatgcctcctccccttatagtatatactgataacacttgatcatctctgatctacttcagagctgttctg

SEQ ID NO: 3317 - DNA, 275 bp, Homo sapiens
ccttaagtagacaaggttatagaatctcaagtcatattttgtttcttctttggtaggttttagggtaccttgctgaaatgatttatcctttcacccttttattctgtagttaacttaaaggcatttagttcaaacagccattgtggagttaaacccaaattcattgaaaggttactccacttaatattttgccatttccttgctctggaatatccagctctgcaattttctggccctatgatttgggtaaagtatctctgtccacagtttcctct

SEQ ID NO: 3318 - DNA, 243 bp, Homo sapiens
gtactttccaatctcagtcactctaggactctgcactgaatggctgacctgacctgatgttccattcaatcccaccctcttcaacagtttgggacttttctcccgcctctctctctcaaggagacctgaacctgggcaagacttcaaaataaaatctcgggtgtcctattaattaatgtgcttccctgaaggaccttctgggctaaggcagagcagactctactctggtgtgagtcaatatgc

SEQ ID NO: 3319 - DNA, 370 bp, Homo sapiens
cacactcctagctgctccagtctcagcctgggcagcttccccctgccttttgcacgtttgcatccccagcatttcctgagttataaggccacaggagtggatagctgttttcacctaaaggaaaagcccacccgaatcttgtagagatattcacactaataacatcatgattatttccatgaagtttaaaaatagctcactttaaagctagttttgaataggtgcaactgtgactcgggtctggttggttgttgtttgttgttttgagtcagctgattttcactcccactgaggttgtcataacatgcaaattgcttcagttttctctgtggcccaaacttgtggttcacacaccctgttgagataaagc

SEQ ID NO: 3320 - DNA, 240 bp, Homo sapiens
cctgcaactcagccatcctgacttcccagatggtgaatatggatgatctaacaggttgctcaggagattcctcaaaggttacttgtatttcacatactggtggtgagcctgccattatctccagcacacactctctgggagatgtaggatcttcatcataggcccaagggagacccagaggttggtttgagtatttcatagagggcactcttcttctcatactgagatgtagaggatatc

SEQ ID NO: 3321 - DNA, 341 bp, Homo sapiens
ctcaacctcttctgtcctcaaagaggccaaacgcagtgcccacagtcggtagccttcactttagatgtcctattcatgtaaaagagaaggtgcccccaccaggcttacatcagcattaggcattcctattgcaccgatggtgttcacattttaccccagtgtgtgcccatgtatgcctttgtgccckgtgtatttatggttagcgcccctttcactgagaggggtgatgatacactgtggccacctcgattcacaccccacatttcctgctcgggggagctcccaggtcacaggccatctctcacctccctccaggcacagtggacactgccaccacctcg

SEQ ID NO: 3322 - DNA, 208 bp, Homo sapiens
ggagggcccccctcaagggcatcctgggctacactgagcaccaggtggtctcctctgacttcaacagcgacaaccacttccttccaccttcgacggttgggctgggattgccttaaccggaccactttgttaaggttaatttcctggattaccaccagattttggctacaccaacacagggttggtggacctcatgccacacatggcy

SEQ ID NO: 3323 - DNA, 165 bp, Homo sapiens
ggacacaagatccctttgctggtggtgacttactcacttcccccaccagagggccttgggacttccgaaaccttccgtaacttggaaagcttccttggctcagcttccacttggggggtgaaggaggccgcttccttaagccccaagccttgagcggccttccaa

SEQ ID NO: 3324 - DNA, 180 bp, Homo sapiens
gtcttggctctgccacttactggctgtgtgaccttgacacgtactaactctctgtgttccatgtctcttaactcttaaaccaaggattaaggaggtgaccctaccctccggattactaaggagggttaatctacacgtaacacatacaaacaaaggctctgctcatcttggtcactgtct

SEQ ID NO: 3325 - DNA, 118 bp, Homo sapiens
tgtggttctgctgctgcttactatttgattaccttgggtgctttctctccagctattgtttttatcttacaatttaatatatttcgattttggttaaagccagaatggaccctgataa

SEQ ID NO: 3326 - DNA, 490 bp, Homo sapiens
tgtggttctgctgctgcttactatttgattaccttggtgctttctctccagctatgtttttatctacaattaatatatttcattttgttaaaacagatgaacctgataaatgtgttggcctgtcttaacccaatcctgtagcttttttaatgttgtttatatgttttgggactgttagatattttgccgaattaagtatattttatgatctgcaaaaactcaatgaaaagccaggatttcaaaaccctgagcttacatttttgttctctaattaaggtgtattgtacgagcattgaaagatccaaatgcatttccttttgaccaccttcctactttaaaaccagtcaagtttttggaaggcgagcttattcatgatctttaaccatttttgtgagtgctaaattggatcatatgtcaagtttatcaagataataaagactcattgatcacttggccggtacatgacagatatggaaaaatgagacactac

SEQ ID NO: 3327 - DNA, 141 bp, Homo sapiens
cgcacgaggctggctatgtgtttagagataaggtgatgtcagagtttaataacaacttcccgcagcagatggaagaattacccgaaaaacaacccacactgcttcgatccctggacaaggatgcaaggcagattttaaggt

SEQ ID NO: 3328 - DNA, 200 bp, Homo sapiens
caacctgaaatggattgttttccacaactaagagtcactggggacactgcatatttaaaattgccaggggagtcatttggctgctgagggtttcccccagcaattgttccccagagaggggcaaaagggtccgagagagaaaaggtaagggtctccttgcacaatgtccccatagtgtttcatatgttacatatacactc

SEQ ID NO: 3329 - DNA, 210 bp, Homo sapiens
gcgcctcggaggcgttccagctgcttcaaggatgaaggctgtacactccttccagccactggctgcagagaactctatatgaggtggcgcgtgtgacgcgacaactctctgtatcttctatatagagagcgctatatgcgccacagaggttcgtactcacgcgctctggggtaagagtagtgagagtatattgtgcgccgatcacatgtg

SEQ ID NO: 3330 - DNA, 237 bp, Homo sapiens
aacagacctaaaatcgctcattgcatactcttcaatcagccacatagccctcgtggtacaagcccattctcaatcccaacccccctgaaggttcaaccgcgcagtccaattctcactaatcgccacacgagcttacacaccccactatcatattctgcctagagaacatgaaactcagcgacgcgactcacagatgcagtcactaatcctctctcagaggcatcacatcgactccac

SEQ ID NO: 3331 - DNA, 283 bp, Homo sapiens
ctcgtgccgtaatttaacatactgcaagtgtttacagaaagttggcgataggaagacctatgcctctgccaagctttcctctgagttgccttccagaaggaaggttgaagcagaagttaaagcagcttcagagaatatcaattgggacagagggtttcagaagagagtatatgtcaatatttctgtcatatctgtcacccaggtgtattagatctctctatatcgacccagtctctatatactacaatatcgagtatggctatgcacctatgtacagtcatgt

SEQ ID NO: 3332 - DNA, 367 bp, Homo sapiens
gtcgtaagggctgaggatttttggtccgcacgctcctgctcctgactcacgctgttcgtctcggccgactgacaagtcggtcaaggaaggcatgccgcgaacaagccattggtcttttatagggtacccggaaaacacacccgtggatgccggaggtggcattacccgattgcgattaaccttacacagccgaagcgtaaaatccttggaaagggtgtgcctgcacgagataaggaggcgcaaagaagagtatctcaggtgagggcacagctcgtatgcctacgagactatgagtatcactacaggaacatctcttgtggatgaggctactagacgtggcatcgtctccagatgagattcacagcta

SEQ ID NO: 3333 - DNA, 123 bp, Homo sapiens
gctctctgattagttagtgtagatctgctctgcgtactctgaacttccgctctagttaggaggcctaacagtagccgactctcgtcaaagctcaatatgcctatccctttaaatgtcaatccy

SEQ ID NO: 3334 - DNA, 138 bp, Homo sapiens
gataccatgaacataaaacccacagaggtatttgatgtatctacatgtgacaggagactctgcagataaatgaaggccagactggcatgctctactaattaacctgactaaggagggaggcattattactatactcct

SEQ ID NO: 3335 - DNA, 174 bp, Homo sapiens
gtgggtgagtgagcacagcttcatctgtatttacagctgctccccagagcttgcattactgcctgagctctgcctcccggtcaggtcaagcagcagcattagggtctcaatgggagttccgaaccctgttgtgaacctgccacaatgcgagggatctagggtagtgcgactcct

SEQ ID NO: 3336 - DNA, 144 bp, Homo sapiens
cttccttgaaaactacagtttcactctgctggagatactctggactttctctatctatcgtgaatcagtggctattctgccccaagcttttcatgatcagcaagagctctgagagagctctagagacatatactctctcacatc

SEQ ID NO: 3337 - DNA, 185 bp, Homo sapiens
gcaatagtcatgcccttgtccaggctgggatctaattgatacaataggtcgttgactccctcctagtaggagctatctaggtttgtctggaaagtttccgaccctggcttataggcaccacacctcatgtactcctcatggcttggatctctgtattcagcctttgttcagtccaataaactttg

SEQ ID NO: 3338 - DNA, 262 bp, Homo sapiens
ggaattcctcctgatcagcagagactgatctttgctggcaagcagctggaagatggacgtactttgtcttactacaataatcaacaggagtcttacctctcatctctgtgtgtgagagctctccgtggttggttctctaggaacaggaaggaggaggtctacacaccactcccaaggaggataaggacacagggagagagaggttaagctctgcgctgtcctaaatatattatagggtgggatgagtatgcgcaatattagt

SEQ ID NO: 3339 - DNA, 107 bp, Homo sapiens
aatattttgggtcactgattctttcccattttacctttggacactttatttgatcctcagatcaatttttttttttttcccatttcagacccggtttcgaaatgaga

SEQ ID NO: 3340 - DNA, 520 bp, Homo sapiens
  misc_feature 4, 5, 32: n = A,T,C or G
aatnntttgagtcactgattctttgccatggnagctttgaacactttattttatcgtcagatcaatgtgtgtttttttgccattgcagagccgtgtcaagatgagagggaagcgtagaccgcagacccgtgcagctaggcggctggctgctcaggagtccagcgagactgaggacattagcgtccccagaggacccattgcacagtgggctgatggcgccatttccccaaatggccatcggccacagctcagagcagccagtggagaagacagcactgaggaggcctggcagctgccgctgcaccttgggaaggtggtcctgtgcctggagtggacagaagcccctttgcaaagtctctgggtcattccagaggggaggctgacctttttgattccggggacatcttttccacgggcactggatctcagtctgtggagagaacaaaacccaaggcaaagatagcagagaatcctgccaacccaccagtgggtggtaagcaaagagcccatgtttcctgct

SEQ ID NO: 3341 - DNA, 132 bp, Homo sapiens
ccccatcatgggtccgatgcatgctcccgggaagggccttctcccatcggctttaacctatcgaggcgaagcgtccccaattggttgaagttgaaatctcagcgcgcgtgaaaggagcacaatttacaaact

SEQ ID NO: 3342 - DNA, 347 bp, Homo sapiens
  misc_feature 87, 88, 89, 90, 91: n = A,T,C or G
ctcgtgcgaattcggcacgagttccgcgccagagcccagcgcgcctcgtcgccatgcctcggaaaattgaggaaatcaagggacttnnnnnctcacaagcccgacggaaagcatgccaaatctgtcaaggatcaagaaaaataagggcaaccgtgaaggtttaaaggttcgattgcagcagatacctttacaccccttgtcatcactgacaaagagaaggcagagaaactcgagcagtccctgccccccggttttgcagtgaaggacctcataatgaccacgacacactgatttggacctgtattatattatatactaaatatctcaaaaaaaaaaaaaaaaaaaac

SEQ ID NO: 3343 - DNA, 198 bp, Homo sapiens
ctcccttgccacccgtggcgagtcttcgactacaatactagagttcaggcatctttttttgcaatacgagtttaatttaaaggttagcctttctagatcctctctcattcgcagcatggactcaattattttgtgactctcttaaatgttgccttcttttcttgaggcctgtcaccttactttgaagccctgtttggt

SEQ ID NO: 3344 - DNA, 374 bp, Homo sapiens
atctgccagagcctggagtcttccgaaggccgggacccggttccccggccacagttggggtgtgcaaacccgagagaacttgggttgcaaattcgtgaaggagtcagcatcatgtttggcagcttagtatttgagcgcaagagacctgtccatgtagggtttttagaacagagtgctgtttttagagctctgcagcagcatctcagacgcacgagaagggtatatctcccgaggatgtcatgcgtccagagcactagctgtcatcagagttgagactgctgaactaatcacgtcagtcatcaacatgtggtagtaggcatcgatgtctcatgatgcatcaggacgatcatcatcagcatcgatcgagtatattt

SEQ ID NO: 3345 - DNA, 334 bp, Homo sapiens
gttcgtcagagctctggcagccttcctcaaaaagtccgggaagctgaaagtccccgaatgggttgataccgtcaagctggccaagcacaaagagcttgctccctacgatgagaacttgttctacacgcgagctgcttccacagcgcggcacctgtacctccggggttgcgctggggttggctccatgaccaagatctatgggggacgtcagagaaacggcgtcatgccagccacttcagccgaggctccaagagtttgcccgccgggtcctccaagccctggagggctgaaaatggtggaaagggccaagatggcggccgcaaactgacacctc

SEQ ID NO: 3346 - DNA, 335 bp, Homo sapiens
ggctgcccgcctccgcacagccagtgtcccgctggatgccgtgcgggccgagttggagaggacctgtggcccctaccacaagcagcgtctggctgagtattacggcctctaccgagacctgttccacggtgccacctttgtgccccgagtccccctgcacgttgcctacgttgtgggttaggatgacctgatgcctgtgtactgtggcaatgaggtgactccaaccgaggctgcccaagcgccagaggtgacctatgaggcagagagggttccttgtggacgttgctactcactagcttggatggacacctcctggagcagatgctgagtacctc

SEQ ID NO: 3347 - DNA, 181 bp, Homo sapiens
ctcgtgccgcaagatcaaataaggctatgcttattttgtgctgccaggaactgtagcaactctgtgttcttaggggcacacatgtgttttgcaggccctcctgtcctgggggttcaattctggctatatcctctaaggggcgcaagggtaagggacgcttctgggcccagaggaaaaaaaa

SEQ ID NO: 3348 - DNA, 338 bp, Homo sapiens
gtgacaaggacgcccgaagcacagtggacggtcatgaaggagcgggggtttggcaggcgggttacgtccaggagagggagcgccccttgctgcccctcggccgccgacttgacgcgcgggccttgccagcgagcaccctcatcgggctgtcgcctgacagcatacctcaaaaggccctagctaataaacctgtaagcccagcatttgagagaaggtagggtgtttatatataaaaggttgtgtacacctccacgaggtgaaaaatattcagtaacttgtttacatagcatttgtgtaaagactatgatctcatcccaataaaatgatatattaaccct

SEQ ID NO: 3349 - DNA, 154 bp, Homo sapiens
ctgtaatcccagctactaaggaggctgaggtaggagaatttcttgaaccaggaggtagagtttcattgaagctgagattgagccactgcacatccagacctgtagtgtacaaagatgtagacatctcatctcaaaaaaaaaaaaaaaaaaaaaa

SEQ ID NO: 3350 - DNA, 95 bp, Homo sapiens
gtggagatgacccctccctgtgccggctggttcctctcccttttcccctggtcacggctactcatggaagcaggaccagtaagggaccttcgatt

SEQ ID NO: 3351 - DNA, 175 bp, Homo sapiens
  misc_feature 50: n = A,T,C or G
acaagtttcacaaaagaagcctacaagaagtacatcacagattacatganatcaatcaaagggacacttgtaaggacagaggacagagagaggtataaacccttttatgtacacagggtcttcagagacacactcaaggcacacttctctgtctatattttcacaaaactctccc

SEQ ID NO: 3352 - DNA, 96 bp, Homo sapiens
ccgcggcgcttcccagcaccaacatgtaaccggcatgtttccagcagaagacaaaaagacaaacatgaaagtctagaaataaaactggtaaaaccc

SEQ ID NO: 3353 - DNA, 205 bp, Homo sapiens
tcaagtccaatggcagcgtcttcgtccgggactcctctcaggtgcacccgctagctgtgctgctgctgaccgacggggacgtgcacatccgtgatgacgggcgccgggccaccatctcactgagcgacagttaccgtctgcggctggagggtgactcgcgtaccgtgcggctgctgaaggagcttcggcgggcccttggcgcaat

SEQ ID NO: 3354 - DNA, 168 bp, Homo sapiens
gagacagcatgacgccgaggtggatgccacactcaagtccctcaacaccagattgagagcatccgcagcccccgagggcttccgcaaggaccctgctcgcacactgcagagagacctgaaactctctgcacacctgagtgtggagagtgtgagagctctcttgagatt

SEQ ID NO: 3355 - DNA, 150 bp, Homo sapiens
gcaacctgggcctcaagcatgctgctgcagtgaatggcgccaacccgtggcagtcccagaagctggaggcaggaggatggatcctaatctccatgggaagtgtaagcgtgtggctgcaagggaagcgtggcaggcgcctggccttgggtc

SEQ ID NO: 3356 - DNA, 136 bp, Homo sapiens
cgaaagcagaagggaagctcctgcccctcctaaagcttaaggcaaagcgaggctttaaaggccaaggaggcagtttttaaaggtgttcacagccacaaaaaaggaggaggtccgcacgtcacacccaccttccgcg

SEQ ID NO: 3357 - DNA, 130 bp, Homo sapiens
gagaatttggataaatacttgttgagggttggacaattaaggtagaggaacttagcataagtaatattgaaccctgccctgttgagcagaaaattacttaatagggatttaaagttagttttcttagggg

SEQ ID NO: 3358 - DNA, 540 bp, Homo sapiens
  misc_feature 89, 146: n = A,T,C or G
gagaatttggataaatactgttgagggttggacatttcaggtagaggaactagcataagtaatatagaacctgccctgtggagcagaanattactgaatagggattgaaagtaagttttctgaggggagatagaattaaaattganaaggaaccattgtgaaagtcagtgtggcgattcctcagggatctacaactagaaataccatttgacccagccatcccattactggatatatacctaaaggattataaatcatgctgctataaagacacatgcacacgtatgtttatagcggcactactcacaatagcaaagacttggaaccaacctaaatgtccaacaacgatagactggattaagaaaatgtggcacatatacaccatgggatactatgcagccataaaaaatgatgagttcatgtcctttgtagggacatggatgaaactagaaaccatcattctcagcaaactatctcaagggcaaaaaaccaaacaccgcatgttctcactcataggtgggaactgaacaatgagaacac

SEQ ID NO: 3359 - DNA, 275 bp, Homo sapiens
gggaggccacacacacacactgacatgacagggcttgggcaagactcctgttctacttatccttttgaaatacctcaccctgccactccaccatgtatgatcattccagagatctttgtgactagagttagtgtcctaggaaaaccagaactcagaacttgcctccatggttgagtaacaagctgtacaagaaccccttttattccttggagagggctttttaatgaaacccatgcccagggtttgaaggggtttagcatccactttcaggggag

SEQ ID NO: 3360 - DNA, 135 bp, Homo sapiens
atgaacatagaattgctgcttttatatttaactgcagattgtgaattcactgccttatattatttatttctgacacaacagaagcaatttttaattaaacctactgaaatttttgaaaaaaaaaaaaaaaaaaaa

SEQ ID NO: 3361 - DNA, 240 bp, Homo sapiens
tgaacgcgccacctacatcggaacctccaactggtctggcaactacttcacggagacggcgggcacctcgctgctggtgacgcagaatgggaggggcggcctgcggagcagctggaggccattttcctgagggacttggactccccttacaagccatgaaccttgacaacctcaactgacaagcttgggcaacgcctgccgcctgctctgaggcccgatccagttggcaggccaaggcct

SEQ ID NO: 3362 - DNA, 198 bp, Homo sapiens
aaaagttattaagccacctgattaaaagaaaaccaatatttaaaggcatttaatagatatcaagtataacctttgaggagaagaatcaatctgtattacccaaaaaaaaattgttttcattttctggtaagatacacatgaactcggtacactaaaagtgcaaattttgtgttactcgcaaaaaaaaaaaaaaaaaaa

SEQ ID NO: 3363 - DNA, 220 bp, Homo sapiens
ccgccgcttgttgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggccggagaactcactgaggatgaggtggacgtgt

SEQ ID NO: 3364 - DNA, 200 bp, Homo sapiens
agaagacctcacggcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgac

SEQ ID NO: 3365 - DNA, 180 bp, Homo sapiens
cggcacgaggcgaggtttcaccatgttggccaggctggtcttgatctcctgaccttgtgattcaccaacctcggctctactaaaaatacaaaaagtagccaggcatgatggcgcatgccttaattccagctaccccggaggcttagacgggagaatcgcttggacctcgggaaggagaag

SEQ ID NO: 3366 - DNA, 205 bp, Homo sapiens
gtcgagtccgtgtctcggctgacggcatgctccgggccctgctgggctccaagcacaaggtgtccatggatctgcgggccaacctcaagtctgtgaagaaggaagacacagagaaggagccgcctgttgaggttggttacttgagagaagaacgttgagagccatgtcttgcatatgaagggcccgaagagagatattttgatgt

SEQ ID NO: 3367 - DNA, 273 bp, Homo sapiens
aaaaaacatgagggaagaagaagccaaagctgagcgtgagaagaaagagaaaggaacagaaagagaaaggattaaattaggattcaggagattttattactcattttgggcaccatttcagtgtaaaagcagtcctactctccacactaggagggctttccttttttgacctggtccagtgggaaatttggcatttcacattctgattgggtccttgtcatttctgtccattgattcctttattgtcgcgttgttggttcccttcttgggcgt

SEQ ID NO: 3368 - DNA, 323 bp, Homo sapiens
atacatggatcaggccagtgggaatgtaaagaaggccctgaaggctgattgggtcaaattgagggtgatttcaaggctgagggaaattagcaaattcacctacacagttctggaggatggttgcacgaaacacactggggattggagcaaaacagtctttgattatcgaccacgcaaggctgtgagactacctattgtagatattgcaccctatgccattggtggtcctgatcaggaatttggtgtggacgttggccctgtttgctttttataccccaaactctatctgaactcccaacaaaaaagttttaactccatatgtg

SEQ ID NO: 3369 - DNA, 316 bp, Homo sapiens
cgggagcgcttcgcgagatctcggaccacccaacctgaaaggtgcttaggaagttgaaaggcccaaaggagggcctcccggcaaaatggcccgagccttggaccgaccaattcttcctaacgagaagaagaaattgcctgttgcaagtggcggtaagaaccacgctccagttcctgggggatttcggaccggagagacgcgcagagaaacctctgcccggcctaaagcgcgccccaaaagcaagctaagagggcgcttcttcaaacaagacaatttcgcaatttcgcattaaaaaattggacgacaacttgctggc

SEQ ID NO: 3370 - DNA, 310 bp, Homo sapiens
ggtgcacagactgcaaccgcagcttttctcgttctgaccacctgtccctgcatcgccgtcgccatgacaccatgtgagccgcacaggtcacactagagaagctgcgctggtatctttcctggtcgtgtgctgaggttgggacaattttttcctctttgacttcagcttgcatatggggttgaagcagcccactgagccaagttgaggagactggaggaaaagagagctggtctccgtgggctctcatattctacctcacttctcactgtcagaccgttttttcaacctcacatggttgaattcagtttgg

SEQ ID NO: 3371 - DNA, 330 bp, Homo sapiens
tgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctataagcaggtagcaggtaccatgaagctggaattggctcagtatcgtgaggttgctgcttttgcccagttcggt

SEQ ID NO: 3372 - DNA, 310 bp, Homo sapiens
gcggtgctcgggaaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtacaggcgctgggcctgtccaactacaacagtcggcagattgatgaca

SEQ ID NO: 3373 - DNA, 335 bp, Homo sapiens
ccgggacgtcccagtccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagagctggaggaggagcagcaggccctccagaaggaggttgaggggacagaggatgaggtggaagttatttatccttgaggaggcccaggagaacttgagcaggcca

SEQ ID NO: 3374 - DNA, 300 bp, Homo sapiens
gacccgtgtgcctacgagtccctggtgaaattccaagccaaagtggaggggctgctgcaggccctgaccaggaaactggaagctgtgagtaagcggctggccatcctggagaacacagttgtctaaggctgcctgtcaccactgtggcctctccaagcgtcctgcacatgtccgccgtagctttaccattttagtgagggaagccagcccaggggttggagggggtgttttttggtgtcctattgagagcctgtaatggcgtttgggagctcgtgtgtttatgtgtccgtgtgtttatcc

SEQ ID NO: 3375 - DNA, 330 bp, Homo sapiens
ggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaggaggaaatggctcgtcaccttcgtgaataccaagactgctcaatgttaagatggccttgacaatta

SEQ ID NO: 3376 - DNA, 386 bp, Homo sapiens
gcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgcccgtattatggagatgaaccaatggatttcaaaatcaacaccgatgagattatgacttcactcaagtctgttaatggacaaatagaagcctcattggtcctgatggttctggt

SEQ ID NO: 3377 - DNA, 122 bp, Homo sapiens
gtaataagatgaggaatgaagatgaaatgcgatgatatgatggagatgattttggagtatcgacatgaatgaatattacataacgacgagacgcaatgttaaattagcgacaggattaacga

SEQ ID NO: 3378 - DNA, 400 bp, Homo sapiens
gtcatcagctgcggcatgaagctgaacctggactatctgctggagatgctttgggagtacttggccctgacctgcatctacaccaagaagagaggacctcttccctcgcgcagaatcacaagatggcagtgtgggccctgatgtgtggctgacgttctccccatcctgccctgcagagaggccagacttcacagacgccatcattctccggaaaggggcctcagtggagcacgtgtgccaccgcatccaccggtcactcgccaagccagttcaagtacgccctggtgtggggcaccaagcaccaagtacagtccgcagcgggtgggcctgacccacaccatggagcatgaggacgtcatccagatcgtgaagaaagtaacggcgcctgccgggcctcccg

SEQ ID NO: 3379 - DNA, 322 bp, Homo sapiens
  misc_feature 95, 96, 97: n = A,T,C or G
caaaggaggaagtgaggcgaattctggggctgctggatgcttacttgaagacgaggactttctgggtgggcgaacgagtgacattggctgacatnnnagttgtctgcaccctgttgtggctctataagcaggttctagagccttctttccgccaggcctttcccaataccacccgctggttcctcacctgcattacccagccccagttccgggctgtctgggcgagtgacactgtgtgagaggatggcccagtttgatgctaaagagttagcagagacccaccctaaagaggacacaccacgcagagagagggcttcacggg

SEQ ID NO: 3380 - DNA, 332 bp, Homo sapiens
ccttgccatctggcgctcccatggctcttgcaacatctccccttcgtttttgagggggtcatgccgggggagccaccagcccctcactggggttcggaggagagtcaggaagggccacgacaaagcagaaacatcggatttggggacgcgtgtcattccttgttgccgcaggctgggcgggagagactgttctgttcctcgtgtactgtgttgctgacagactacctcgctcttgtctagatgtgtcaccggggcatctctctggggccggatatggggacaggttggaagcggctccccattatataccagaggtgctacatctatgtaat

SEQ ID NO: 3381 - DNA, 316 bp, Homo sapiens
gaattcggtgtggacatagggccggtctgcttcttgtaaaacctgaacccagaacacacaatccgttgcaaaccccaagggccccaagtactttccaatctcagtcactctagggcctctgcaactgaatggctgaccttgacctgattggtccatcaatccaacctctaacagttcggacttttctcccctctctttctagagagccctgacctgggacagactgcaaaataaactctcggtgtgctatatatatatgtctccctgtaggacctgcgggtcaggacagaggcaggacacttactggtgtgagtca

SEQ ID NO: 3382 - DNA, 218 bp, Homo sapiens
gcaaggtatgctacatggagcctcagctgtctgctccctctcttctgtcagcacagctagcagtcagagacaaatgggctaacccttctcttgagtctctctggagtaaagcctggttgttgtcctccgtggattccatcctgttccagattggtggatagcaaggccttccttccaggcctcttgggagccattgattgagtatcatggttagagag

SEQ ID NO: 3383 - DNA, 270 bp, Homo sapiens
gaataaccacaggcaaacatcaaaacaatacgcataagttcgacaagattaactcttgtctgatatctgcacaaacagatatgcaccatgttggaaacatgtgtctccctagtcccatccaggcttcccacaggaaggccatgatgtgggtctaacccatatgttcggagtaacggagatatagagcagggggagtgtccccaaattggaagagagatgagagatgttccacggatatatgcttgagagcagacgcagtgtattgctgct

SEQ ID NO: 3384 - DNA, 135 bp, Homo sapiens
gaaacttaggtttttccacgcaatcgatggattgtgtcctaggaagactgttctcttcctctcggatctctcgtttcctcctgtacaagggagggtgtcttcagctttggtttgggtggggcctgccggccaact

SEQ ID NO: 3385 - DNA, 244 bp, Homo sapiens
ccaacatgccatccagacttaggaagacccggaaacttaggggccacgtgagccacggccacggccgcaataggcaaagcaccggaaagcaaccccggccggccgcgggtaattcttggttggtctcaataacaaccggacaaccttcggaccaaataccacccaaggcgcttcctttggggaaaggttggaattgaggcattacccacttaaaagagggacccaggacgctctctccccacac

SEQ ID NO: 3386 - DNA, 269 bp, Homo sapiens
ctcgtgccaattcggcagagtggacataggagggtccgagcaggaattcggtgtggacatagggccggtctgcttcttgtgagaacctgaacccagaaacaccacattccgttgcaaacccaaagggacccaggtgacttttccaatcttcagtcactctaggagctcttcacctaatgggctgaccttaccttatgtgccattattcccaccctcttataaggtgcggatcttttctcccctctctctctaggagccctgacttggga

SEQ ID NO: 3387 - DNA, 352 bp, Homo sapiens
aaattacaatactaattcccttaaaaatacaatagattaaacactcttagcaactttccctaattacagaagacagtcgtgtatttaacaattattatttctatgacttctgaaatctcttctcttgaaaactgcattaatctatatatataggctaatgtaataagtgtgattacacactctgttgtagggcgaaacctacatatatgtgtagggccctcccagctgagtgacctacagagtgagtggctacatgatatgtagcatgttctcgccatacatcaggtatgtgacttatagtgtctatcccacgtcataacacctacacgctaaaagcattgccatgtcaaga

SEQ ID NO: 3388 - DNA, 340 bp, Homo sapiens
gcacgagctggtcttgaactcctgaactcagtcattggccaggctggtcttgaactcctgagctcaggcgatccacccaccttgacctcccaaagtgctgggattacatgcatgagccactgtgcccagccaaagcagtcttaaaaagggacaacaaagttggtagtctaactctctcgtattcaatctctatttcacagctatagtgaatttaacacagtgaggctctatatatacacaccctatatagctcattggaccagattcacagtactccagatataatcctctcacatatatggtcatatgattttcaggacacgtgccagacaacatggaa

SEQ ID NO: 3389 - DNA, 300 bp, Homo sapiens
gaagccatgagcagcaaagtctctcgcgacaccctgtacgaggcggtgcgggaagtcctgcacgggaaccagcgcaagcgccgcaagttcctggagacggtggagttgcagatcagcttgaagaactatgatccccagaaggacaagcgcttctcgggcaccgtcaggcttaaggtcactacccgccctaaggtctctgtgtgtgtcctgggacacgacagcacattgtacgcgacttaaggccgtgatatatcccacacatggcacatcggcgcttgaaaactctcaacgagtataaaa

SEQ ID NO: 3390 - DNA, 350 bp, Homo sapiens
gaatgatccgggctttagaattggacccaaacttgtacagaattggacagagcaagatatttttcagagctggagttctggcacacttagaggaagaaagagatttaaaaatcaccgatatcattatcttcttcaggccgtttgcagaggttacctggccagaaaggcctttgccaaggaggcagcagcatctaggtgccttaaaggtcttgcagcggatctgtgccgcgtacctgaacttacggcactcgcagtggtggcgagtctacacagaggtgaggcgcttctacaagtgactcgccaggaggaggacctacaggccagagatgaagagctgttgagggtgagga

SEQ ID NO: 3391 - DNA, 343 bp, Homo sapiens
ggcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgagacatctgacaagatgactcccaacagtccctctatcacatatgacatcagtcagttgtttgatttcatcgatgatctggcagacctcagctgcctggttaccgagctgatacccagacataccagccttataacagagactggattacagagaagatctacgtgctcctgcgtcggcaggcacaggct

SEQ ID NO: 3392 - DNA, 289 bp, Homo sapiens
agggacactttcacttgttttgacacagtgctgtaaaagaataaaggatactgttcaaaaattggcctccgaccacaaagacatccacagcagtgtttctcgggttggcaaagccattgataaggattcactttaagagatttggaaactcttcccttttggacttgctcttccatgcagaggtgcaatttatcactgtccgtaacaagcctgcctaagacttgccagaggctgtgtgcgctcttgatgagcggcagagccttccaagcagggccgtcaagggacactt

SEQ ID NO: 3393 - DNA, 149 bp, Homo sapiens
tttaactaatcctccgtcctctatttgtgttgtctcccattttttattattacaatattactgggtgaacatgcttaacaatacattccttggatatctgacaacgtgtttctgaaaaacagattttcataagtaataataaaaataat

SEQ ID NO: 3394 - DNA, 267 bp, Homo sapiens
caaacctgcacacgtaccgctgaagctaaataaaagttttttagaaaaacagcatgcccacttaaataaatctaccctagagacatacctgcacatttatgaaatagcataagcccattattctttgtacataatttatattaacaataatatccatcaagagactaggtgaacaaatacacaacggagcactttgctacctcttaaaaaagaccgagagaatctcacgtgtagagtagattgggattaatctcatacacccttttc

SEQ ID NO: 3395 - DNA, 357 bp, Homo sapiens
ccgcaggcgggagaggaacgcagcagccagccttgggaagccaaagaccgggcagccatggcggtggaaggaggaatgaaatgtgtgaagttcttgctctacgtcctcctgctggccttttgcgcctgtgcagtgggacttgattgccgtgggtgtcggggcacagcttgtcctgagtcagaccataatccagggggctacccctggctctctgttgccagtggtcatcatcgcagtggggtgtcttcctcttcctggtggcttttgtggggctgctgcggggcgtgcacggagaactattgtcttatgatcacgtttgccatctttctgtctcttactcactgttggtggaggttg

SEQ ID NO: 3396 - DNA, 347 bp, Homo sapiens
gggggagtgattgatttagaattgtgtgctcatgttggaagtgacaagtcatttttcctcctcagctctagattcttgatgtgtagcttagttggattagaacgctgaggtttataatgtatttcttattcgataggttgacacaggtgtgtgttaagactcattatactgttgtctacgatttctccctattctgagtgcctcagatttatgttcatcaatcaaatagtgtcacaataatgagatgtcttcatattaatcgatgattaactacacaagaggtggcaatacctcgctgcctctgtgttttctaagggtatgtctcccagggccgcctgcatggctat

SEQ ID NO: 3397 - DNA, 334 bp, Homo sapiens
atttacatgggaattgatcctgtgaccagaactgaaatattcagaagcggaaatggcactgatgaacattggaagtgcacgactttaaaacggatacactggcatctacttcgtgggtcttcaaaaatgttttatcaaaactcagattaaagtgattcctgaattttctgaaccagaagaggaaatagatgagatgagacattaccacactttctttgacagtcagtgatttgggtcccgcagaaagcctattgaaaccgagattttcttaaaagctccaaattctggagatttgtgatacgtgcctgtatggctcaatccactctatatcagt

SEQ ID NO: 3398 - DNA, 344 bp, Homo sapiens
cgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaggtcactgtgccagcccagaacactggtctcgggcccgagaggacctcctttttccaggctttaggtatcaccactaaattctcaggggcaccattgaaatcctgagtgatgtgcagctgatcaggactagagacacagtgggagccagcgagcacgcttgctgaacatgctcaacatct

SEQ ID NO: 3399 - DNA, 231 bp, Homo sapiens
gtcgcatttggccgcctccctaccctccaagcccagccctcagccattggcatgccccctggatcaggccattggctcctcgtggccatcttccacaagtactccggcagggaggggtgacaaggcacaccctgagcaagaaggagctgaaaggagctgatccagaaggagctcaccattggctcgtagctgcaggatgctgaaattgcaagctgatggaagacttggacc

SEQ ID NO: 3400 - DNA, 250 bp, Homo sapiens
gacaaaaattgcggtgcagtgtatactgctcaggggatgggtgctaccaaaatctcacaaatcaccactaaagaagttaaccaacaccacctgttccccagtaacctatggaaagaaagaaatgtctcatatgtttctgcctaaattgggctttaatactttagcgactctcttgagtttggactataaaataggtctggtcttagagcatatgctactgtaagcctactatgattatgtcatcgtgagg

SEQ ID NO: 3401 - DNA, 325 bp, Homo sapiens
aagattctggacaagtgtaatgaaattatcaactggcttgataagaatcagactgctgagaaggaagaatttgaacatcaacagaaagagcttgagaaagtttgcaaccccatcatcaccaagctgtaccagagtgcagggggcatgccaggaggaatgccttgggggatttcctggtggtgagctcctcctctgtggtgcttcctcaggcccacattgagaggttgattagccaccaagtgtagagtgcatgttcacacattaaacattgaggactaattgtgcaatcttgcagtttaaagtagctgcatagtagtactggcat

SEQ ID NO: 3402 - DNA, 280 bp, Homo sapiens
cgaggaaggcattgctgctggaggtgtaatggacgttaatactgctttacaagaggttctgaagactgccctcatccacgatggcctagcacggtggaattcgcgactgcccaaagccttagacaagcgccaagcccatctttgtggtcttgcatccaactttgatgagcctatttattcaagttggtggaggcccttgttctgacacaaatcaacctatttaggttaatacacagatctaggaatggtagccttttaaattacagagggaacccctaag

SEQ ID NO: 3403 - DNA, 195 bp, Homo sapiens
aaggacaagcgcttctcgggcaccgtcagcttaagtccactccccgccctaagttctctgtgtgtgtcctgggggaccagcaggcactgtgacggggctaagggccttgggtatccccaacattggccaccggggcgcttgaaaaacctcaccaaggattaaaaaccttgtcaagggcttgccaaggaggttatc

SEQ ID NO: 3404 - DNA, 226 bp, Homo sapiens
attgatgttcctttgggtctgtgaggttctgtaaactgtgctagtgctgacgatgttctgtacaacttaactcactggcgagaatacagcgtgggacccttcagccactacaacagaatcttttaaattgacagttgcagagttgtggagtgtttttacattgatctcttgctaatgcaattaggattatgttttgcatgtatgactcaataaatcctcgaatcat

SEQ ID NO: 3405 - DNA, 240 bp, Homo sapiens
gttgacattctgaatgcttctaagtaaatacaattttttttattagtattgttgtccttttcataggtctgacatttttcttcttgaggggaagctagtcttttgcttttgcccattttgaatcacatgacttattacagtgtttatccttcatatagttagctaataaaagcttttgtctacacaccctgcatatcattattggggttaaggtaagttgagatagttttcatccattac

SEQ ID NO: 3406 - DNA, 203 bp, Homo sapiens
gtacggggtgtggcatgaatctgtggagcatcttttgaggtcgcaccacagcacatcggcaagcctcaccatccgcagagatgccctgctggccgcaaagtaggtctcattgctgcccgccggactagacgtcttcggggaacaagactgtacaggagaaagagaactagtgctgaggggctcaataaagttgttgttaatgc

SEQ ID NO: 3407 - DNA, 210 bp, Homo sapiens
aagaaactgccgaggatggagaggaggaagatgaaggggaagaagaagatgaggaagaagaagaagaggatgatgaagggcccgcgctgaagagagctgccgaagaggaggatgaagcggatccaaacggcagaagacagaaattggggcatcggcgtgaccctgcccaacaggcttgggtttgggaggcctctcttggccttgaggttg

SEQ ID NO: 3408 - DNA, 220 bp, Homo sapiens
gaaagatttacacacggtgacctgtcataggccaagcgatgagaagagggcgccaggagcctggggtcccgaggtggctcagatggaagccatgggacggccgtcccaggcccgcgcacccacacctcagtttcccctctgtgaaatgggagcttatgcttcttccaagtctgctcgtgccgaattcgcacggggccacggaggaaagaggaaagaagac

SEQ ID NO: 3409 - DNA, 240 bp, Homo sapiens
gtggagaggatctcagcatatttctggaagatagaaagtggatgaagcatgataatgacagagtgaagaacctttcagataaaatgtaagctgatctgaacaacataaccccaaagagacttgcgcacctcacaagcttgtctactgaggagttactccagttgtaagattgagccctctcctactctccccaaactcttatgcacaagacacaggcagtctccactattgataccagtt

SEQ ID NO: 3410 - DNA, 279 bp, Homo sapiens
agaccctcaccttccttctgcccatcttccatgttgtaaaggaacagccccagtgcactggggggaggggagggagtgaggggcagtggtgcctttcctgcagaagagacatgcagcagtagcgctggcgccatctgcaggagctggcgggctggccttctggaccctggcttctccccactgtaacgcctgttacacacaaactgttgttggttcctgccaggcttgagaaaatgatctgaattttttcctcctcttggtttattttgttggttattt

SEQ ID NO: 3411 - DNA, 360 bp, Homo sapiens
gagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatggaagtcctggcacagtttttggtaagcccttgcacagctggaggaatggcatcattataagctatgagttgaaatgttctgtcaaatgtatctcacatctacacgtggcttggaggcttttatggggcctgtcaggtagaaagaattggtatttag

SEQ ID NO: 3412 - DNA, 331 bp, Homo sapiens
ccggcctgggttggagggagcggatgggtgtagggcgaggcgcctcccgccctcggctggagacgaggccgcagaccccttctcacctcttgagggggtcctcccctcctggtgctccctctggtccccctcgttgttgtagcagcttaactgtatctggagccaggacctgaactcgcacctcctacctcttcatgtttacatatacccagtatctttgcacaaaccaggggttgggggagggtctctggctttatttttctgctgtcagaatcctattttatatttttaaagtcaggttaggtataaccttattatgaaggtttttttt

SEQ ID NO: 3413 - DNA, 335 bp, Homo sapiens
cacctgccccagagcccgtttgtggctgagtgacaacttgttccccgcagtgcacacctagaatgctgtgttcccacgcggcacgtgagatgcattgccgcttctgtctgtgtgttggtgtgccctggtgccgtggtggcggtcactccctctgctgccagtgtttggacagaacccaaattctttatttttggtaagatattgtgctttacctgtattaacagaaatgtgtgtgtgtggtttgtttttttgtaaggtgaagtttgtatgtttacctaatattacctgttttgtatacctgagagcctgctatgttcttttttggtgatcaaatt

SEQ ID NO: 3414 - DNA, 245 bp, Homo sapiens
  misc_feature 40: n = A,T,C or G
ctcgtccattttcggccagggaaaaaaaacagaaaaacanaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaaaaatataattaatttgtaagtctgaaaaaaaatatttaat

SEQ ID NO: 3415 - DNA, 102 bp, Homo sapiens
gcctggctggctttaagatttatgcatcctaacatttcttcacctactaacatgagttgtcaagtatgatatctgatctaatcctacatgattttctatttt

SEQ ID NO: 3416 - DNA, 191 bp, Homo sapiens
ccacctctctcctcttaacccctcctccacagctgcagcccatcctcccggctccctcctagtctgtcctgcgtcctctgtccccggggtttcagagacaacttccaaagcacaaagcagtttttccccctaggggtgggaggaagcaaaatgctctgtacctattttgtatgtgtataataatttgagat

SEQ ID NO: 3417 - DNA, 260 bp, Homo sapiens
aagggtgtgggcaccagatactgctacaccatctcatcggcatggacctatatgtggcagcaagtccatctcatcgcttttgggtgaaagtcagtccagtttgtaaagattctcattgtcactgtagacgaggactgggacaccaaaaggagaacctctggccacacttgcaccctgttccaaatcctggtccagtgtcaccacagatggtaaggagctctagagacctcaccagccctgggattggtcacctcactctc

SEQ ID NO: 3418 - DNA, 202 bp, Homo sapiens
gttcgtcagggatgctctgacaaccaggtgtcgtccacgggcgggggcatgggcatggtgacagtggtcctgttgatgtaaccgatgatgctgagcgcctccttcaagcgcgtggtgcatgtgcagcatctcgtcgtgctgctgtgcctgcttgcaactcctccatcagtgtgtctggtcccacataggtacatattggcaa

SEQ ID NO: 3419 - DNA, 253 bp, Homo sapiens
ttgagagcttctcagactatccacctttggctcgctttgctgttcgtgcatatgagacagacagtttgcgggtggggtgttcattcaaaggcaggttggacaaggacggcttgcttgggagcttgggcaaggttcacccaaggtcttgccccaggaaaggttcaggaggggttaaattggaattattcattccctaattaccctggccaaccccacttcttaaattcagttggtggaaggaaccggttttcag

SEQ ID NO: 3420 - DNA, 340 bp, Homo sapiens
cgccatcttccagtaattcgccacaatgacgaacacacagggaaagaggagaggcacccgatatatgtttctctagggccttttaggacaaccatggagttgttccttttggccacatatatccgaatctataagaaaaggtgatattgtagacatccaagggaattgggtcctgtccacaagggaattgccccacaagtgttacccatggccaaaccttggaggagtctccattgttcacccagcatgctgatgggcattgttgtacaccaaccaggttaagggccaagtatctcgccaagagatttaatgtccgtattgagccaattaggcactttag

SEQ ID NO: 3421 - DNA, 372 bp, Homo sapiens
cgctcctgatgatcacgtataaaagtcaggtgttcagctatcctcaccgctacctggtcctcgatcttgctctgctgtttctgatggggattctagaggcagttcggttatacctgggcaccaggggcaacctgacagaggctgagaggccgctggcgccagcctggccctaacggcttggcaccgcccttctctctcccacttcctgctttggcaggccctagtgttgtaggcggacttgggccctaagcgcaacgttcctggcccttaacggccttgaagcctcctacaggtggttgccatcgcggccttcacaggtagctacggacaccgggatacccacaatggggccctcctcctgggctaacagtc

SEQ ID NO: 3422 - DNA, 240 bp, Homo sapiens
ttagtaggggagagaagagttaaatctcccttatagaggagtctaaatcattatgtagatactcccccaacagacatggaccattactccccacctgctaagtgttgggctctgcttagtggctgcttccaaagagtgcaatatggggccgggcgctgtggctcatgtctgagctctagacctttgggacgccaaggacggtggatactttacggttaggagttggagaccagccttggc

SEQ ID NO: 3423 - DNA, 197 bp, Homo sapiens
acttgaatacaccatgggactcacggagtacactagtgatactggagtgctccaggaggagagatatgtcatgatgttacaaggaaaagtcaaattgcttgatatgcatctgagagtgagtgcattctatgtttgcctgccatttaaggtaaatgagttcagcatacatgactatagtgaaaaaaaaaaaaaaaaac

SEQ ID NO: 3424 - DNA, 162 bp, Homo sapiens
actattataagttataagcctatcttctgccttatatactacattttcttggtttaagattcttccctcaaaaccacatttaaatcttttctgaatttagggatggcttctgaaattgggcatttttttttaactcgaaggttaaaaaaaaaaaaaaaaaac

SEQ ID NO: 3425 - DNA, 300 bp, Homo sapiens
gctgtgtgcggaccaggagtgcagccaccctatctccatggctgtggccttcaggactacatggcccccgacttgccgattcctgaccattcaccgggggccaagtgggtgtatgtcttctccaagctgaagggcccgttggcggctcttctctgggaggcagcgttcagggagagtactatagagatctcgctgctcgcctcgggctatattcccagtagcagatgtctcgacgagagcacgacactcatacatctgcagagtcgatgtgagacagacacatagtagtatctactacta

SEQ ID NO: 3426 - DNA, 325 bp, Homo sapiens
agagaacaacattcctctctgtcaacatcgagaggctttaaaacaactgtttagtggaaactttctgagagatgggaaacaagcttctggtgggtgcattttcttggcccggagttgccttcatccacgctacttgccccctgtcccccggcccccccagatttgtacggttgcaacagatgattcctctttctctgggtttaaatttctcagcagcatgatagtgctctggggacagcacacagtagaggagtgtctcgtcacactgtctcgcacacagtaggggctcatatatatgtgttcacttataaaaaaaaaaaaaaac

SEQ ID NO: 3427 - DNA, 305 bp, Homo sapiens
tttgcatccttcaatgacacttttgtccatgtcactgatctttctggcaaggaaaccatctgccgtgtgacttgttggatgaaggtaaaggcagacccgagatgaatcctcaccatatgctgctatgttgggctgccccaggatgtggcccagaggtgcaaggagctcggtatcaccgccctacacatcacactccgcggacacacgaggagataggggcacgagccctcgagctcggggccagtcggccctctagagagcctttccgctctcggtatatgatcgcgcgcagtgaggatgatcac

SEQ ID NO: 3428 - DNA, 190 bp, Homo sapiens
attttgtcaaatgcttattttctgcatctattgagatgatcatgtggcccgtgtccttattaatataggtgtgggtacacttgatcttcagatgttaaaacaaccttgcacttcttggagagcatcctctgctttgttatatgcgtatagattcccgtctatatagttgctcgagtctgtgcttctgata

SEQ ID NO: 3429 - DNA, 169 bp, Homo sapiens
  misc_feature 25, 26, 27: n = A,T,C or G
gacagatccacatcatggaggttgnnngggtgctgcacatggttcgttatggctatagcgactatcaaggtcaagcaggttgaagcagcagcttaagacaaggagctctctctgaagggtctgtatttttccaaggacctctatatacctagggggttaagatattttt

SEQ ID NO: 3430 - DNA, 232 bp, Homo sapiens
aggaaactaactggtgtgagtcaaatgccccctgagtgacttcccccagcccaggccagaagacctcccttcaggtgcccgggcgcaggaactgtgtgtgtctctacacaatgtgtgtctattctcgttgttcaaacacactctcgtattttttttaaaccatacacattgatatataaaaatgtagaaagagttatattgagaagtgaaaaaaaaaaaaaaaaaaaaaaac

SEQ ID NO: 3431 - DNA, 330 bp, Homo sapiens
agaaaattcacacatattcccaacacccaacaacaattaactgttaacatcttgatctgtgcactagtctgtgattattagggtgttagtgataagtatgcataaatgtcaaagatgggaagacagatgaaaaacaagacatagttgtgtggttgttgtgtggattatggttattttgtttcgggtttccttgacaggtcatcatactagtgtttttggtagtgcacctctactacatatatctccactatatatgacgcgtgttcactatagagactctgaagtgacagcagatgttgagagagactcaccactgttttcaccatccac

SEQ ID NO: 3432 - DNA, 545 bp, Homo sapiens
ctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgccctccggagccctcgggtgagccgccggggcccccttctgccagcctcccgtccccaacatgcagtctactctgggtgtcttgtctttatttttgtaagtgtcattgtataactctaaacgcccatatagtagcttcaaactgggaatagcgctataaataactcagttctgcagcccccaaaaaaaaaaaaaaaaaac

SEQ ID NO: 3433 - DNA, 346 bp, Homo sapiens
cagcaggcgcaccaagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgacaacctaaaaaaaaaaaaaaaaaa

SEQ ID NO: 3434 - DNA, 460 bp, Homo sapiens
agagaggggctacaaaaagaccaggatgcctgtgtcgccatgagatgaaggctacaactcaagacaagtttagagaatagccatggccttcaacctacgtaggagaggtctcaaacacacactggctttcaaccggccgcatttctctccctgtggcaagccacttctggagctaaagagatgatgccttctcatgcttccctctttctagagtccatgcttccctctttctagaacattctccaggtacaagatacacagcattccttcttcacagtatccctaccctgcttccaaagcctgagtgacccctttctcagctcaatcctcctcaacattgaccatcctacttggtaggtacccttgggccttagaagtgatgagctgttggcaaatgttgaatgggtaagtaggaatgtctattcaatgattagggcttctttggtaagttgtggtgttc

SEQ ID NO: 3435 - DNA, 210 bp, Homo sapiens
cccaattggaccaatctatcaccctatagaagaactaatgttagtataagtaacatgaaaacattctcctccgtcataagcctccgtcagattaaaacactgaactgacaattaacagcccaatatctacaatcaaccaacaagtcattattaccctcactgtcaacccaacacaggcatgctcataaggtaaggttaaaaaaaaaaaaa

SEQ ID NO: 3436 - DNA, 261 bp, Homo sapiens
ctgcgtctgcctctgtcgtgtgtgctgatttgagtggcttagcttgccacagcgcaacctcttctgtccctttcagtcaatttgctgtatttccctgtggcacgttaccatggaagccgctccagggtgggtccagggtgcaagctgctggtgaggtttgggaggcatcagggctcacgggtgttcatgtgtgttcgtgcgtgtgtgtgcgtacgtgtatataactgaaagtgtctgtacggagtgccctttgctagccat

SEQ ID NO: 3437 - DNA, 372 bp, Homo sapiens
agaatcttcagtactacgacatttctgccaaaagtaactacaactttgaaaagcccttcctctggcttgctaggaagctcatttggagaccctaacttggaatttgttgccatgcctgctctcgccccaccagaagttgtcatggacccagctttggcagcacagtatgagcacgacttagaggttgctcagacacctgctctcccggatgaggatgatgacctgtgagaatgaagctggagcccagcgtcagaagtctagttttataggcagctgtcctgtgatgtcagcggtgcagcgtgtgtcccacctcattattatctagctaagcggaacatgtgcttcatctgtgggatgctgaaggagatgagt

SEQ ID NO: 3438 - DNA, 126 bp, Homo sapiens
cctcaacaagggccacaaatgtgatccaagtgcgtgatcaagcccaggcatctatcgactgctgtctgtgtggccttgatcctaatcataacccatgggccggtctgggacaatgattctgggatg

SEQ ID NO: 3439 - DNA, 220 bp, Homo sapiens
aaatattcaactctttcaacaattgctctgaaatatgtaaagagagaaagaaatctaaattacctagactttattattggtcctagatggttgtcactcccctcaaatttatacagaaaagttttatgaggttcaaataatgctcatgttgcaaactatgtgggatcccctagaaacagaattttttatttggcaagggccctttgaggcatttatatct

SEQ ID NO: 3440 - DNA, 223 bp, Homo sapiens
gtcaaccgtacaatggtgtgggaatgacgatgatgtgaatatttagaatgtaccatattttttgtaaattatttatgtttttctaaacaaatttatcgtataggttgatgaaacgtcatgtgttttgccaaagactgtaaatatttatttatgtgttcacatgggcaaaatttcaccacttaaaccctgcacttaggtaggaccccatttttaaagagttaac

SEQ ID NO: 3441 - DNA, 195 bp, Homo sapiens
tcgggaagttctgcgcatgcgtggcaccatttcccgtgaacacccatgggaggtcatgcctgatctttacttctacagagattcctgaagaggatttaaaaagaagagcaggcttgcttgcttgagaaggcagttaccaaggagggatttcaaggtgaatttgactttcttccgctctctctagttcactttctc

SEQ ID NO: 3442 - DNA, 110 bp, Homo sapiens
actgccatcagggttgcattggctgtcgctgtgctcaaaactgtcattttgggacttctgtgcttcttcttcctttggtgaggaggagggaaggtagcgaggcgcgccag

SEQ ID NO: 3443 - DNA, 157 bp, Homo sapiens
ggactggcgcgttgctatcgccgaggggtacagagacgccctaggccgtgttctctggaagatcccgaggggggagacaacaagcaacagcggggggcagagaacccaagacaaacataggcccttttggggagggggagcacacgaagataggttc

SEQ ID NO: 3444 - DNA, 167 bp, Homo sapiens
gtagagcagaagaagaagcggaccttccgcaagttcacctaccgcggcgtggacctcgaccagctgctggacatgtcctacgagcagctgatgcagctgtacagtgcgcgccacgcggcgggctgaaccggggcctgcggcggagagcactccctgctgtagcgcct

SEQ ID NO: 3445 - DNA, 187 bp, Homo sapiens
gccagctataaggggaatccctgtccttgagaggctcatagtctataagtaacattacagaatttgttagcatacccattcattattagttttacctaaacgtgttaggatcactactggtggaaattgtaaccagcctttgggcatcttaaagggtgacatgtggcatgycctttttttttttttt

SEQ ID NO: 3446 - DNA, 205 bp, Homo sapiens
agatcttcgtgaaaacccttaccggcaagaccatcaccctttgaggtggagccagtgacaccatcgaaaatgttaagggccaaggattccagggataagggagggcatttccccccggacccaggcagagggcttcatcttttgccagggcaagcaggcttgggaggatggccgctactcttttcttgtcctaccaacaatccca

SEQ ID NO: 3447 - DNA, 194 bp, Homo sapiens
cgcggactgttctagtgagggcatccgggtgaccgcaatgaggagaagcgcatcactgaggcagagaagaaccgagcgttttccagcggccactcttgaacgctgtagccagcgagcttttcccagggcccgagatgaggattaagagggacccacaattgacatcattcaccaacgaggaacatgaggcaagg

SEQ ID NO: 3448 - DNA, 214 bp, Homo sapiens
gggaagatggcggacattcagactgagcgtgcctaccaaaagcagccgaccatctttcaaaacaagaagagggtcctgcttgggagaaacttggcaaggagaagctcccgcggtactacaagaacatcggtcttgggtttcaagacatccaaggaggctattgagggcacctacattgaccaagaaatgccccttcatggtaatgtgtccatcg

SEQ ID NO: 3449 - DNA, 315 bp, Homo sapiens
ggcgacatggccaaacgtaccaagaaagtcgggatcgtcggtaaatacgggaccgctatggggcctccctccaggaaaattggtgaagaaaatttgaaatcagccagcacgccaagtacactttctctttctgtggcaaaaccaagatgaagagacgagctgtggggatctggcactctggttcctgcatgaagacagtggctggcggtgctcgaacgtacaataccacttccgctgtcacgctaaagtccgccatcagagactgagggagttgaaagacagtagacgctctctactctctgagacatcactggc

SEQ ID NO: 3450 - DNA, 198 bp, Homo sapiens
gccgagcgatgggcatctctcgggacaactggcacaagcaccgcaaaaccgggggcaagagaaagccctaccacaagaagcggaagtatgagttggggcgcccagctgccaacaccaagattggccccgccgcatccacacagtccgtgtgcggggaggtaacaggaaataccgtgccctgagggtggacggtgggga

SEQ ID NO: 3451 - DNA, 207 bp, Homo sapiens
gacgactcccggaggctggggaagttctgcggcgacgagtcccgggctccatctcctccgaaggaattgaactcctcggtccagttcgtctcagatctcagtgtcaccgctgatggcttctcagcctcctacaagaccctgccgcgggggcacttccaaagtagggcaagggcccgccccaaacgggggactgaggctcaagtgaag

SEQ ID NO: 3452 - DNA, 187 bp, Homo sapiens
ctaggagactgaggcaggaggatcacttgagctcgggagtttgaggctgcagtgattcatgattgcaccactgccttccagcagcctgatgacagagtggggatccctcgtgccgaattcggcacgaggctgagatccccaaggcctttcctacaaagccccctcccttcacaagggggacagagaa

SEQ ID NO: 3453 - DNA, 164 bp, Homo sapiens
gggaaactaagaaatggttgacagcgttcccacccatctacaatgttattttaggtgctttgtggtaagtcttttttcttagattgcgctaaaatttcttagattgttcagcgctcagaacaaaagtttgaaaaatgcatttgttcatatatgaatgtcatctc

SEQ ID NO: 3454 - DNA, 366 bp, Homo sapiens
gaagcacctcagacctcttctccctgcccatctgctgacattgacatgaagacaatggagactgcagagaaactggctagatttgttgctcaggtggggaccagagatcgaacaattcagcatagaaaacagcaccgataaccctgacctgtgggttttacagaaccaaaatagtttttctttcaaattctatcgaagaagtgttttactatgtccaccaatttgtttcacgggatcttcgcacaacctccacactgtggtggtgacacacgggggtgtcatgagagcccctcgacctctatgatgggggaggcagaggtttttagacgggcccctccctcggagggtatcttgtgagccacacgt

SEQ ID NO: 3455 - DNA, 259 bp, Homo sapiens
cagggcactcctaatctctggttgttctttcctcagccttgagtagttcctcatgtgcatgtgctgatcttactccatggaatactcaaaggggggacctcttaagatcttgagttttttctgttgcagctctcacctgtctagtactttgtcctgtgaactgtagctactttgggctccctcgatgttttgcactatcctcctcagctcagtctgctaagctctgtctcggggttcccttccttgccctatggcgcga

SEQ ID NO: 3456 - DNA, 275 bp, Homo sapiens
tcgtgccgaaattcggcacgagggcggcgcgcccctcgacaaggtggtcttcgggatccgtatcggtttaaagaagcggacggagtttctcattggccgccgaggcatgcacacgggccagtttgtgtattgcggcaggaggcccagctcaacattggcaatgtgctccctgtgggcacatgcctgaggatacaatcgtcgtgctgcctggaggagaagcctcgagcccgtcgcaagctggcccgggactcaggcactgtgcccaggttctctcc

SEQ ID NO: 3457 - DNA, 321 bp, Homo sapiens
gcggtcgtaagggctgaggatttttaggtccgcacgctcctgctcctgactcaccgctgttcggctctcgccggaggaaccaagtcgggtcagggaagccccgcgcgcaccacccattggctttttaagggatacccggaaaacccaccccgtgggatccgggagttggcaattaacggaattcggattcacccttaacaggccgcaccgtaaattccttggataaggtgtgtcctgactcgataggaggcgcaaagaaagactctcaaagtgaaaggcccagctcgtatccctaccaagactttgagaatcactacaaga

SEQ ID NO: 3458 - DNA, 223 bp, Homo sapiens
agatggcggaggtgcaggtcctggtgcttgatggtcgaggccatctcctgggccgcctggcgccaatccggtggcttaaacagggtaccttcttgggcccgaagggtgggtgggtccgtaccgttttaagggcaataaccaatttcttggcaattttctaccagaaaacaaaggttgaagtacccctgcttttcctccccaagcgggatgaacacacaacccy

SEQ ID NO: 3459 - DNA, 245 bp, Homo sapiens
cttgctcctaagcctgcagatggcctattgtgggaccttgtgattgtgagaattaatacttaataaactccccattacatacatatatctgttctttagttctgtccccttagagaaccctgactaatacacctctttttctcgtggaacaataaaaaaataactttaggggcccccatatttttagacagattcagcttagcccatatttttgagggtccccctgtgtactcgacacttgaaca

SEQ ID NO: 3460 - DNA, 226 bp, Homo sapiens
agtcccccgttgcctcttcaaacctacagcttctctttgccatttgtggatttcacatcactccacacagaaacattacagcctggcatccccagtctttgcctttttccagctgcctcgacacaagactgtggcctgtccctatttgccaggcacgccatttcaagggcaggaaggggcagtgtcctccaagcccacctttctgtgcacgctcttaggggaggtg

SEQ ID NO: 3461 - DNA, 235 bp, Homo sapiens
gcggcccttcctgcagcgcctgccgccccggggactcgcagcacccacagcaccacgtcctcgaattctcagacgacacctggagactgtcccgacacagcgacgctcccctgagaggtttctggggccccctgcgtgccatcactcaaccataacacttggatgccggttctttcaatatttatttccagagtgccgaggcagcagacacgccctcttagtgtggggcttattd

SEQ ID NO: 3462 - DNA, 247 bp, Homo sapiens
gcactgccaagactgagtggttggatggcaagcatgtggtgtttcgcaaagtgaaagaaggcatgaatatttgtgggaggccatgggagcgcttttgggtccaaggaatggcaagaccaacaagaaggtcaccattgcctgactgtgggcaactcacgataaagtttgacttgtgttttatcttaaccaccagatcacttccttctctaggtcaggggagcacccctcccccccatttgctcgcagg

SEQ ID NO: 3463 - DNA, 364 bp, Homo sapiens
cttcaggtacaggtctacttgacactaaagttcaagaactgcaattccaaattcctgagcccatgaactttttccccctagttttgtctcagccaacagaaccagccatggagctcgctggggtaacatttgctctctggctcactgactttctagacttcagggcatattcacttcgatacattgtacaaattaattttgtttctaaaataggagtggtaaataaggatgactaggggcaagtccctgatttttatgtgctaaacatttatggaaatatttacagttttaagtcaagggtggcagggccttgggaaggcgttattagggaaggggagaattgggatttgcccatagcaacaaa

SEQ ID NO: 3464 - DNA, 284 bp, Homo sapiens
ctgttgtggtgcatggccccgagcccttctaatggggctgaactgctctacaagcgcatcatcgtctttcttcctgagcacgagttccagatggacagtgtaggtcaaggaccttaaagacaaggccaaagagacttcagatgccatcacttaaagagcgaaggaagctaccgtgaatttacttggtgaagaacgaagagcacctaaaccagacttgatggaactttctgacctctctgtaccttctactgagcttgatgttatattagggactctggtaatat

SEQ ID NO: 3465 - DNA, 230 bp, Homo sapiens
gcggcctgtgcaggtgattggggctctgattggcaagcaggagggccgaaatatcgaggtatgaactcttgaggctgctgttcccacaaccttggaaggagaaggttattcttgacaagggattattgaatacaaccaagaggagcagttttaaacagggtttcaaggagcttgagtgactcgggttggttaccacaagggggcactctagaccttcggacatctacacg

SEQ ID NO: 3466 - DNA, 275 bp, Homo sapiens
gttccacctaagttacgaaggataatctgccttactaaaaattacacagtctctgtatgactctcctagattcatcctcaatcttccttgaggtgctgtagggtgggcaacagtgtttgtattggtgaaggtgttgaaagttggtagcatgggacttgaaaattaatttagagtttgagagttagagatcttctggattaaggccttcacatctagaaaagggcttagcccagggtgttataagatcccatgtgggggtgctatatgctatttct

SEQ ID NO: 3467 - DNA, 313 bp, Homo sapiens
gcagttcgaaaaggaaaacaaaaagatggttaagagtccaaacctgaaagacaagaaagaaatgcccaacccagactaaggcttacagttacgccaagtccagtgaaaggcaaagggaaagtgggtcgccccacagctttcaaaggcattcaaagggaaaggactccttctcccaaagaggaggattgaggacccggaaagccgcccagaaaagaaaacatctcaagcccccaacccgagaatcctgggctatgagggtcttagatgaagccccttctggggaggtattaaaaggtatgatggtctggggaga

SEQ ID NO: 3468 - DNA, 314 bp, Homo sapiens
tagatcgccatcatgaacgacaccgtaactatccgcactagaaagttcatgaccaaccgtctacttcagaggaacaaatgtcaattgatgtccttcaaccccggggaagggcgacaagtgcccttaaggcaaggaatttcggggaaaaaacttagccaaaaatgtacaaggacccaaaccggatgttcatctttgtaatttgggattcagactcattttggtgggttgccaaggacacctggctcttgggcatgattaatggattcccggggtatagcacaaggaaatgtacccccacatcagtgctctcacac

SEQ ID NO: 3469 - DNA, 264 bp, Homo sapiens
ctcgtgccgccctgagttggttgcctctcccctgctcactccagtcacatagagaattggtgttccgcagttgggatgcagctgttggacaaggtatttcggggggcaaaggttggtaggggaaggacaagctgttcacttgctgtttacaaggcacaaaggtgtatttaaaaatgtcttaatatttgcaaattttaaggctctggtccaatatatagggaaaagttgaagggggaaaatactctggatgcttctccaaagggt

SEQ ID NO: 3470 - DNA, 142 bp, Homo sapiens
ctcgtgccgaattcggcacgagaagaacctggaggaggagggtctgcccaagaaccccgacttgcgtatcgcgcagtgcgttccaacttcaggcctggcccgagcaaccgaggagacgcttccccgttcgcgcacgagcgct

SEQ ID NO: 3471 - DNA, 243 bp, Homo sapiens
aacaaatcaagcacatccttgctaatttcaaaaactaccagttctttattgggtgaaaacatgaatcagatggcatggttgctcaattggacttccctgagggttggtgttgaccccatatatataattttcctttaaggattggtgttagagatatgagaaaatagttaacacatgtgtgcacttatattttgatactatcacatcgtcatcatatatctgctctgctttgtcatacacaca

SEQ ID NO: 3472 - DNA, 247 bp, Homo sapiens
tttagaatttgtctagtaggctttctggctttttaccgaaagccctcttatgatgtttgtgcatgatagatgttcactgtgcaaaaattatgggtaggttttggttgtcttgatgcagttgtaagctttgggtattgaaggattggccacgcctctggcgcttacggctgcgcgagtgctgtttcccttccgctcccagagggcgttgggacggtgttaggacgctgcgctttatacgtcgagtatt

SEQ ID NO: 3473 - DNA, 343 bp, Homo sapiens
ccggccgcaggccccttccttatcgccgacaagtggcccgcgctgccccgcaagctggactcggtctttgaggagccgctctccaagaagcttttcttcttctctgggcgccaggtgtgggtgtacacaggcgcgtcggtgctgggcccgaggcgtctgtgacaagctgggccttggagccgacgttgcccaggtgaccgggccctccggagttgcaaggggaagatgctgctgttcagcgggcggcgctcttgaggttcgacgtgaaggcgcagatagtggatccccggagcgccacacgtgtggaccgatgttcccaaggtgcctttgacacgcacgacgt

SEQ ID NO: 3474 - DNA, 348 bp, Homo sapiens
aagaacaaaggcaagcatccattcctcactccaccacttttctatttcagtgggtgtcgttgctacgatgaagacttttgaaatttccttttctcttttaggacagggtcaggatttaggactcatagccttaaagctcattacatacttcctgtaaccatcagtccaaggttcagttcactataagtgcatgttctataaccaagagctatacctcatttcacattttaaaatatgtactctcgcccgttgcagtgctcacgctctaataccagcactcttgcagcagcgcgatatgcgcaagctcttgaggtcacgagtgttagacaccctcgccaccactgtgad

SEQ ID NO: 3475 - DNA, 299 bp, Homo sapiens
ccggtggggacagagggccaattcgggcaccatcccccaattcccaatactcgagaagtaaatggatggtactttgttgtcagagccagagtaggggacaaatggattgttggattcttaggtttgaggcttcgcttttgaggctttgacacacactattcggattgcttttgtagcactctcaattcagagagccacagcttttggggtagagagaggggtgctcttgtccccccacatatgacacagatatatatggggtcatcatgttgtgtgtgctgcagagtctcacagcagag

SEQ ID NO: 3476 - DNA, 340 bp, Homo sapiens
tgaaggtgctccttgccgccgccctcatcgcggggtccgtcttcttcctgctgctgccgggaccttctgcggccgatgagaagaagaaggggcccaaagtcaccgtcaaggtgtattttgacctacgaatttgagatgaagatgtaggccgggtgatctttgtgtctcttcggaaagactgttccaaaaacagttgataattttgtgtgccttagctacaggagagaaaggatttagctacaaaacagcaaattccatcgtgtaatcaaggactccatgatccagggcggagactttaccaggggagatggcacagaggaagagcatctactgtgagcgt

SEQ ID NO: 3477 - DNA, 301 bp, Homo sapiens
gcctgaactgcggcttgggctttgggacttggcagagagaggtcgggagcaaggggacgaacggccagaacacagttagatctcaaaggtaataagagtgccttcacacagtaggcattttatgatggctgactaagtgaaaagagcttggcttggtcagagcattgttgcccacccctgtaatctcagcacttttggaggccaggtgagtagatcactctgaggtggggagtttgagagcagacccgccacacatatgcaaaaccccatctctactataaatacacaaattatgccgctr

SEQ ID NO: 3478 - DNA, 327 bp, Homo sapiens
ccgccttagtgctgaaatatgtagtacatgaatatgccttgtttaattacagaaaattccaaaacttgtactatttttttttccatgtagaaaggcaggaatttcttctaagctttcctggacagcagatgaatgagcgcgtagctttagtttgtacgtaggtacagttgtgagcactatatgtactctctgtgactacttttgacacaagtaggtttttgaatgtaacacgataagtcaacttgagttgtaatatatatttgggggtcagctcactacacattgtgactctatacactgtactctatatgtgttgtagagttcccc

SEQ ID NO: 3479 - DNA, 241 bp, Homo sapiens
gttgctgagggcaacagcaggttcacttacactgttcttgtagatggctgctctaaaaagacaaatgaatggggaaagacaatcattgaatacaaaacaaataagccatcacggctgcccttccttgatattgcacctttgacatcggttgtgctgaccaggattctttgttgacaattggcccagtctgtttcaaataaatgtaactcaatctataattaaaaagagagagaatttgaga

SEQ ID NO: 3480 - DNA, 338 bp, Homo sapiens
gtttttaacctaaaatggtttataaaggttgaaaaaaattaaacaattgcaataaagcttagagaatatgaatataaaaagaaatagttttgtacagcagtatgatgtgtttgtgttctaagctaaggattattacaagagtcaaaaagtttaaaaatgaaaatgtttgtaaagtgaaatgttacattaggctatggttaaattattattgagagaataaatttttaaaataaatttagtgtagcccaatgtacacggtttatatagagccttggtgtgcacagtgatgtctcgagctcacattactcactgtctcaccccgggccgtcgtagtctct

SEQ ID NO: 3481 - DNA, 310 bp, Homo sapiens
ctcgtgccaattcggcagaggccatggcatcgggccatgtcctcaagcgtgtgccagcatggcccaagggcccattctctgatcgtctcaatctgttcagcaggacttttccccatgccaactttgtctaaggccacagtttgttttgcaatcatggggtagtaggatgttcagcaaaggatcagtcctttattgggaatttggaggtggtgtttgtagggctttccatttcaggcaatttcttttgtccatttggagttgtattgaccaggatggttaggtctaggcagaccatcttccgataggattt

SEQ ID NO: 3482 - DNA, 414 bp, Homo sapiens
atcatgggccagtaacaagcaaggtgggcaaggagatggaatccaagtgaatagtcagtttcagcaaggattttcccagccttgcaggcagcttggggatcaaggaaaaaaaaggaaaagggaaacaaatgatggacaacttattgggaccctggacccagttttacgtccaaccaaattgttgcttgttggagaaaaggtggtaaggctgctggctcaacttcgtcaactgatcaagatgaaaagctccctggccaggatgaaagcacaagctggaacatcagcagcaaaatgatatcctcaaagtggtggaaaagaggatagctggtggtctcacaggctaactgaatgacagcaggctgctctcgctcccagtatagagcatgatgctcctatatgctccacagtatccta

SEQ ID NO: 3483 - DNA, 397 bp, Homo sapiens
gcctaccccttccttgtactatccctatgaggcataattataacagctccatctgcctacgacaaacagacctaaaatcgctcattgcatactcttcaatcagccacatagccctcgtagtaacagccattctcatccaaaccccttgaggcttcaccggcgcagtcattctcatattcgcccacggacttacatcctcattactattctgcctagcacactcaaactacgacgcactcacagtcgtcatcatatctctctcgaggtacttcaatacttctactcctactaatagctttgttgatgacttctgagcagcctcggtaacctcgctacccccaactattaacctactgggagactctctgtctagttaaccagcgtctctgatcaaata

SEQ ID NO: 3484 - DNA, 317 bp, Homo sapiens
aagagacctaggaccaaagcacccaagattcagcgtcttgttactccacgtgtcctgcagcacaaacgggcggcgtattgctctgaagaagcagcgtaccaagaaaaataaagagaggctgccagatatgctaaacttttggccaaggagaattgaagggaggctaaggagagcgccaggaccaaattcgcgagagacgcagactttcctctctgcgagcttctacttctaagtctgaatccagtcagaataagattttttgagtcacactaaatgagcatcagcctctgaaaaaaaaaaaaaaaaaaaaaaaaaac

SEQ ID NO: 3485 - DNA, 401 bp, Homo sapiens
  misc_feature 9, 10: n = A,T,C or G
cttaaactnnctatatttatattttacataagtttttaaaatccgatacagtcaatatttgtttattaaaattatatgatggaccatataatataccaggctgaggaggtccaggcgtatcaataccccaagggaggcacgtccatgtgggtaatgttaagggataccttatatgtcaggccctaaccaaaggaggtttgtggaacttggagagatccaggaggtaacaccaaaaggctgcattgagcaatgcctgcctagccctcctgtacagctcatgattatattgtcgcctgaggccaccttacacaaaaccattcctatctccatgcttttgtttatgctgtgcctccttgagagggcacgctcaccgctctgctgtgttgatactaccgaccctc

SEQ ID NO: 3486 - DNA, 401 bp, Homo sapiens
caattccatatttgatggtagagtggtggcaaagcttccttttaccctctttcttacatccaagggactgtctcatcgaaatctgctggggagatgacaccacagactgttccttcattttcctgtatattctctgtactatgtcgattcgccagaccattcagaggattctcggccttgccccttacacggagccgccaccaagcaggcaggtggatttcttggcccaccacctccttcttggaagttctctagatctcaggatctctatattctctatcattcttctagacacacacacatcagacttgcatctgttttggtagcaggaccataggtagccttactacttggcgctcttctagttttgaattattctaagctgtgggtatgatagagtg

SEQ ID NO: 3487 - DNA, 404 bp, Homo sapiens
gtcagatcttacgtggcttcctgctgggggagatggccttcacccacggatgccgggttctcctttctttcctcaccccaacctttactccaccagagaaacttccttttgacctcagtggggaagagggtgatgagacaggcctagaaagtagtgggggaccaagcgagtggacgccctgctccgggattcctgagtctgtaaatagtgtgcccagcagctgtgaactccctatatagctgaggctgacagtgtcctccagagctgtgtgagaaatgagagcggacgtccacaggcacccagccagttttgggtgttgtgactcactacacctctgtgccctagcagaggtactgttggctcctcgtcttgtgagccttggggtcagctctctacacatgtgt

SEQ ID NO: 3488 - DNA, 374 bp, Homo sapiens
tttgcaacaggggaggaaaaaagacccaaaacttccaaggccctgcttttttcttaaagtactttaaaagggaaatttgtttgtattttttatttacattttatattttttgtacatattggttaggggtcagccatttttaattgatctcggatgaccaaaccagccttcggagcgttctctgtcctacttcctgactttacttgtgggtgtgaccatgtacattatactctcagaggagaaaaacacctcgtaaaagagcaaattgacaccagcatcacatcttatccgagcatcccagtaacttttttgtatatgctactcagctgctactatgaagagttgtgtagtatgaagatgattaaaacgcccaa

SEQ ID NO: 3489 - DNA, 255 bp, Homo sapiens
ggccagcccctcctctccccgccttctgggaggaggaggtcacacgctgatgggcactggagagggccagaaggagactcagaggagccgggctgccttccgcctggggctccctgtgacctctcagtcccttggcccggccagccaccgtcccaagaaccaagaatgcatttgcctgtccccccgggccagcctccacaacttgatgtgtgtgtttgtttggggggaatatttcatatattatataagagacag

SEQ ID NO: 3490 - DNA, 416 bp, Homo sapiens
ctaatttttttttttgttattgtggagatggggtctcatttgttgcccaagctggcctcaaactcctgggctcaagtgatcctcccacctaggcctcctaaactgctgagattaaaggtgtgggtaaccatattctgcctcaatgccccttgttttatagcccttgttactgaaccgtaagtctctgtttttcatcagaaagagtcatacaagctattcccctggggtcctaggtgattccttaggaacggatcactttttccattagattggtatctccagaataactagtggtcattcccagacttcttaaatgccaatatgaggaacctcctgcacgagcaagaccagatttttgagaacaggaaaatagggaagtgttggaacccttagggtaagcctaagcctttactcat

SEQ ID NO: 3491 - DNA, 416 bp, Homo sapiens
cgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcatttcccagggtattggcaagcttgccagtgtacctgctggtggggctgtagccgtctctgctgccccaggctcttcagcccctgctgctcggtcttccccttctgcagcagaagagaaggaagatgagaaggaggaggagtctctaagagtcaaatgatgacattggattttgcccttttattaaaatccctctcccctg

SEQ ID NO: 3492 - DNA, 295 bp, Homo sapiens
aaacctgggagatggagtggctcatgcctgtaatcccagaactttgggaggccgaggcaggaggatcacatgaggtcgggagttcgagaccagactgaccaacaaggagaaaccccgtctctactaaaaatacaaaattagccaggcatggtggcacatgcctgtaatcccagctactcgggaggctgaggcaggagaattgcttgaacatgggaggcggagattgtggtgagcccagatcacggcatttcacttcagccttggagacaaagagaaacttcattccaaaaaaaaa

SEQ ID NO: 3493 - DNA, 370 bp, Homo sapiens
ctggattgtagaacttgttgctgattttgaccttgtattgaagttaactgttccccttggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaaccgtgggctgttacttgctttgaggtggaagccggtttcaattaccgctgtaatgtattcaatcctaatttatggaaggtttttttgtaccgaattctcggttctcttgaagagatagacacacacaatttttgggtttctcacactgtatatgtagagacaca

SEQ ID NO: 3494 - DNA, 354 bp, Homo sapiens
cccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactccgacccggggaggtagttacggaaaataacaatacagggcttctttcgaggcctgtaattggattaggtcactttaaatcctttaacgaggattcatttgagggcaagttttgttccaagcaagcgcgcgtaatttccagtctccattggcgatatataaaggttctctcagtgttaaaaaggtctcgagagttggg

SEQ ID NO: 3495 - DNA, 330 bp, Homo sapiens
aatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacccgtgtcttataggttacactgccaaaacaatgccccgtaaggtggcttatttgtataattgggttacctaaggcacatattaaaaggtaaactacctgttaaggggtctgcacactggcccagtgaggtaggttcttcc

SEQ ID NO: 3496 - DNA, 250 bp, Homo sapiens
gcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacggagcaccacctggtaaaatcttgaaaacaa

SEQ ID NO: 3497 - DNA, 250 bp, Homo sapiens
ggcttttctcttgtgctatggacagttgacaatttaacctaagcatataacttttcaatatgtaattgacagtagaagtgtgacaggatggtggtttacacacatgtatgatacccttttctaaataagagtttctgggctgggcaggttggctcacactggtaatcccagcactttaggaggctgaggtgggaggaatcacttgagcccagcagtttgagaccaacctggccaacataggcagaaccct

SEQ ID NO: 3498 - DNA, 230 bp, Homo sapiens
cagctccgagctgtcacttgaccgtgagaagatgctttgttcatctttagagtcctcctttaactctgattgtctctaactccagtgagacaggaaggaccaagggttgcgaccatcatccaaataatcatagtaattccacctatttatagagcaccaattatgtatccagcaacttggaacatagggtgtcttgacttatgatggggctatgttccgataaaaaccat

SEQ ID NO: 3499 - DNA, 390 bp, Homo sapiens
ttttcctttttttttttgagacggaggctcactccgtcacctaggctagagtacagtggcacgatcttggctcgctgcaacctctgcctccctgattcaagtgattctcgtgcttcagcctcccatgtagctgatattacaggcacttgccaccatacccggctaatttttgtatttttagtagagatggggtttcaccatgttgcccaggctggttttgaactcctaacctcaggtgatccgcccgcctttgccttccaaagtgctgggattacaggcgtgagcacttttgcccggcttatttttctttatgtttttgcttcgtaagaggttcttttgagcagtgatttgcaactcttgctgacgttgctggggaagctttaaaaaaaa

SEQ ID NO: 3500 - DNA, 350 bp, Homo sapiens
aaaaaactctggggatctttatttgttaataagatgatgtcgtaaaatagctgatgggtggggcgcggcaggtcatgcctgtaatcccagcactttgggaggctgagacaggtggattgcctgaggtcaggaattccagaccagcctggccaacatggtgaaaccctgtcactactgacaatacaaaaattagccaggcgtggtgctgcgcactggtaatcccagctgcttgggaggctgaggcaggagaatcacttgaacccaggagatggaggttgcagtagccaagatcatgacattgcactccaccctgggcaacacagttagattctgtctccaaaaaaaaaaaa

SEQ ID NO: 3501 - DNA, 406 bp, Homo sapiens
tgtgggtaaagtgtggtgttaaaaatgagttataggccaggcactatggctcacacctgtaatcccagcactttgggagcccaggtgggcagatcacttgaggttcggagtttgagaccagcctggccaatatggtaaagccccgtctctactaaaaatacaaaaattagacatggtggcatgtgcctgtatcccagctacttgggaggctgaggcaggagaattgcttgagcccaggaagtgaaggttgcagtgagccaagatctcaccactgcactccagcctgggcaacacagggagatcctgtctcaaaaaagaaaaacatttttacagttgacagattgccaacaatctaaatgaccataggagaaagggtaaataagttgcatatttgcacagtataaca

SEQ ID NO: 3502 - DNA, 400 bp, Homo sapiens
gcgaatttggcacggaaggcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtgacctgcttcagcagcttgtgctgcaccagcaggaggtcctgccccctcactgctgctgctccagctgaggagaaggaagtggaagcaaaggaaggaggattcgaggagtctttatgatgacatggctttgggctttttgactaaaccccttttataa

SEQ ID NO: 3503 - DNA, 140 bp, Homo sapiens
acgaggccaaacaatacaaaggtagccaaggaaagaaattgaccgaaagaagcataatagagtagcaattgtaggacttacacttactacttcccttaaggctgacaatgtcaatcaatcacaagggtcgactgatatct

SEQ ID NO: 3504 - DNA, 185 bp, Homo sapiens
acattcggctcggagacatactaatggtggctttatctagtatggagacgaaaatttgcggtcccaacattgccaaagtccagatgatttttcacgggtgtgctaacggaagggttcagaaatcaccttaattgcaacgacaaaccattccctcatttcgcagaagcacctggaacctcaaggaa

SEQ ID NO: 3505 - DNA, 370 bp, Homo sapiens
cggtgacgatgataaaactcggcccctggtgaaatgacgcccctcccccacctgcccatggcctgggactctctgcgatgtacataactatttaatgcagcggcagggccgacagctttccctgagaggacttaaaagcagaaggaaaccgagatgcttcccgcagccgtggacgattctccaggactctttttttaccttgagcacttgcctcgtgagacttcatagaacagtggtttactgtccccccttctcacctcctcattctctctggctctttctgtcttccccttcttacctccttccttcccttaggcatcacttcttgggaggtaaaggaccttgacttaggttcccggaaaaaaaaaaa

SEQ ID NO: 3506 - DNA, 340 bp, Homo sapiens
acagatcagtcacagataaattgtttaagatccaactccatgtttgagtctgtgtgcatgtacatgtctctgtctgagttttgtatatgcttagaaataaagaactaaagtaatacagaccttaagtacaagtatcattttctttgtttttgcttcttccaattttctaaattttctttaattaccttgtgctactttgtaatcagaaacaaaatcaattataattttcaaatattttcaacattttcataggttctcatacaattaggcattttcttctatattacccttctatgttctacttgctttctttaataggtgacaaggctcttacattaag

SEQ ID NO: 3507 - DNA, 200 bp, Homo sapiens
gtctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaaaaaaaaaaaaaaaaa

SEQ ID NO: 3508 - DNA, 264 bp, Homo sapiens
ccgcacatggctcggaggatcctacgcccacggagtctcgctgattgctagcacagcagtctgagatgaaacagcaaggtggcagcgaggctgggggaggggcgccggccattgcccaggcttgattaggtaaacaaaggcagcttggggaggctcgaactgggtggagcccacaacagcgcaaggaggcctgtcctgcctctgtatgcttcacctctgtgggcagggcacaaacaacaaaagacagcagtatcctcttcagag

SEQ ID NO: 3509 - DNA, 229 bp, Homo sapiens
cggcacgagcagctggcaacctcaagaaggccctgcctccattccagggcttccaattgaccgctggagatccgggcagagggcaatagcaggttcacgtacactgccctgaaggatggctgcacgaaacataccgctaagtgggccaagattgttatcgagtaccggtcacagaagacctcacgctctccccatctattgacattgcacctatcgcagcataggaggg

SEQ ID NO: 3510 - DNA, 280 bp, Homo sapiens
actttataagtatttgctcgtgtctgttgacagacctctttctttcaaacttgttagaagagtggtaagacatatccaattggaaaataagatgcagtgttgtatagcacatacatttaaagtgcttgcgttaaaattagtttctcaataagataaaattattttaaaaatttggttcactttattacaatagtggcactttagctcttcagtattacaggagtttataaatatgtgtttctttgtatggggacactctcaactctcgggagtatctcca

SEQ ID NO: 3511 - DNA, 276 bp, Homo sapiens
aggacctggtttttcaggtactgggagccgggggctcactgcttgcactgtgcttagggtagggatggtaaatatcctccctgcatggctttatcctccctctcattccaaagcaggtatcttcttgttgtcacagagtttcatttagttcagctgcagccacgttgccatcttgagctctgtgtctataggtgaccatctctgtacatatgaggggagcctctctgtctcctccactctatatgcagtcatctttggagagcgcgaggagaaggt

SEQ ID NO: 3512 - DNA, 200 bp, Homo sapiens
cggcacgagggaagaccagtttctttcaatctaaggctatttaatatacattaagaggcggcgcaggtggctcacggcctgttattccacacaacacttttggaggccaagcaagccgggtaatagaggcaagagagtttagagcccatccctggctatacacacccggtgaaccccctgctctctctctaaatacacaa

SEQ ID NO: 3513 - DNA, 250 bp, Homo sapiens
gtttttagtggctcgggatatattagatgacagtgagtgaaatacactaatttctccctcttttctcatgcatttcatttctaggaaccagagagaaagtattggggaagggagccaagcagggagacgtttcacaccttgcctctaaactctgggtctctcatatcacatgtgtgtatacacaggctgtgttttgtccacagatatcggtgggatacgctacaccgcgactcgctctctactctctcct

SEQ ID NO: 3514 - DNA, 284 bp, Homo sapiens
cagaggcagcgtgcgggtgtgctctttgtgaaattccaccatggcgtaccgtggccagggtcagaaagtgcagaaggttatggtgcagcccatcaacctcatcttcagatacttacaaaatagatcgcggattcaggtggtggctctatgagcaagtgtaatatgcggatagaaggcgtgtatcattggttttgatgagtatataaaccccgtattagatgatgcagaagagattcattctcaaacacagtcaagagaacaactcggtcggatcatcactaaaa

SEQ ID NO: 3515 - DNA, 269 bp, Homo sapiens
ccagaacacaggtgtcgtgaaaactacccctaaaagccaaaatgggaaaggaaaagactcatatcaacatttcgtcattggacacgtagattcgggcaagtccaccactactggccatctgatctataaatgcggtggcatcgacaaaagaaccattgaaaaatttgagaaggaggctgctgagatgggaaagggctccttcaagtatatcctcggtcttgtgataaactcaaagctgagcgtcgaacgtcgtgatcatccaccttata

SEQ ID NO: 3516 - DNA, 355 bp, Homo sapiens
agatggtgagaagccgggttttctctatgctaaatgtgtctactaagagcagcactttctactagctaagcacaatcataggcccaccgtgatgagctgctagtcttgaataacattccctgacttaggggaaggcacacaaaaacatattaaggtatgtctattttcatatgtgtgatactgacagagccatggtatttctaaacatatagggttctctcttttcttgtattctgagccaattgcatttattcactacattacaaaccatcactgatgtatccacatagcacacatagtgcagtatgatcatagagataacatcttttataagcagtgatttatgggattttct

SEQ ID NO: 3517 - DNA, 117 bp, Homo sapiens
ctacattgaagactggcaattcgttaatgattatcgccatcctgtcagtgtgacacgatttgtccgacccacatgggaccagattaggtttcattgatgcacacagtgatgggattg

SEQ ID NO: 3518 - DNA, 103 bp, Homo sapiens
  misc_feature 8: n = A,T,C or G
ctgaaatntcaagctccaggacatgcaaggcatttatcaggtgaacagaaggtagagccttggtgatatgacattggaggataatgtcaagggtgttggggta

SEQ ID NO: 3519 - DNA, 150 bp, Homo sapiens
cgccagtatctggaccagatccgcagacaatctttgaaaacctgaagatgctgaaccatgcactagtgtccagattcatgacggtgccttcagagacctctgaccctatgtacagagagctgatgaggctgtatgtcagagagagagagg

SEQ ID NO: 3520 - DNA, 180 bp, Homo sapiens
gttgatccgctggtcccctcttttgggggtagatgcggccccgatcaggtctgactcgctgctctttttgttcccttctgtctgctcgaaccaactgcccttcggcttatctcctctcctctttcctcacaccggcacactggggagtcacagagattggggctctgggctctctacagg

SEQ ID NO: 3521 - DNA, 170 bp, Homo sapiens
ctccccccgagcgccgctccggctgcaccgcgctcgctccgagtttcaggctcgtgctaagctagcgccgtcggtcggtcttccttcagatcggccatctatgtaatatacttacccggggacctctatctagaccacggatgtagaatgtttcttccgacaatcttaca

SEQ ID NO: 3522 - DNA, 273 bp, Homo sapiens
ctcgtgccgaattcggcacgagcaaagtacctggactttatggaatccttctatacttcattgtcaatcatttattggttctaaaactggatcggacaatgttgctattttcagggaggccaatgtttttggaggtaaaatgcacaaattaattttctctttgcctttgcaaacacaatttttttttctgtcatttgcaattgttgcacaaaggggccacgaggggtcttcaagacaggccctcccttatttcttccccggggtggggggcgt

SEQ ID NO: 3523 - DNA, 250 bp, Homo sapiens
ataatttcttacggcctgtttttactgcagtctcggaacataaagtgtgaagatttcatggacatttatcacttccccaatcaataccccttgttgaatttcctatgcttgtctttactttaatctcttaaatcctgtcatcttcataagctgaggatgcatgtcacttcaggaccctgtgatgactgcgttaactgtacaaattgtttgtaaagcatattgtgtttgacaatatgagatcagtgcaccc

SEQ ID NO: 3524 - DNA, 176 bp, Homo sapiens
atagattttatgagaattaagtgagatatgcatttagtgtacaggataatgcctgtcacatagtaagtatgtaataagcatttattatttacttattcagggtattgagtttattgaatttgtgggagcctcggggttattgggaggagggcttggcgttcaaatcaaagggctga

SEQ ID NO: 3525 - DNA, 285 bp, Homo sapiens
ggggagccttctggaacacgttgctttgcccagtcagtggtgctgaggggtatagacaggcatgccacacacgccagctcaccccagggacaacctcccacccctcttgcccttcatagcatgttacccactgtgggaagagaatcttttggcgtctagtattttacaaccaagcaagcaagccctctgaggtgatagaggtgctttccccatctgcttgcttgtactccctccccagagggggcgtcctcccttactcacccaccatcttcttcaatgatggca

SEQ ID NO: 3526 - DNA, 213 bp, Homo sapiens
cggcacgagcgaggccccacaggaggagaaggctgtgttctttgcagggaatgaatacattgatctactcagcagcaccctgtgaggcgaggggtaccccaagccacattaccagccttgggacatttccccctgatgtccacgagagtgggagtccgccgtttacattgaggcagaaacaaagaggagatataatattttcttgtaggagaa

SEQ ID NO: 3527 - DNA, 401 bp, Homo sapiens
ctcgcgaggcaacctctgggccaccggtcacttcatgggcaagaagagtctggagcccttcagcccattcccattgtgggacagactctcccacaacctctcctttaggggacccagcgcactttcagactttagttcaatatatcttgcttctgggaattcctccctcgcttaaaaagaagagcttcttgtgggcgtcgtagccgtctaagaccgccccccgcaccacccaaaatactagctaacaagagggacgtcttggtgacaacatacttactagcaagatgatcaaccaacctaattagtggcagacaacaaacaaacaatggctttcgttatagtattgctaccccaccggaagggatgctttcattggatggcctcccttgattggcacgccc

SEQ ID NO: 3528 - DNA, 394 bp, Homo sapiens
taacataccacgtgtgagagaaatacatttggaaaacaataaactaaaaaaaatcccctcaagattaccagagttgaaataccctccagataatctttccttcattctaattcaattgcaagaggtggggagtaaatgacttcttgtccacaagtgcccacagatgaggagatctctattacagtgcactatggtgtatttcacaacccccgtggaaatacttcggggatgctaccatcctacaacttcgttgttgtttttagcagcagtagtggttcatgcttcgggagctactggagggttattaattagtagttagtagtatccacccattatatgtatgcatcaatccctccctcaggtgggcttcatcgtcctttattaatggagggtg

SEQ ID NO: 3529 - DNA, 309 bp, Homo sapiens
cggcacgagggatggggcttcacttgcttgttgacttccctcctgccaaggggatttggggctttcttgaaagacagtccaagccctggataattgctttactttcttgtgtttgaaggcacctgtttgggttgttttgggttaggtgaccttattgttaaaaacgggtttttcttcttgggggaggggttacacaagggctctactttcagaagtgggacttcttgtttttttttctcttttaaagagggggaagaggttggggctggtggctccacaactgctaatacccacccactacttaggaat

SEQ ID NO: 3530 - DNA, 204 bp, Homo sapiens
aaagatttaagtaattttgccatcctaggcttaaatgcaatattcctgggattatttacaatgcagaattttttgagtaattctagctttcaaaaattagtgaaggttcttttactcttaattggtggacaatgttcacataaatgaattgctatatgaaaagggttaacagataacagactctggagtgtgtgtagcactcta

SEQ ID NO: 3531 - DNA, 308 bp, Homo sapiens
caacaatgatagactggattaagaaaatgtggcacatatacaccatggaatactatgcagccataaaaaaggatgaggttcatgtcccttttgtaggggacaatgggatgaaaatttgggaaatcatcatttcttcaggtaaaacttattcgcaaggggcaaaaaaaccccaacacccgcatgtttctcatttcatagggtgggggacccccacacattggagcaccattgggcacaagggagggggggcatctacaactctttgggggcttcttttttgggggtggggggaggttggggagggggtt

SEQ ID NO: 3532 - DNA, 343 bp, Homo sapiens
gagatgacgaagggaacgtcatcgttttggaaagccgtcgcaataagacgcacacgttgtgccgccgctgtggctctaaggcctaccacctcaagaagtcgacctttggcaaatatggctaccctaccaagcgcaggagaaagattaactggagtccaaaggctaaaggaggaaataccaccggacctggtggaataaggcacctaaaaattgtataccgcagattcaggcatggagtccgtgagggaccaccacctaaacccaagagggcagcttttgcagcagtccagttctatctcaaggagtgtcaccgacttagtcatgcaatatatgattctggtgt

SEQ ID NO: 3533 - DNA, 211 bp, Homo sapiens
gacagacaaggcttgggtgtatatgccaaccagatctcattgaagtatcagcttgttggtactaggtgcaagtgtagcatgttccacatgtagaccaatctttggggtccattggccaattttttaggggatgttactggcccaccattttttacgtgagggggtccctcgcgcggggggtgtaagagttattcaagggttatttttcccm

SEQ ID NO: 3534 - DNA, 239 bp, Homo sapiens
gccatgagcagcaaagtctctcgcgacaacctgtacgaggcggtgcgggaagtcctgcacggaaccagcgcaagcccgcaaggtttcttggagacgggtggagttccagaatcaactttgaaggaactatgattccccagaagggacaaggcgttttttggggcaccctctaggctttaaggtcccttcccgccccttaggtttctgtgtgtcttccctgggggaccagcagacactgt

SEQ ID NO: 3535 - DNA, 151 bp, Homo sapiens
ctgtgcgaattcggcacgagcatgattctattatgtattggtacgtctgtagacagatatattttctcacataagtttctatctttccaaggttacaaatcacacaggtgcaacttgtttttcaattgccatttatggaggagggggtgac

SEQ ID NO: 3536 - DNA, 277 bp, Homo sapiens
gttttatgctttttctacatcagttattatcaaagacaaaagttataggcatgaggtggctttgcaagataagtctgcaggaaaattttccccatctcatttttcgtgaaagggttatctatgactttcaatgttcaattaaacgttaattgttttatagaaaaataatgatttttctggggtttcattcatctcatttctgctcaaccacaagggacatactcaatttcactacagtaggggaataccacggtatggcagccacctcactgctatg

SEQ ID NO: 3537 - DNA, 323 bp, Homo sapiens
cttatccctaccttcatgttccagtggaagaccttagtaaaatcaaagatcagtgagttcatctgtcatatttttttcacttgctttcttactgaccagcaaccaggattttttttttcctgcagagcaagttttcaaaatgtaaatacttcctctttttaacagtccttggaccattttgatccagttcaccagtagggttggacagcatattattttgcatcattttgtccctggttcaatcaagatgttttgcagatattcctttaacgggcggactttggctgtttcctatgacacatgtagtggtgattatttggagt

SEQ ID NO: 3538 - DNA, 311 bp, Homo sapiens
cgaagaaggaagctcctgcccctcctaaagctgaagccaaagcgaaggctttaaaggccagaaggcagtgttgataggtgtccacagccacaaaaagaagaagatccgcacgtcacccaccttccggcggccgaagacacttcgactccggagacagcccaaatatcctcggaagagcgctcccaggagaaacaagcttgaccactatgctatcatccaagtttccgctgaccactgagtctgccatggaggaggatagaagacaacaacacacttgtgttcattgtggatgttaaagccaccaagcacca

SEQ ID NO: 3539 - DNA, 246 bp, Homo sapiens
agctgacgcctctgctttcctccacctgaagagaacctgcgtgctgctcctttgcttcggacctccgcctctgcccgggagaaagcccaggccagcctgctgacaagcagagaccatgagaaggagagttcaggggtcccaatccaggccatcctagaccagccagctccagctgatccgcacgcagccacttcggctacctttctacttgccaaagggaggtccagggctcacccagattcagag

SEQ ID NO: 3540 - DNA, 113 bp, Homo sapiens
cggctgtgtcaacttcggctattacctgtaccggtgcgatccagcatgagccccacgaccaacgtggtcctgtgtcgtgtcagtgtggccacggccctcgtcgggccctgtcg

SEQ ID NO: 3541 - DNA, 183 bp, Homo sapiens
gacactaggaaaaaaccttgtagagagagtaaaaaatttaacacccatagtaggcctaaaagcagccaccaattaagaaagcgttcaagctcaacacccactacctaaaaaaatcccaaacatataacttacctcctcacacccaagttggaccaagtcgtatcaccctatggagcacctaat

SEQ ID NO: 3542 - DNA, 143 bp, Homo sapiens
aaaaaggacccttcactattcttgtttagtaaatagctgtctgctcttcagggaactgttacctatgggtgtattaccaaagaacgctggcaattggaaatgtcctgatggaaattctttcacgtgccggttctctggcatcc

SEQ ID NO: 3543 - DNA, 156 bp, Homo sapiens
gggtgcccagagatgcagggggtaaaattcaacaaggagaaggaattctctaggcaaactcttttaacaattttgaacggggcgagaagccccttgggccagaacttaggaggaggttgcgaatcctaatccggcatgcagagtttacaggccagg

SEQ ID NO: 3544 - DNA, 195 bp, Homo sapiens
ggacaactggcacaagcgccgcaaaaccgggggcaagagaaagccctaccacaagaagcggaagtatgagttggggcgcccagctgccaacaccaagattggcccccgccgcatccacacagtccctgtgcggggaggtaacagatataccgtgccctgaggttggacgtgggtatttctcctggggctcagagt

SEQ ID NO: 3545 - DNA, 182 bp, Homo sapiens
ctaaaattgaccatgtaattggaagcaaaacactcctcagcaaatgcaaaagaatagaaattataacaaacagtctctcagactacagtgcaatcgaattagacctcagggttaagagacctcactcagacccacacactacatggatactgaacaacctgctgctgtatgactactgggta

SEQ ID NO: 3546 - DNA, 170 bp, Homo sapiens
cagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgatt

SEQ ID NO: 3547 - DNA, 249 bp, Homo sapiens
ctggagctcctgagaccaccgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtcccccaagagggctccggaggatgagctaccccctcaggtgcacaaggtatagacaaggctgagcagggttcctgttgcccagatg

SEQ ID NO: 3548 - DNA, 275 bp, Homo sapiens
cagttcatgaacctgggaggtgtgctgtcctggctggacgctacttcggacgcaaagctttcatcgtgaagaacatttatgatggcacctcagatcggccctacagacattctcttgtggctggatttacccctaccccccaaagtgacactgccatggcaagaagagatcgccagagatcaaggtaaatctttgtaaagttatactcaatcacctaatgccacaaggtactctctgatatcccttggcaaactttcgtaataggatgtttcagg

SEQ ID NO: 3549 - DNA, 290 bp, Homo sapiens
ccaggggactcgaagtgtcgtttcggggccgctgtctacggggagaggaggtggcggtgccccttggcctcgttgggatacgtgatggtgacagaagagaagaaggtttcgattgggaagccagaccctttgcgggattccgggacttacgaccaggaggaggagccgcttggagcggacttcgaccgcttcattggagccacttccaacttaagccgtttaccttttggttcttgagacattccttggcccggatgccaaagttcgttgggccttaacttggccacctt

SEQ ID NO: 3550 - DNA, 355 bp, Homo sapiens
cagagtctagctcccaccagcagtcgggcctgcctcctgcaaaagaggggaaagagaagaaggagaaacccaagagcaaaacagcccagcagattgccaaagacatggaacgctgagctaagagtttgaataagcaggaggaaactttaaaattagctttcagcctgtcaattccttgagggaaggagaaggagataatcttctgcagcagacgttggctttctctctttgagagaagggagccttagctgaaggcagcagctcatccagtattggtccaaatggagatgaggagatcccctcaaagggtctggtgctgctacagtgtacagtacataggagactgtgagtctta

SEQ ID NO: 3551 - DNA, 265 bp, Homo sapiens
gtccttttctgccacctcccagccacacacatttgcagacccacaagaagaactgtagccttgataatttcagttcaggctggaaaaatgccatgcaataatctggtttgctttcagtaagtaggcaccaggtgaaactgtatattttcatcacctattctgctgttctatctaaaatgagtgtacctgtggtgtgtgactggcccttgtttgtgccagctcctacaaggatgttcctgtgagacactgtcgcctgccctctaga

SEQ ID NO: 3552 - DNA, 295 bp, Homo sapiens
ctgatcctgagctggccttggcccttcgtgtatctatggaagagcagcggcacgccaagggagggaggaggccccgccggaagcctgcagctttcttctcttggaggccggggatttctacgactgggacttaagactcagacgatgccctgctgaagatgaccatcacccagcaagagtttcgccgcacttggcttctcacctaagcagtatgactgaggagacagattgcttatgcatgcagatctcctgcaggagcagagttcggcaggcggaatcagcagcattcatgcag

SEQ ID NO: 3553 - DNA, 275 bp, Homo sapiens
catatatattgtgcagctagggcgacagccaagaggtgtgtgtatgtctttatgaaatgtttgaaaagagataaactgactgcttgataatcactctcaggtgtaaagctccaagtgtaaataaaagtggcattaacaaatctttcagtacaaggtacagctgactatatataccagggctagctaagggcacagctgagagctccgatctccagagagactaatctaaagctctgctttgtacttcctcaccctgctttcgtacaaggaggggg

SEQ ID NO: 3554 - DNA, 350 bp, Homo sapiens
cggcggtgtcggcagctgctgtagcgaagagagtttggcgcgatgtctcacaccattttgctggtacagcctaccaagaggccagaaggcagaacttatgctgactacgaatctgtgaatgaatgcatggagggtgtttgtaaatgtatgaagagcatctgaaaagattgattccaacagtccctctatcacatatgacatcagtcagttgtttgatttcatcgatgatctggcagacctcagctgcctggtttacgagctgataccagacataccagccttataccaaagactgattaagagagatctacgtgctctgcgtcggcaggccaacaggctgggaaatattg

SEQ ID NO: 3555 - DNA, 260 bp, Homo sapiens
gctgtctccatcttgtctgtatccgctgctcttgtgacgttgtggagatggggagcgtcctggggctgtgctccatggcgagctggataccatgtttgtgtggaagtgccccgtgttttctatgccgatgctgtcctagtggagacagactccactgtaactagattgatctatgcactctgtctctgctggcagggagtatgtgtagcctgtgtaatgttgataccaggaatggaagacagcttaataagattcctgga

SEQ ID NO: 3556 - DNA, 260 bp, Homo sapiens
cagcaagcgactcaagagcaggcaccgcctccaggacaacgtgcgcgaggacctctatgaggctgctgacaagtgggtggctgctgtgggcaaggaccggcccttcatggggggccagaagccgaatctcgctgatttggcggtgtatggcgtgctgcgtgtaatggagggtctggatgcattcgatgacctcatgcagcacacgcacatccagccctggtacctcgcgggtggagaggcccatcaccgaggtcctccca

SEQ ID NO: 3557 - DNA, 308 bp, Homo sapiens
gtcaacccaagacctaagaatcttgatgttggaataaagatggaggaagctatgacctacacagaggacagttatgggatggatgggaaggttaatcagccccgtctcactgcagacatcaactggcaaggctagaggagctacacagtgtgaatgaaaacatctatgagtacagacacaactacagacttagtctggtggactggactaattacttgaaggatttagatagagtatttgcactgctgagagtcactatgagcagaataaaacaattagactaaactctcaagtacgggtctggttgt

SEQ ID NO: 3558 - DNA, 355 bp, Homo sapiens
atggcggaacaagggagacacaagaagcggatccaggaagttggtgaaccatctaaagaagagaaggctgtggccaagtatcttcgattcaactgtccaacacagtacaccaatatgatgggtcaccgggttgattattttattgcttcaaaagcagtggactgtcttttggattcaaagtgggcaaaggccaagaaaggagaggaagctttatttacaaccagggagtctgtggttgactactgcacaggcttttaaggagcaggtttttcaccgagccctaaagtatgaaatgaatatgataaggcataaggaagagaaggtaaggaaagctgaagtggaaagagagataaag

SEQ ID NO: 3559 - DNA, 209 bp, Homo sapiens
tagaaaccaagtccataccatttaatgtagctaatgcaatgccatttggcttttttttgccctgtaaataattgaaggggagagacaaacggcaagagccttcctctaggtaattaggggtcggattccagaaagcctttacgggccattttcttaaagtgttcttccttcataaaggatttatattgatttgtgtgcggtaaatacat

SEQ ID NO: 3560 - DNA, 185 bp, Homo sapiens
tttaaatcttggctatctaaaatttcctccctttgtcttgaatatttgtaaggcctttaagaagttagtgtcagcaaattaattgaaggttatgcttcctatactggggccatattcacatactgagtatagtactcctgctactgctctcaatgtaaaatgtatgcctgggtgttttaaagtaa

SEQ ID NO: 3561 - DNA, 269 bp, Homo sapiens
agacagggatggagtaaaccgaagccaatttcagggctcttggcgtgttggacacagaaggaatcctagtgcagcctttggtagctaacagtcactgattttataattggagaatgcgtaaagattcatttttcaaggagaagagcctccaaatggccaatgaaggaggtaaataaactaagatattccgagggagggacccaggccacctcccttccgcagtctgcagatgagggttttttgaatgaaatgccactctcattttcaga

SEQ ID NO: 3562 - DNA, 460 bp, Homo sapiens
ggtaaccttttgcactcaaattcctttatcaggaataacttacatagccactattttacaaagccattggaacctttttatttggtgcagctgctagtcagtccctgactgacattgccaagtattcaataggcagactgcggcctcacttcttgggatgtttgtgatccagattggtcaaaaatcaactgcagcgatggttacattgaatactacatatgtcgagggaatgcagagagagttaaggaaggcaggttgtccttctattcaggcactcttcgtttccatgtactgcatgctgtttgtggcactttatcttcagccaggatgaagggagactggcaagactcttacgcccacactgcaatttgtctgttgcgtatcattatgtggctgtctcgagttctgatataacacactggagcgatgtgtgactggactattcaggagctctggtgca

SEQ ID NO: 3563 - DNA, 273 bp, Homo sapiens
gtgactagtgttcagcttgattaggacgaacctgggcacttagccatgcaggaacatggcgagcctctagccctattgggagcagcaatgggtgcctcgctggatcagaagtgcagtggatgccctgccggatctggaggggtggaagtcagtggggggtctgtcgacggcgatgatcggcagtggtggatggtgagcaaaatctcagctcgagagtactcctagagcggccgcggcccatcgattttccacccgggtggggtacaggtaagt

SEQ ID NO: 3564 - DNA, 309 bp, Homo sapiens
gggagaaactatcaatgctggcagccagtttgaatataatgtagaaggagtgacttccaaggaaatggctacccaacttgccttcatgcgcctgctggccaactatgcctctcagaacatcacctaccactgcaggaacagcattgcatacatggatgaggagactggcaacctgaaaaaggctgtcattctacagggctctaatgatgttgacttgttgctgagggcacagcaggttcacttacactgttctggtagatggctgctctaaaagacaaatgtatggggaagacatcattgatacacaca

SEQ ID NO: 3565 - DNA, 277 bp, Homo sapiens
tctcagtgaattctggtattcagactctattccactagtgaaagaaccattttttaaacttcccttgccttttttatttatttaattttcttggtttggagatgtcagtcccaaacaccagagtctgtacttttctataacacagctcagattaaggtagggcatatgccaaggaggttctcacctccctaaggaggggacttgaattttagggactttaattcacccctccttcaatacacctctcccccttcttgtttgcacatgccaagatact

SEQ ID NO: 3566 - DNA, 231 bp, Homo sapiens
cggcacgagagaagccaagcgtcctccaggctttgaccgtgtccgaaatgctgagattgggaataaagactttgagcttgatgtcctggaggaagcatataccacagaacattggctggtcaggatatacaaggtaaaggacctggataatcgaggcttgtcaaggacataaatgtcacgtccagctctgatatgcttcgcactgagcacatcacatttaggacgttgaga

SEQ ID NO: 3567 - DNA, 158 bp, Homo sapiens
cggcgtctcgtgtcctttcagcctatgtcagccgcctgcccgcggccttttgcgccgttgccccgggtccggatgctggccgtggcccggcctcttcagcaccgctctctgctccgcgggggcccagacgaggctcgggactttgcagccgccttagt

SEQ ID NO: 3568 - DNA, 339 bp, Homo sapiens
gcgggacttagctgttgagttagagccaacatgagtgagcgacaaggtgctggggcaaccaatggaaaagacaagacatctggtgaaaatgatggacagaagaaagttcaagaagaatttgacattgacatggatgcaccagagacagaacgtgcagcggtggccattcagtctcagttcagaaaattccagaagaggaaggctgggtctcagtcctagtgggagacccccttcctagtccacctgaaaacaccaaattcaccatcatctgtcagagattaaaggacacaccttagagagagtcatccacacacattcacacacgctagcaaccttcca

SEQ ID NO: 3569 - DNA, 340 bp, Homo sapiens
gtatgctctcagttgagaacaatggaatggatttctcaggagctttaagccttctttaaagtttaccagaatttagaacgtaaacatctgctcaaagttttaatcaaatgtagggaatatacaatgtggatatttctgtaactttgtcagctagaatattatgtttcacaagtctttaaaatggcatttttcaatcaatgtttgatcaaacacaccacggttaaattagtttgaaaaatacaacttactatatatagattgggctgtagtctcatgcagagtctggtgataactttggcatatcaaaggctctagtgagctccataataagatcttgttt

SEQ ID NO: 3570 - DNA, 315 bp, Homo sapiens
gaggcctccgagatagctgagggaagttctttgcctgctgtcagaggagcagctatctgattggaaacctgccgacttagtgcggtgataggaagctaaaagtgtcaagcgttgacagcttggaagcgtttatttatacatctctgtaaaaggatattttagaattgagttgtgtgaagatgtcaaaaaaggattttagaggtgcaatatttatagtgttatttgtgtcacctacaagcctttccctgaggtgttacaatcttgtcttgcgttttctaaatcaatgcttaataaaatatttttaagggattacag

SEQ ID NO: 3571 - DNA, 209 bp, Homo sapiens
ctgacattaacagttttccatgaaaacgttttatttgtgtttttaatttatttattaagagggattctcagatatttatatttttattttatttttttctaccttgaggtcttttgacattgtggaaagtgaatttgattgaaatatttaagcattgtttgcttattgttccaagacactgtcaataaaagcatttaagttgaatgcga

SEQ ID NO: 3572 - DNA, 285 bp, Homo sapiens
atttagtgccatgctagtgagtcccacgaattcagttcccacgccaaaccagaccccatggcctgctcagcctcagcggactttccgtgacatttctgaagatctgaaatcttcagtaggttgatgtggtttcctctgcagtgatttttctaggagttcaaatttgacagcgagttcagctcagctgtgggccttctgcccttccagctgtgcctagcaagcaaaacccaggaaagaagcagaagcctcctggccttacatacagaatgcctggacaagagaaac

SEQ ID NO: 3573 - DNA, 300 bp, Homo sapiens
ctgtcctttccccagtaccacattgttttgattactgaagctcagtggtaagtcttagatcaggtagagtgagtcctctaattttgtttagattgtttgcatttctatataacttttaaaaacagctttttaatttttagaaacaaaagtctgctgggattgtggctggaattgtcttttctccatagtcagtttggagaactgactttttaacaatattgattttccaacatatgaacctcatatgtttttccatttatttgtgtattcctaggtcccctcagcaatgttttatcattg

SEQ ID NO: 3574 - DNA, 360 bp, Homo sapiens
gacactagtggatccaaagaattcggcacgagaaataacttcactgaagtaaattcagatgccttaaaaatgtgcagggtcttcaaacgtccattctcagaaccttcagccaatattggtgtgtggcagttggcttttgaaacgatgagtgttatatctgtggtcactaactgtgcgctgattggattgtcaccacaggtgaatgcagtctttccagaatcaaaggcggacctcattttgattgtggtagcagtggagcacgcactcctggctttaaagtttatacttgcatttgccatacctgataagccacggcatatccagatgaaacctagccagactggaatttgagtctttgga

SEQ ID NO: 3575 - DNA, 146 bp, Homo sapiens
tccttgttaaatatcaggaatataggccgggtgcggtggctcacacctgtaatcccagcactttgggaggctgaggcgggcggaacacctgaggtcaggtgttcgagaccagccaggccaacatggtgacaccccgtctctactaa

SEQ ID NO: 3576 - DNA, 228 bp, Homo sapiens
gaactgcagaaaaaggaagaagagaatgctgacagcgatgatgagggggaactacaggatttgttgtctcaggattggagggtgaaaggcgcattgttatagggttttaaagacccaaggtttctaacagcctctgctgttgtataaaaagtgctgtctgctcagtagtatagcggttacttcatgcctcaagatttgggtacctggattgctaaactggattgttga

SEQ ID NO: 3577 - DNA, 219 bp, Homo sapiens
aataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgcgcgtggtggcgggcgctttaatcccagctacttgggaggct

SEQ ID NO: 3578 - DNA, 326 bp, Homo sapiens
ggcgagatcagcgccctgacggccgaggcgcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactacatccagcctggggctgagggctgaggcactcgcgaggagagggcgctcctctctacacacctactagtcaccagagactttagggggggggatccactcgtgtgtttctatttttagaa

SEQ ID NO: 3579 - DNA, 158 bp, Homo sapiens
ctccaccccatttgctcgcagtatcctagaatctttggctctcgctgcagttccctttgggttccatgttttcctgttccctcccatgcctagctggattgcagagttaagtttatgattatgaaataaaaactaaataacaattgtcctcgtttgaa

SEQ ID NO: 3580 - DNA, 374 bp, Homo sapiens
tcaagaccttcccctaccttttgtggaaccagtgatgcctcaaagacagtgtcccctccacagctgggtgccaggggaggggatcctcagtatagccggtgaaccctgataccaggagcctgggcctccctgaacccctggcttccagccatctcatcgccagcctcctcctggacctcttggcccccagccccttcccacacagccccagaagggtccagagctgacccactccaggactaggccagccctcagcctcatctggagccctgagaccagtccaccacctttctggcctcatctgacactcctccgcatcctgctgtgtgtcctgttccatgttccggttccatccaaatacactttctggacaa

SEQ ID NO: 3581 - DNA, 312 bp, Homo sapiens
agaacacattatgtacatgttttctattcatgtccagggcatgagaatcttaatattcttatacttccctttttgcatgcagtatgtctggaatatgtttataaaattttagcaaggggtgagatcaagggacagaggtagagtggttatttaaagacaatcagaaatgaccttaaaagctgccctgcaaaaccatcctttcctatcatgaagagtacctccatatttctagagattgtctctgaaccgttgctacatagccataaatgtctgtaaatcatgttggctatcagttcttgctattctcagagc

SEQ ID NO: 3582 - DNA, 215 bp, Homo sapiens
aaaagattttaataattagttgggcgtagtggtgcatgcctgtaatcccagctactctggagacaggtggaggggattgcttgagcctgggaagctgaggctgcagtagccatgactgcaccactgcattccagcctggttgacagagtgacccttgtctccaggaaaaaaaaaaggcaaatggggttagggcctcatggaatgggaggggaagg

SEQ ID NO: 3583 - DNA, 400 bp, Homo sapiens
ctccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaaggctgtggcactgtcctcctctccggtcctcgaagggccgagagtgtaccgcatttcggcaaggcccaggaccccgcaaagcaaacaaacctacgtccgtccagggccggagttcggcgtccaa

SEQ ID NO: 3584 - DNA, 175 bp, Homo sapiens
cggattggaagcttcggaagaggccctcgatggggcccacccatccccggacccaagtcttcttcctggcgggcctctcgtctccttcctcggtttgggcggaacgatcacctcggatgcctacgtggaagggacctcgaatgtgggaccccagccccttctccagctcgaaatc

SEQ ID NO: 3585 - DNA, 210 bp, Homo sapiens
gggttccagcttagctctctcagatcctatcctgtggatttagttattatgtgtatttatgtagtatttcaaacatttcaaaatgctttcatctatgtttatcacattttaataccacagcacttataatgatgtcactacatataggagctcacagttaaggggttttctgaggctgtaaagttattggaggacttgagacacactccg

SEQ ID NO: 3586 - DNA, 210 bp, Homo sapiens
gactgtttctaggcagtccttttacttatcccctctgttctgcaattcccaatcccctttgtccttacaatagtttagttagtgtcactttacaggtgactctcattcttacttagaggcctcttctctgtgttcctgtaccgcgtaggactatctctgtcttagcacccatcacataatatttgactaacttcacctatcttataactg

SEQ ID NO: 3587 - DNA, 102 bp, Homo sapiens
gagtacttcttagagcggccggggcccaatcggatttttccacccgggtggggttaccaggtaaagtgtacccaattccgccctatagtgagtcgtattaca

SEQ ID NO: 3588 - DNA, 265 bp, Homo sapiens
gttcctgctagcatggtgcatacatcttggaggtggcgcacagttaacaatgaaccaaattacatgagcaagatgagttttactaactgctatggaaattaaatggagcattattggtagaatgggcctattaaagaaggggtctttttattcggttgtatgatcaggaatgacctgttggaaggaagtgattttcaggcaagactgtatatctgacataaaggcacaaatccagacactaccactaactggctctgtgacttgg

SEQ ID NO: 3589 - DNA, 250 bp, Homo sapiens
tttttggttacggcagcacttttatttttccttacacaatgacgtgttgctggggcctaatgttctcacataacagtagaaaccaaaatttgttgtcatctcttcaaagaatcgagaattgcgtacaaaaaaaaccttacataaattgaggatgaatacatttacaggcgtaaatgcaaaccgcttccactcaaagcaagtaacacccaccggtgttctggccaaagcatcactaaggagggaactgggt

SEQ ID NO: 3590 - DNA, 131 bp, Homo sapiens
ggtcgacatkgrtcaagrwttggcacgrgscccaatctgatggtattaggagtggggctttgggaggtgactaagtcacgagggtaaagccctcatgaatggaattagtgccctcattaaagagatcacag

SEQ ID NO: 3591 - DNA, 183 bp, Homo sapiens
caaatttaggaacacattgagccttgggttaagtaaatatttcacttatatgggacacttggcctctgtcagaaattggcgaccagcctgggccgacatggtgaaacctcatctccactaaaaatacaaaaattgggcctggtgtagtggcacacgcctgttgccccagctagtttggaggcc

SEQ ID NO: 3592 - DNA, 241 bp, Homo sapiens
taaacaaggagagaagctatttaaacatgcaggaggcctttgagacagccgattgctacacccaggcctgaatcagccctaaggcttttttgaggctgaggcaaaaaataaaatccacgaatttggttagctttcctttcatgaaattagagatacactgttgtaaatacaaatcacctatagacacacatgactactgagagacttcaaggaaattaacctataatttccttaatctcat

SEQ ID NO: 3593 - DNA, 194 bp, Homo sapiens
ctttagaggacagaaaggataaggatgctaaattccgtctgattctaatagagagccggattcaccgtttggctcgatattataagaccaagcgagtcctccctcccaattggaaatatgaatcatctacagcctctgccctggtcgcataaatttgttctgtgtactcaagcaataaaatgattgtttaacta

SEQ ID NO: 3594 - DNA, 163 bp, Homo sapiens
gcggaagagggaaatgctaaaggagatgccactgcaggacccaaggagcagggaggaggcggccaggacccagcagctattgctggccactctgcaggaggcagcgaccacgcaggagaacgtggcctggaggaagaactggatggttggcggcgaagcggcc

SEQ ID NO: 3595 - DNA, 155 bp, Homo sapiens
ccagcaggaggcgccatcatgggagtgacatacgccataacaaggaccgaaagttcggcgcaaggagcccaagagccaaggatatctactgaggctgttggtcaagttatacaaggtttctggccagaagaaccaactccacattcaaccaggtt

SEQ ID NO: 3596 - DNA, 301 bp, Homo sapiens
ggcaggagcagggctggacgggcctgaaggagaccacgggccccaaggaccccaaggcgtgcccggcaccagcaaggacggccaggacggtgctcccggcgagcctgggccctcccggagatcctgggcttccaggtgccatttgggcccaggggacacaggggatcttcgacactcagcctgccaaggagccgtgttaggaggggtcggggagaaatcaggctctcgaagctcataaaattcaacgtgaggaagcaagttacaaggacgcccgcagcacagtggacgatcatgaaggagc

SEQ ID NO: 3597 - DNA, 326 bp, Homo sapiens
cagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttatcccaattaaaagtatgcagattatttgcccaaagttgtctcttcttcagattcagcatttgttctttgccagtctcattttcatcttcttccatgggtccacagaagctttgtttcttgggcaagcagaaaaattaaat

SEQ ID NO: 3598 - DNA, 322 bp, Homo sapiens
cccttgcgcttcccgagctggcggggtccgtggtgcgggatcgagattccgggctatggcgccgaagttttttcgtcagtactgggatatccccgatggcaccgattgccaccgcaaagcctacagcaccaccagtattgccagcgtcgcgcctgaaccgccgctgcctacagagtcacactcaatcctccgggcaccttccttgaaggagtggctaaggttggacaatacacgatcactgcagctgctgtcggggccgtgtttcgcctcaccacctgcatcagcgccatgtcgcgagagccgacgacccctgaactacttc

SEQ ID NO: 3599 - DNA, 161 bp, Homo sapiens
atttaaaagggcttcgctcatatataggaaaatcgcatatggtcctagtattaaattcttattgcttactgatttttttgagttaagagttgttatatgctagaatatgaggatgtgaatataaatgagagaaggaagagagtaaagtagagtgagtctcc

SEQ ID NO: 3600 - DNA, 203 bp, Homo sapiens
ccccccaccccctggattttccttctccctccatcccttgacggttctggccttcccaaactgcttttgatcttttgattcctcttgggctgaagcagaccaagttccccccaggcaccccagttgtggggggagcctgtattttttttaaacaacatcacacattccccacctgggtgctccccctttccatggtgccaact

SEQ ID NO: 3601 - DNA, 338 bp, Homo sapiens
gtttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcaggttcggatgagaccaggtgttgcttgttcagtatctcagcccagaaagatgaattaatccttgaaggaaatgacattgagcttgtttcaaattcagcggctttgattcagcaggccacaacagttaaaaca

SEQ ID NO: 3602 - DNA, 103 bp, Homo sapiens
tccgccgctggcagtgcagtgccgacttgggggggtgctctcaccctctcagtggcggcgatgcagcagtccaggctgtgttgtgcttggccacgtttgtggt

SEQ ID NO: 3603 - DNA, 144 bp, Homo sapiens
tcaggcacgtgtcgccgatccgtcgcgtgccccagcgctctgcctcttgtccgatttgcgattgtgttggcggggtgtcccaggtgtctaggttgtgtttcgaaggcgtgtcccccctatggggtggggtgctccagatcgtac

SEQ ID NO: 3604 - DNA, 132 bp, Homo sapiens
ctcattgtgccatatcgaatgattgcaaactcggctgtgcccctatatatggtcccgggggtattatttataacgggtcaaatcacatgttcaatattaatggtgggcgtgttgatggcctgattaggtcat

SEQ ID NO: 3605 - DNA, 115 bp, Homo sapiens
gctgtccttgcggagccttcctatccggcgggctttggctgttcttgagcttgtgcacttcggagcctgaggatctgtccccgccgggatatgggttcctccctagctcctggag

SEQ ID NO: 3606 - DNA, 106 bp, Homo sapiens
caggcagtcgcatggcgatgtgtcatggcagggggcgcaggtctgtgtcacgcgcacgtgtgccatgtgcactcctaccgcatggtttgcttgcgccgctctcagg

SEQ ID NO: 3607 - DNA, 154 bp, Homo sapiens
catcatgcacactggccagccacgccggcatgtccaatgcgcagtggtttcactcaccatgtgtcagtgtggtgtgccacatctgtggccatgtgtcgtcggggcttgtgtttttctagtgcgcggcccgcttgtcacgctgggcaggctccat

SEQ ID NO: 3608 - DNA, 112 bp, Homo sapiens
tccccttacattacatccgacccccctgcttgattatggggtcgtactggccgggactactccgtctacgtcttgctgtatcttcctcacgtgggtccgctctttctcctct

SEQ ID NO: 3609 - DNA, 102 bp, Homo sapiens
gacttcactccctgcggacggcttacttctgacggcgctgcactggggactactctcccggtctcttgccgtgggtacggcggggctcgcggtaagtacctc

SEQ ID NO: 3610 - DNA, 167 bp, Homo sapiens
tgagcttttcaggagagcgagtttaagtttgcaaagtacaagctgcttccggagataaattcgttcctcaaggtgtagagggagaaaggcccaatctctaaggcccatctcctcttctttttctctaacgtgccaagatcaagtcaccctgcttcttgggctctcaa

SEQ ID NO: 3611 - DNA, 262 bp, Homo sapiens
gaaattcgctgggggccaggcacgttggctcacacctcttaatcccagcactttgggaggcactttgatccacctaaggtcaggagttcgaaaccagcttggccattacagggaaccccgctttctattaaaatatacacaaattaaaaaatttagccaggcatggtggcaggcgcctgtattcccagctmytttggagcctgagacaggagatttgcttgaccctgggaggcagagtttccagtgagcagaggttccgcca

SEQ ID NO: 3612 - DNA, 360 bp, Homo sapiens
cgtcattctattcttgctgcctggaatgtccttcctttccattgccacgtgtacaaattcaaccccttgttctagacccagcacaaacatcacctaaacattccgtgaagcctttgatcttgctcaaagcctcctcctcgtgtttagggtgttttttcatctctgttatgacacagtattctcggtcacagcctataattcctcgtggcagccatcctatagaatacttgaaggacgtatcagattttaggtatatttttgtcattctagcagtcacactgagtcttgacatagaaactctctactctttgctaaatgcatttatttagaatctcctagcttggatagagtgggattagt

SEQ ID NO: 3613 - DNA, 321 bp, Homo sapiens
gaagggagccgccgccatgtctgcgcatctgcaatggatggtcgtgcggaactgctccagtttcctgatcaagaggaataagcagacctacagcactgagcccaataacttgaagggccgcaatttcttccgctacaacggactgattcaccgcaagactgtaggcgtagagcagcagccgacgcaaaaggtgtcgtggtggtcattaagcggagatccggccagccgaagctgccacctcctatgtgcggacaccatcaacaagagtgctcgcgcacgtcagcagcatcagacacatgatccgcaggacaagtaccgccc

SEQ ID NO: 3614 - DNA, 249 bp, Homo sapiens
ctcgtccatttttggcagggtggaacgccgaggacttaaaaaagggtggcgggcagtagcagcagccactctaggcagcagagttccgtcaacccagacccagttgcactagacgcgcatcgggaattccttcacaggcctgcgtctggatacgtgccacaggagatctggaagagagctgaggaggccggtcaatgaggtgaagcgccagcgatgacggagctgacagaaggacgtgtctgaggcgga

SEQ ID NO: 3615 - DNA, 226 bp, Homo sapiens
aatttaaagttccagattttgagctactattgctaacagatcccaggtttatgtcctttgtcaatcccctttctggcagacggtcctttaataggactcctaagggatggatatctgagaatattcctatagtgataacaaccgaacagatgttaccactgtaccagactcagaagacctatgaaaagaagttgtatgtgccacataaaactctgaatataaaggt

SEQ ID NO: 3616 - DNA, 105 bp, Homo sapiens
aatttttttaggtagtacgcagagacgtagttaacattaaaaaagcaattcttttgggcactttttaatatccaactaggggttttttttggtgttattgttgtc

SEQ ID NO: 3617 - DNA, 408 bp, Homo sapiens
gacactagtggatccaaagaattcggcacgagcgccagtccctcagcaggcttcccaatggatttcaatgtcactctacgccttcgagctgagctggggagcactccattctgcctgggtgacaatgccttggtttcaccactatcggaatgtgactatcgggcctccagaaaacattgaggtgaccccaggagaaggctccctcatcatcaggtctcctctccctttgacatcgctgatacctccacgcctctttttgtatatgtccattactggaaaaggaggatccaccaggtcaaagcctttcagaggactccattcattggtacttaaaccctccagagttctgtttcaagccagccactctttggcaaagtacactgagggtcggcattaagacaatctctc

SEQ ID NO: 3618 - DNA, 369 bp, Homo sapiens
ctcgtccattttcggcacgaaaaaattatggagtgggaggacagtatgaaccgcacttcgacttctctaggcgacctttttgacagcggcctcaaaacagagggggaataggttagcgacgtttcttaactacatgagtgatgtagaagctggtggtgccaccgtctccctgatctgggggctgcaatttggcctaagagggtacagctgtgttctggtacacctcttgcggcgggggaaggtgactaccgaacaagacatgctgcctccctgtgcttttgggctgcagtgggtctccaataagtggttccatgaacgaggacaggagtcttgagaccttgtggatcacagagtgactgacatcctttb

SEQ ID NO: 3619 - DNA, 192 bp, Homo sapiens
ggaattttatgtcaggaagtgtggtgatattcttggggtaaccagtaaactaccaaggagccaacaggatgcccaaacatataccttgagcacgtcttcttacaagtggtggagttcacgaaattgaaccaggacatgacatcgatacacgtgaaacagcattccagacactttctgaggaccatgactctg

SEQ ID NO: 3620 - DNA, 213 bp, Homo sapiens
cttagatagcttttatgaatatagcttaaaattgttgagatattccaatacamccacactggccttcatgggtaaggggcagactggatgttttactctttcacacccagccctgttttctcagtacataccttggtcatgggttactaattgattactttgaggaggagagagggcgcacacaacactgatgagtcaatgccatacctcaga

SEQ ID NO: 3621 - DNA, 332 bp, Homo sapiens
ccggccgcgaggtagaaaaggccaaacgggccctgtcttctcagcatcaagcaagaattgaaattgagtccttctatgagggagaggacttttctgagaccctcgactcgggccaaatttgaagagctcaccatggatctgttccggtctactatgaagcccgcccagaacagtgttggagattctgatttgaaggaggtctgatattgatgaaattgttcctcgttgggtggctcgcctcgattcccacagatcagcaactggttaaagagtcttcattgcaggacccatcctgggcataaccaagatgatgctgtgcgtatggtctgctg

SEQ ID NO: 3622 - DNA, 212 bp, Homo sapiens
tcagtcacaacagcagcctagcagtacacccgagaagcgaagaacctccctcattccaggcccaagtcacccaacatgcaggacctgaagaggaggtttaagcaagccctctctcccaaagtgaggcttgtcacttccgtttgtaggcaggaggagcactcagggggtttggtttccccaggaggaggcctsaggttttcctagtcaggacc

SEQ ID NO: 3623 - DNA, 117 bp, Homo sapiens
ggcgacgcggctgagggcttctcgtcggggtcggggctgcagcgtcatgccggggatagtggagctgcccactctagaggagctgaaagtagatgaggtgaaaattagttctcttgt

SEQ ID NO: 3624 - DNA, 188 bp, Homo sapiens
agctggcaacctcaagaaggccctgctcatccagggctccaatgacgtggagatccgggcagagggcattagcaggttcacgtacactgccctgaaggaatggctgcacgaaaacataccgctaagtggggcagattgttatcgagtaccgtacacagaggacctcacgcctccctatcattgatata

SEQ ID NO: 3625 - DNA, 202 bp, Homo sapiens
ggaattcggtgtggacatagggccggtctgcttctttgtaaaaacctgaacccagaaacacacacattccgttgcaaccccaaaggaccaaggtactttccattctcagtcactctaggactctgcactgaatggctgacctcacctgatgtccatacatcccacctctcacagtgggacttttctccctctctttctgaga

SEQ ID NO: 3626 - DNA, 143 bp, Homo sapiens
cggcacgagggcgcctgaaatcccagcctactcaagaggctgaggcaggagaatcgcttgaacctgggaggcaaaggttgcagtgacctgagattgcgccaccgcactccagcctgggcgacagagcgagactccatctttaa

SEQ ID NO: 3627 - DNA, 194 bp, Homo sapiens
caacagcctcaagatcatcagcaatgcctcctgcaccaccaactgcttagcacccctggccaaggtcatccatgacaactttggtatcgtggagggtctcatgaccacagcccatgccatcactgcccacccagaagattgtggatggcccctccggaatactgtggcgtgatcgccgggggctctacagaaca

SEQ ID NO: 3628 - DNA, 406 bp, Homo sapiens
ctgccgcccgcgccatggctggcaaagcacacaggctgagcgctgaggagagggaccagctgctgccaaacctgagggctgtggggtggaatgagctggaaggccgtgatgccatcttcaagcagtttcatttcaaagacttcaacagggcctttgggttcatgacaagagtggccctccaggctgagaaactaggaccaccatcctgaatggtttaacgtgtacacaaggtccacatcacgtgagcacccatgagtgtgccgtcctttaagacggatcataaacctggtcagcttcatcgaacaagtagcagtttccatgaaatagacctgcccttcctttttgaattctccggggaaagggtgacttaactggagtcaggaggagctgaggagccttacctcca

SEQ ID NO: 3629 - DNA, 389 bp, Homo sapiens
gtttcttgactggaggccatcaaccctcttggttgaggccttgttctgagccctgacatgtgcttgggcactggtggggctcggcttctgaggtggcctcctgccctgatcagggacctccccgctttcctgggctctcagttgaacaaagcagcaaaacaaaggcagttttatatgaaagattagaggcctggaataatcaggctttttaaatgatgtaattcccactgtatagcatagggattttggagcagctgctggtggcttgggacatcagtggggcaaggttctttgttcctggtcactgtatttgcttccggtcttcctgtgatgcctcttgggtctttggtttggtggaggaggccattgccctaattacctgctagctt

SEQ ID NO: 3630 - DNA, 332 bp, Homo sapiens
acgatactgagcttcttcctatttgccatggctttcactgtataaataggagaggatgagagcccagaggtaacagaacagcttcaggttatcgaaataacaatgttagggaaactcttatctcagtcatgcataaatatgcagtgatatggcagagacaccagagcagatgcagagagccattttgtgaatggattggattatttaataacattaccttactgtggaggaggatgtaaaaaaaatgcctttgagacagttctttgcttttaatgtggttcttctgtggcttgtagatgtgagcatcctcttgaaatgtaattgtagttcag

SEQ ID NO: 3631 - DNA, 244 bp, Homo sapiens
ctcactgtcttaaatagaatttttaaatagtatatattcagtggcattttggagaacaaagtaaatttaacttcggccttctaaaattttttgtaaagactataggtttagacatctttctcattcaaatttaagatatctttctcccctggatcaatctatcaatattgatagaggccacactagtatatccctttatacatttacaccttcttatttagaggtattgatgcaaatattgaca

SEQ ID NO: 3632 - DNA, 373 bp, Homo sapiens
gattattacactcttgtgggaggcaacttaaacattatcagtaaaagaggtgctaccaaggtgcagtcaagttgctaatcatccgttatttcactataggaggctgaaatagctgcttccagctttcactttgctttgctgtcagtgtagtaacatttcagggataagtatttttatgtggctctaaaccttaactatacttaaatgaaaattgaaatactactgtgtaaatgacaggtatataatgtgcagtttttaatacatacattctgtgtataaggagatgggtgagtctactgcaggcacaattgaaatcctgagtttggtatatgggctcaccaaataatagggggaaacattttgaaggaacatg

SEQ ID NO: 3633 - DNA, 384 bp, Homo sapiens
ctcgtcaatttcggcagaaaaattcaagttcttgaatttgattctaagttgcatattataacagtctcgaaaattattttacttgcccaacaaatattacttttttcctttcaggataattttataaatcatttgacctacctaattgctaaatgaataacatatggtggactgttattaagagtgtttgttttaagtcattcaggaaaatctaaacttttttttccactaaggtatttactttaaggtagcttgaaatagcaatacaatttaaaattaaaactgattttgtatctatttgagtatatatggaggctgaaataatgtttattcttataaagggtaattaattgcccaggttccctggacagtcactgatattgt

SEQ ID NO: 3634 - DNA, 348 bp, Homo sapiens
tcgagttttttggtggttttaggaaacagaatgcatttaaaaatggactgaattgttttggtgctctttaaagatgagatgcattttcttttggcttgtgggaaaaccagcactgtcacttactccagagcagagattccatctgatttatggcattcaagatttacctggggagctttaaaaattataaatttccttggagtccattctcaaaccatttgatttcataggtttggtgtggagcccacaactgttttttgaaaaatgtcatgggtaatcatgatgtctagctagaatgggagcttgtcttgggggtgaattaactccctctatttgtgcacaggaagg

SEQ ID NO: 3635 - DNA, 314 bp, Homo sapiens
aaacaattcatgaaagtggacctttaaaagcttgtcagagttgcacaaatctaactggtattttgtttttgtttttaggaggagatgttaaagtaacccatcttgcaggacgacatttaagattggtcttctgttgatctaagatgattattttgtaaaagactttctagggtacaagacacattgttttccactgtatatagctgccaattagttttctttgttttacttgcctccgctatcgtgtatgactcatgtgattgttatacacatttatagtatcattcatgtaacctcaataatgctcctatgta

SEQ ID NO: 3636 - DNA, 386 bp, Homo sapiens
agaaggagcgcatctgcagaagggctccggcttccacctggacctgctgctcatcgtggccatgggcggcatctgtgccctctttggcctgccctggtttggctgctgccactgtccgctctgtcactcacgccaacgcgctcactgtcatgagccaaggctgtcgcacctgggggacaagcccaagattcagggagtcaaggagcagcgggtgacggggctgctggttgccctccttgtggcctctccatagttatcggggatctctccggcagatcccctggcgtctctttgaatttctgtacaagggagtcactccttaaggggtccagtttatgagcggctgatatttggtaagccgccaaaaccaccagattttattaagg

SEQ ID NO: 3637 - DNA, 354 bp, Homo sapiens
ccaaattgggcaagttcatgaaacctgggaaggtggtgcttgtcctggctggacgctactccggacgcaaagctgtcatcgtgaagagcattgatgatggcacctcagatcgccctacagccatgctctggtggctggaattagcccgctacccccgcaaagtgacactgccatgggcaaggaagagatcgccaagagatcaaagataaatcttttgtgaaagtgtatactacaatcactaatgccacaggtactctgtggatatcccttggacaaactgtcgtcaataaggtgtctcagagatcctgctcttaaacgaaaggcccgacggaggccaaggtcaagtttgaaggg

SEQ ID NO: 3638 - DNA, 335 bp, Homo sapiens
tggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacatgtgggctccaagcagatgcagcagatccccatgtcccttcgcgggaaggctgtggtgctgatggcaagaacaccatgatgcggaaggccatccgaggcacctgaaaacaccccgctttgagaatctctgcctatatccggggatgtggctttttttcaccaggaggccccattgatagga

SEQ ID NO: 3639 - DNA, 181 bp, Homo sapiens
caacttgcagataaggagcgggtgcagctgccctggagaacacccacctcttggaggttgtgaatcagtgcctgtcagcccgctcctgagcctggcctttgacccctcagcctgcatactggtatcctggtccagctcctgccagggctgttaccgattgttttcttgaatcactcacaat

SEQ ID NO: 3640 - DNA, 127 bp, Homo sapiens
ccaggccctgtcctcgtgtccctcacacccgtttgcgtccgttcatgtcatgtcaaaaaaaacattgtgttgaggccaccttgtgttccccagccatagtgcgtagggcccacccagcgtaaggtgt

SEQ ID NO: 3641 - DNA, 219 bp, Homo sapiens
ccctcagtgaatagtgactacatgaagggggcacttactagaggcctgagtaatggaatttcaattagcttctgcttcccttttctaaaaaagaaccacctatgcttaagaataattaggccaaaataaacttgagtaatttgtacagtcaatattttgaagtttcggagttaaccgtgaaatagcaagctgttctccaggaaaggacatccagggttc

SEQ ID NO: 3642 - DNA, 251 bp, Homo sapiens
ttgggtagaaattcctgcctcgttcaatgcggcaagtttttgtatataagataagtacggtcttcatgtttatagtccaaatttgcaaaccctacaactctcggtgtcataggtctattttaagggragagagagaaaaacacccttactatcttgggaggcaatattaacaaacagagcttttttcaaatagcaattgtacttttctacctgtacccttttacataaagtgtttaaatttcagaaggtct

SEQ ID NO: 3643 - DNA, 223 bp, Homo sapiens
caagattcagcgtcttgttactccacgtgtcctgcagcacaacacggcggcgtattgctctgaagaagcagcgtaccaagaaaaataaagaagaggctgcagaatatgctaaacttttggccaagagaatgaaggaggctaaggagaagcgcaggaacaaattgcgaagagacgcagactttcctctcttcgagcttctatcttctaagtctgaatccagtca

SEQ ID NO: 3644 - DNA, 204 bp, Homo sapiens
ctccctcccaccttcctcccacctcacctgtcgcacccactgtgaaagttggaatatgtggtctccctggcctcagggctctgactctgccagggtggggctctctaacccacaggtgttggctgccttgcccatgttcccactgtctctttcacttggtctgggtttggcaggcactcctcttacttgagggccaggattctc

SEQ ID NO: 3645 - DNA, 201 bp, Homo sapiens
aaacaaacaactgatggtcctttttgtttccttaattttattctttcttgattttcatagtatcgttttttactcagttctcttcatacttctgtatattccttttctttattctcttagagtccttggcttacaccctaaacactgacatatttccacctcaacccacttctctattgctcaattctcgagtgatctctc

SEQ ID NO: 3646 - DNA, 148 bp, Homo sapiens
caagaatcagctgaaggaattgccagaaaaaattgcccaaaactcttcaggagctgcgtgcccatgagaatgagatcaccaaagttgcgaaaagttactttcaatgggactgtaaccagatgattgtcatagaacttggcaccaatcc

SEQ ID NO: 3647 - DNA, 171 bp, Homo sapiens
cttgaccactatgctatcatcaagtttccgctgaccactgagtctgccatgaagaagatagaagacaacaacacacttgtgttcattgtggatgttaaagccaacaagcaccagattaaacaggctgttaaggagctgtattacatttatgtgtgccaaggtcaacaccct

SEQ ID NO: 3648 - DNA, 275 bp, Homo sapiens
ccccaatttacagggtgactcacagccacattggtgactcacttcaatgtgtcatttccggctgctgtgtgtgagcagtggacacgtgaggggggggtgggtgagagagacaggcagctcggattcaactaccttatataatatttctgaaaacctaccagccagagggtagggcacaaagatggatgtaatgcactttgggaggccaaggcgggaggattgctttagcccaggagttcaagaccagcctggcaacataccagaccccgtctctt

SEQ ID NO: 3649 - DNA, 320 bp, Homo sapiens
gtcagccagcagttgaaacaagggctctctgctatctcacatctgaattgaattgtttcctacagacttctcatagctctctaggcaaggaatacatcttctcaccttcccacactaagaaaggcctctgtctgagcctgggtgccgggtggccaggattcctgctgaacgttcaggagctttccatctccagaggtgagctcctagttcctgcttaccttagaacttgtagacatataatgttacactgaaagaacctctcgtatagttggatcacacccttaccatatttatttaaatgtactgctttaatatgtaca

SEQ ID NO: 3650 - DNA, 255 bp, Homo sapiens
ggcacgcggcctgctttggcctgcagcccggctgctgcggcagatggggagccgccagatcgccatcgcgggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggcccacgtggagcgggactttttggaggcgccttgcagattctg

SEQ ID NO: 3651 - DNA, 315 bp, Homo sapiens
gcacgagagaacagccacagcagatgacaaaaaacttcagttctccttaaagaagttagggggtaaacaatatctctggtattgaagaggtgaatatgtttacaaaccaagggaccagtgatccactttaacaaccctaaagttcaggcatctctggcagcgaacactttcaccattacaggccatgctgagacaaagcagctgacagaaatgctacccagcatcttaaaccagcttggggcggatagtcttactagtttaaggagactcgccgaagctctcccaacaatctgtggatggaaagcaccacttgct

SEQ ID NO: 3652 - DNA, 345 bp, Homo sapiens
aagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctccgcagggccaagttcaagtttcctggccgccagaagatccacatctcaaagaggtggggcttcaccaagttcaattgctgatgattttgaggacatggtggctgaaagcggctcatcccagatggctgtgggt

SEQ ID NO: 3653 - DNA, 340 bp, Homo sapiens
ggggcctccaggagaggtgggaccccgaggacccagggcttcctggcagtagaggagaattaggaccagtgggatccccaggcctaccaggtaaactgggttctctgggtagccctggcctccctggcttgctgggccccctggacttcctggaattgaaaggtgacaggggtgtagtcggtgaaccgggtccaaagggtgaacagggtgcctcttgtgaagaaggtgaagcaggagaaagggggaacttggagatataggtttacctgcccaaaggatcttcaggtatcctggggcacctggcttgagagccttaggaagtggggcctcctggagtgga

SEQ ID NO: 3654 - DNA, 307 bp, Homo sapiens
cccaagctatctaaagtttgttagatagctgcatgtggctttttttaaaaaagcaacagaaacctattcctcactgccctccccaggtctctcttaaaggtgggattttaccaggttaatttactcagcaggaattggtgatcactccaggtaggtttgggggcaaaaattccgagggtgctttggggagttttgaatgttagaattgaccatctgctttttattaaatttgttgacaaatttcctcattttcttttcactcgggctggttaacacagtcaaatattctaatcctcgtattttaagg

SEQ ID NO: 3655 - DNA, 303 bp, Homo sapiens
aattgtctgaacagtagaacgatacaatcctgaaaataatacctggactttaattgcacccatgaatgtggctaggcgaggagctggagtggctgttcttaatggaaaactgtttgtatgtggtggctttgatgggtctcatgccatcagttgtgtggaaatgtatgatccaactagaaatgaatggagatgatgggaaatatgacttcaccaggagcaatgctgggattgcactgtagggacacatttatgcagtgggaggattcgatggcaataatttctgatacggtggaggttttacct

SEQ ID NO: 3656 - DNA, 305 bp, Homo sapiens
gcttcggggcggacgtgttgagtcccttgccgcatgtattggactccaagggggccactcagagcctgttgctgagacacttctgttctcgcgggtgtacagcaagtactcagtgactgtgtggtggggggagctggggcccgggcattaatagatgatccacagagctgtcattctaagtctcagtcagagccataggggttccagcagagattggtcactgaggtcagggttcctccaccacaggaggggccttgacaaatgtggaccacttcttgattgggaccactaacttttattgggac

SEQ ID NO: 3657 - DNA, 310 bp, Homo sapiens
ctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagttattatcctactgaagatgtgcctcgaaagctgttgagccacggcaaaaaacccttcagtc

SEQ ID NO: 3658 - DNA, 245 bp, Homo sapiens
aatataaccagtgacttcaactttggcatttcattcatacttctgtagagaacggaaaactattgtccattaacatgatatgctaaacattctataaacattctggtatttatgtgagacttgcccatctactgtctggctgtgtctgccttttaatcatgaacagttacatgatttataatttcactgattgagattactttgtaaggagctgttcagaggaataaaatatgacctgtttgggg

SEQ ID NO: 3659 - DNA, 280 bp, Homo sapiens
cggcacgagccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcggtaggatgggtgagtaaaatgattcccttctccgattggccaaggccgatggcatcgtttcaaggaacttttgatggagag

SEQ ID NO: 3660 - DNA, 345 bp, Homo sapiens
tcgatgccggaaaaacaccttggcccgccggaaggcaggcacatgggcataggtaagcggaagggtacagccaatgcccgaatgccagagaaggtcacatggatgaggagaatgaggattttgcgccggctgctcagaagataccgtgaatctaagaaggtcggtcgccacatgtatcacagcctgtacctgaagggtaagggggatgtgttcaaaacaagcggatttctcatggacacaccacagctgaggcagacaggcccgcaagagctctggctcacagctgagcccgcagtctaacacaaggagcacgagcccgtgagacccctcagccaagaggagaga

SEQ ID NO: 3661 - DNA, 120 bp, Homo sapiens
ccagtcttgctgagccacccgctctctctgggtccatcccatccctgagccaggggagggcagcatttcatgggcatgtctatcagaggtgggccttgccagcctctcccccaggggttg

SEQ ID NO: 3662 - DNA, 198 bp, Homo sapiens
ggctcacgctgtcatccaacacttggggaggccaaggttggttgatcacttaggttaggagttaagaccaggcttggcaacattggtaaaccccgtctctatcttaaaatatcaaaaatatgcttggggttggtaatttgtcctttaattccggcgttctttggggggtatgggaggagagtttttttaaccacgagg

SEQ ID NO: 3663 - DNA, 138 bp, Homo sapiens
gttcgtaccaagaccctggtgaaggattgcatcgtgctcatcgacaggcacacctaccaccagtggtacggtgccatcatgcgttgccctggggccgacaggagggagccagagtcgtctcctcgcggaggagggata

SEQ ID NO: 3664 - DNA, 289 bp, Homo sapiens
gactatatcagtttttggaaagcagggttcctctgcctgctaacaggcccacgtggaccagtctgattgtctttccttacacacctatgttttttaggtagtcaacacttacagggagcacatctctaacacaggttctctgtgtcacatatgtgtttggtgacctcgatattgtgatattagagtagggccttctatattcgccatatcaccgtcgtttgtgtcacctcctgactcctcccttctgcgggatactagtggatgtattagtgatgattagtggtgataa

SEQ ID NO: 3665 - DNA, 235 bp, Homo sapiens
ctccagggaccaagtgttgagatttcaaggccggggtgagaccaaaggtacggttatgtcacagtcctaatgtgtggccttctctgattggtacatctccaacccaagagagtgtacacatacaaggcacccgaggacatgtcgcggggagacgcgagatcgtcgcactagagggctctgtgggccctctgtgggcgccctgttagagtgttacactacggggggccactacttc

SEQ ID NO: 3666 - DNA, 272 bp, Homo sapiens
ccatgctgcaggtatgaatcagcacttaggggctcatcttcattctggagttatttatgtggactctggatattacacaatttttggagtatagctcacagcgcaaaatatatgtgtcgtctctgggtgtgtgtgtgtgttatatccccatctctgtacatagtaccacagccacatgtgtgttctctctagcaccatcatcatcatgagcgcgatggtggctgctatatgtctcatatgagataagggtatattattatacactatgaatg

SEQ ID NO: 3667 - DNA, 170 bp, Homo sapiens
gatgatgccagttaattactttgaaatgctcctcaaccaggcaagggcaagactcatgcatcataggtggcacacaccacttctaaggacacagactctcagagcctttgcgtctcgcgggatgtgcgacacctatggtgtctctaacatttccaccttctctcacaagg

SEQ ID NO: 3668 - DNA, 155 bp, Homo sapiens
cacgttcttaggcttttgttactgataccctaaatcggaaagtttaggtcctgagaaagcaaggtcagcgtcctgaaattgctgactctgtgagagtatatcacactctctgcgcctcagatgtctccacatgaaatataatatctctcctctga

SEQ ID NO: 3669 - DNA, 173 bp, Homo sapiens
cagtatccttggggtgttgctgaagttgaaaatggtgaacattgtgattttacatcctaagaatatgttgataaggacacacatgcagggacttgaaagagaggttactaataatggtccaatatgaggactacagagagcagagaaactctgcacagtgtgaacttatatat

SEQ ID NO: 3670 - DNA, 301 bp, Homo sapiens
attatattctagataacacagctaagaaatggcccacatgttcattgaggctaactttctcactccaaagctatgaaggtctgaattagattgcctcaacctgaaaaggtcaaattgatcattgtttagtcataatgactctctatatgaactctgtggatttcaatttttaaaggtgtcttaaaattgaaatgtcctggtctaatttgctagcaattcattgtattggagtgcaaaatgtttgccatgagaagtatatggtagtgatttgccccctctccttatgatatgcccgcggtct

SEQ ID NO: 3671 - DNA, 285 bp, Homo sapiens
ccttgcctaacgcagccatggctcgtggtcccaagaagcatcttaagcgggtcgcagctccaaagcattggatgctgggataaaattgaacccgtgtgttttgctcctccgtaccatccaccggtccccaaaagttggaggagagtgttttccccctcaatcaattttcctgaagggaacagactttaagtatgcccctcaccaaggagatggaagtaaaagaaggattttgcatgccagcgggttcattaaaaatcgatggcaagggtccgaacctcgatataa

SEQ ID NO: 3672 - DNA, 222 bp, Homo sapiens
tcgtgacctgacctcgaggtggacaccaccctcaagagcctgagcagcagatcgagaacatccggagcccagagggaggccggcaaggaacccccgcccgcaccttccggttgaccttaaggatgttccacttttacttgaggagtggggagtacttgatttaccccaaccaagggcttcaaacctggatgccatcaaagtcttcttcaacatgaagattgg

SEQ ID NO: 3673 - DNA, 205 bp, Homo sapiens
ggttcttaaaggggcaaattacttagataataaagcagagggaaatattagattcggtatatcgttcttcaagacaacttgcctcttaagcgggatgtgaaatttttgggcaagacttttcttttaatttttggaacacagaatgttggcacgctttgcccctactaatagaatttgcctccctccggaattttggcggcacaaa

SEQ ID NO: 3674 - DNA, 244 bp, Homo sapiens
cctaaatcttaagaactttaattgacagtttcaattgaaggtgctgtttatagacttacacccagtgaaaggccaggccattaatgacaaattccttggaatgttcctcttaaggaaaataattgcttggtcaattcgaaggcttaaggcattttccggtttttttgaatggcttgggctccccctgcctgaatctaaaggtttcccggctttttcctccctaagggcccttttataccccttt

SEQ ID NO: 3675 - DNA, 341 bp, Homo sapiens
tcaggactccgaggaccaaagggccagcaaggtgaaccgggtccaaagggacagatggcctcgggtgaaattggtctgccaggacctcagggtccacctggacctcaaggaccaagtggtctgtccattcaaggaatgcccggaatgccaggagaaaaaggagagaaaggagatactggccttccaggtccacagggtatcccaggaggcgttggttacaccaggacgtgatgtctcaccaggccagaggggcctcccgggaaaggatggatcctcgggacctccaggcacaccaggcccaataggcattcctggcaccctggagtccaagggatcacagg

SEQ ID NO: 3676 - DNA, 260 bp, Homo sapiens
ctaatactaacatctcagacgctcaggaaatagaaaccgtctgaactatcctgccgccatcatctagtcctcaatcggccctcccatccctacggatcctttacataccagacgggggtcaccggtccctccctttaccattcaaatacaatttggcaccaatttggacttaacctacgggtacaccgactacggcgggctatttctctatctcctacatatctttccccattatttcaagagccaggggagccgtcgag

SEQ ID NO: 3677 - DNA, 265 bp, Homo sapiens
ctgaactgtaaatcttcaggaatatgtattaagattgtggaatgggtgtaagacaattggtagggggtgaaagtgggtttgattaaatggatcttttattggccctatgatctatcctttaacttgaaagcttttgaaaagtggaaaagggcaattttgttgcatttccccatttcttgtttttaaaagacccacaaatctcaagccccataaatggctcgtattgaactcttacatattgaattaaagtggttaaacacaaagg

SEQ ID NO: 3678 - DNA, 345 bp, Homo sapiens
atcatcctttgtggaaacaagaaggacctggatgcagatcgtgaagttaccttcttagaagcctccagatttgctcaagaaaatgagctgatgtttttggaaacaagtgcgctcacaggggagaatgtagaagaggcttttttacagtgtgcaagaaaaatacttaacaaaatcgaatcaggtgagctggaccccgaaagaatgggctcaggtattcagtacggagatgctgccttaagacagctgaggtcaccccggcgcgcacaggcccccaacgctcaggagtgtggttgttaggagagcacacaggtgttcatacagtaggcattttgggcacaatcgttg

SEQ ID NO: 3679 - DNA, 195 bp, Homo sapiens
cttggtgccgaagttcggcacgaggttattggcctgagcacagctgaaatctagcagaggtaactcttctggctccatagtctgttcacttgataattcagggttctactgtttggcgttcagaaccaatgagcagaaggaatcgatttattagcttaattatttacatacaatgggtgaaaactccaacagaag

SEQ ID NO: 3680 - DNA, 380 bp, Homo sapiens
ggaagcacgctcacaaaggtaaagactttttctgtggcttaatccttgtcatgttttcggctcatggacacaaggacacatttttcattgccttctctcacagggcttcttgcggcttcccgggttcactttcttgttgttcttttacactccctttcacaagaggacactttgcttccccccttcttcttcgtttctttggcatccccctagggaaccttgcacacaccagggtctctcgagcttcttggaccctgccttcttaccatgcccgctctttaaggcaggtcaggaggtcgcttgcctgggttcgaggtcctagttaaaataccttagtggcttgagacccttgggggtagggtaaactttttcaagccaag

SEQ ID NO: 3681 - DNA, 319 bp, Homo sapiens
gccatgtcaaccacccttgcactgtggaggaggagatgtctgtgcccttgaaagaactgattgagaagcatgctggggtgttcacgggcgggcttggggacaaacctcctttgcttgttgattccctgggcgggcttcgtcttaccccaacttgattccccaaaggtctggtgttgttgagacgggtgctgattgggacttcgattgcgctggtgcaggcacagacaagggccttgggcacaagcttgcgggtgattcggtcatgggaccgctcggacgggacaatcgtgaaaagccaatcgccccgcctcatttaagt

SEQ ID NO: 3682 - DNA, 269 bp, Homo sapiens
aaataatacattgaccactttccttcatttcttggggaaggaaaggagacttagagcagctggtgtgctcaccccttcctagtcaccttccatttaaccacaagactatgtagcgcttggcccctagcctctttgcaggagccttgttttcctaggcccgaactgtttggattacagacttggagggggtcaggaaactgttttacctttctttttccccctttggcatttaattaaaatttaagttaaattccttttttccacttcaw

SEQ ID NO: 3683 - DNA, 199 bp, Homo sapiens
cgtttcctaaatgtatgcttgtggacctgttttcaaatatatgttactgaccaattatttactatcctacatttttaatcataccagttttaggctaatgctaccaattacagttcagtctctccgtgggcaatttttttttaccctgaaaaccccccaataagtaggcaagttttaacccttttccaatgggcccaat

SEQ ID NO: 3684 - DNA, 90 bp, Homo sapiens
cggcacgagctcgtgcgaattcggcacgaggctgggcacagttacctgcttgctgttctcagatgcctcttctgttgacttccatctcat

SEQ ID NO: 3685 - DNA, 200 bp, Homo sapiens
gagcccagggtctaccatgcaagcagaggaccaggctttctgcaccgcagtttgtttaaacttggacctgtaattggtaagctatttatgggccctggcacttttgttccacacccaacacttccagcatttagctggccaaatggcggagagttttaatttttaacttatttgacaccggaaggtaattccgccgaatg

SEQ ID NO: 3686 - DNA, 209 bp, Homo sapiens
catcaacattcacaagcgcatccatggagtgggcttcaagaagcgtgcactcgggcactcaagaggattcggaaaatttgccatgaaggagattgggacctcccagattgtcgcattgacacccaggctcaccaaagcttgcttggccaaagggataagggatttgccactccgcaatccctgtttccgcgctttcccaggaacgtaat

SEQ ID NO: 3687 - DNA, 359 bp, Homo sapiens
ctttgatgtttttttgtcattgttctcaagtgcaatatgacaatgtcacactctagatatttcaaaggtgtcattaattttaggaaggcctaatttaaaccaattatttggtattatttttggtttgggcagggaaggggtgattaaggtaggggttatttacccccctaaatgggcccattctgcatttgtatcaggggctgggaagtgatttattctcaccacagttgtgacacactttgaaattctcctgagggtcactgaggatgctgtagtaggttatcaaaattattcgctacctaatcacatagaaggtaatatcttggtggccaccacagtgggtagcaagaatgatctgt

SEQ ID NO: 3688 - DNA, 280 bp, Homo sapiens
gccatgagtatgctcaggcttcagaagaggctcgcctctagtgtctcgctgtcgcaagagaaggtcttggttagaccccaattaggaccaattgaaattcgccaatgccaacctccgtcagcagatccggaaggctcatcaaaggatgggcctgatcatccgacaagccttgtacggtccattcccgggcctcgatcgccggaacaacacttggccccgccgaaaggcaggcacatggcataggtaagccggaggctaccagctactgccagtattgcca

SEQ ID NO: 3689 - DNA, 276 bp, Homo sapiens
catctaagccagagagagacagggcagctgggggccgggctctcagcagtgagatggcagccccttcctgcttgccacaaccacggtaagttctcaagtcccaacctcgggggattgttttcaagcaagggcttgtttgacccacaagcttgggccctgttccctctttggacctcggcttctaatcttgtcaaatagctttggccaacttgaacggacctaacgtccagagaccgagtcctttataggacagtctccgctctgccttcacaacgt

SEQ ID NO: 3690 - DNA, 209 bp, Homo sapiens
attttgcgagtactcaacaccaacatcgatgggcggcggaaatagcttgcatcactgcattaagggtgttggccgaagatattcttatgtggtgttgaggaaagaagcaattgacctaaccaagaggccgggagaccttacttaggatgaggttggacggttgatcaccattattcagatccagcagtcaaggtcccagcttggtcttg

SEQ ID NO: 3691 - DNA, 258 bp, Homo sapiens
gcggtggggcggacagccgggggtgcgcactttgggcccccctggccatggcggcgaaggtggactgagcaaccttccaaccgacttggaaggaaggcgaaaattcctttcctgaagggccttagttacaaagcagcgggaaggacattacttctgcaaggactttgtcaagcttgaggaggttcccgcaattgaaggagattggcgaaagggttgctctgtaagggttgagaggaccaggtatataaaagggcacag

SEQ ID NO: 3692 - DNA, 182 bp, Homo sapiens
ctccgctggtgatcaaggaggatgagcttcgagagtccattgaaattataacagacatctgtctttctgagggtagccagcctgttttcagttggtccctgggagccagctggagacaggtggtcctgtaaaagctttattcctaatgtgggccaatccactccaatgagtcttcaaaaact

SEQ ID NO: 3693 - DNA, 216 bp, Homo sapiens
ccaaggcgtgcccggcaccagcaaggacggccaggacggtgctccggcgagcctgggcctccggagattctgggcttccaggtgccatttggggccaggggacaaccggggatctgcgacacctcagcctgccaaggagccgtgttaggaggggtcggggagaaatcaggctcttggagcttcataaaattcaacgttgaggaagcaagttacaag

SEQ ID NO: 3694 - DNA, 237 bp, Homo sapiens
gcagcatcccatagcaccccgcccttgccccatcaccctgtgggctacatgcaggacacggcatgggccttgcttcccagaggcacctgttttggggtcttcttgagggcttgtgctttcacagctctctttgaagcagatgcttggtgacttggtaggctcttttatacctttgtcacaaggaagctttgtaaaaccagcagtgaaggaaatgttgccactgtctaacctaggcat

SEQ ID NO: 3695 - DNA, 174 bp, Homo sapiens
cagcagcacaatttatccttttctgttaaagggaaggcttcttttcagacttatataaggttttgaattttgggaaaatatattttttcttggggggtttgggggttccctggtttgtctctggtagagtacacaccctttttcttagagatttagtgatatagtgagatactc

SEQ ID NO: 3696 - DNA, 237 bp, Homo sapiens
gcaaagctgcttcaggacggttcgccaggaccttagcagatgtcgtccagtatcgaaggaagagaagcagacccaacttctttgccgaccatgtatcaactgcgtatattaaaagggtatttcccctgggatcgtgtccccatatacagaggtccctctccggatatccccttaactcctagggggtccccccattagacggaggggtactaacacacttggagactattttatgtg

SEQ ID NO: 3697 - DNA, 259 bp, Homo sapiens
ggagttcttagctaaaatattcttggagttattttattcaaacggctaatgtatattcttcacctagactttctacaaagtatactctggtaaagatctctctttgtgtaacacacacagtatcccatccgggtattttaaaatatttataaccaaaattttttggggagatcttgggaaacataatcctggggactacatctctaggaaaagtcccccaacccctgggaggtctatctggatggtgtccccataatgc

SEQ ID NO: 3698 - DNA, 186 bp, Homo sapiens
ccaattcttccagttgtttgccccaaggcggcttgttcaagcttcttcccaaaacctttatttgtggccttctagtctttggaggcctctaaatgtagaaattggggcccacaaagcttggccagagaccacaacgaggagagtgggttttgagcaatgtgggttttatatttctgggagggccct

SEQ ID NO: 3699 - DNA, 202 bp, Homo sapiens
acacttcagttgaaggaaacacaaagaggattgttaaaggctattatcaggaatcgattggagacaggctcacagaccctatttacaaaacaaccgcctcacattcaacacagggagagtatccccccccatccccatctctgtgtcccctccctccctacagggcgcgtgtgtaccccacctcccccagagcttcgcgggc

SEQ ID NO: 3700 - DNA, 169 bp, Homo sapiens
tatatattcattcatgcattccttagcttattcactgagctttttacaaacattttcaaggtccatatctctcccaacacatataagtgtaagcgcattggggctttcacaagagatatataatcacagtgtcccttctcttggggggggcgctatctatatgtctccc

SEQ ID NO: 3701 - DNA, 199 bp, Homo sapiens
caacattgggagcctaatcttcaatgtaggggccggtagaccttctccagagcatggtctcacaacagagaagtccttggaatcctatgtaatgtgtgtctcatagtgtgagagagagagaagtggggacgaaagagaagagagagatcctgagagagtctttatatatataaatgtggctttgtgtcttttgtgatta

SEQ ID NO: 3702 - DNA, 257 bp, Homo sapiens
cgccctttcagttctgcttgctgtccgcaccgctgcgttaaccggaaccggcgggcgaacagcatgacgtgtccgttttgagagacttcatcacaccccgactctgtgcccgttatatacacacagatatgggggagaagtatatgtgtgagacacactagaagaggtttttagccacagacccattaaattgtagatttttgggatagagagctatagcgcgtgtatatgattctctacaacagggggtagaagaa

SEQ ID NO: 3703 - DNA, 222 bp, Homo sapiens
actgtgagtcaagaattggcacgagccttttcctctttacacgaggctctcttcttgctcgagcccagctgagtccttgttcctctcctttaaggtggacaattctggcactttggaggtcaaggccaaggaaattaaggccgagatttagaaaaccaggctgagggctgcccctgagagagctcagacccctaaaccctctccctgttggtacacgagagg

SEQ ID NO: 3704 - DNA, 103 bp, Homo sapiens
ccagaatcccattttccaacttagttccaaagaacctttcccagtggatttgacacatttgagctagtctatgggagggtatattttaattaggaggaaaccc

SEQ ID NO: 3705 - DNA, 214 bp, Homo sapiens
ggagtgtgggcgagctccccagcaccgtggaatcactccagaaggtgcaggagcaggtgcacacgctgctcagttaaggaccaggcccaggccgcccgtttgcctcctaaggatttcctggaaagaacttttttttttggaaaacctaaaagcctaattaagccaagtggaggcggacttgaaaatgctcaggactcttgtggacagtttggtt

SEQ ID NO: 3706 - DNA, 122 bp, Homo sapiens
cggcacgagtcacagctgtttttagtagaagttaggttcttaaaatgtgcccatcgatggtcacttaaacatgttgccaggtaataggcacctccccagggcttcaaggcattgaaaagggc

SEQ ID NO: 3707 - DNA, 218 bp, Homo sapiens
cccagtgcgagcacccttgtttgggagggtggcagaggtcctgccaggcccacagtctgttcccctccagtcaaccttctttttgggcaagcagcacccaaggtttccatcccatagggaggtgttctttttgggaggggattttagccccccttgccccagggcacaagcccacaatcaaaagcttgttctcaagcaagggggccagagcgaggtgg

SEQ ID NO: 3708 - DNA, 230 bp, Homo sapiens
gaagtagacagtggctggtatggctcttaggctccctggggcctgctcagctcctcctgctccttgcctgttttcttgatgattttggggctttggaggtcccctttgtcctcatcttagacttaaatgtggggatccaggatggccctccctcccttttacccttccctccttaagcctgcaacctttatcctgggaacctgtcctccctttttcccaactattcatct

SEQ ID NO: 3709 - DNA, 237 bp, Homo sapiens
cagaggcggcggcaaccccagccacagagagacagtggcacctacgagcagccggcccctgatccatgaccgagactcttgtggggctcccagccccctctgcctcccgggcctacccccccgggccacttattgacttaacccaaggaacaagcacaatcccctggacaattattgactttgcctccaggtacgggcatcccccattaacctccaatttggacggcaggacccgtt

SEQ ID NO: 3710 - DNA, 296 bp, Homo sapiens
cccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggagattctgatgagcattactattcactgatgcagaaagacggtcttttgcataaaagactttttttaacactttggacttctctgaaatatttagaggtgctaatttctggc

SEQ ID NO: 3711 - DNA, 224 bp, Homo sapiens
ggaaggcccctccccgtcgccagccgggccctcatgctgaccttgcaaattcagccgctgctttgagcccaaaatgggaatattgggttttgtgtccgaggcttgttccaagtttgtcaatgaggtttatggggcctccagaacagaatgccatcttcctgaaatgttggacatgccagtgggtgtgactccttcatttttccttctcccttcccttgggacaa

SEQ ID NO: 3712 - DNA, 152 bp, Homo sapiens
gacaatcccaccttttcaacggggcttcaccaccaaatacggccgccaccaccgaaatgacgaggttctccggggaaaagtaccgccccagcgagggttcagaactatcactttggaaggaggtcaaccctttaaagaaccgtacaaggcct

SEQ ID NO: 3713 - DNA, 302 bp, Homo sapiens
gtcagacggatgggtgactagacccatggagaggaactcttctgcactctgagctggccagcccctcggggctgcagagcagtgagcctacatctgccactcagccgaggggaccctgctcacagccttctacatggtggctactgctcttggagtggacatgaccagacaccgcaccccttggatcttgctgagggctcaagacagaggcccagccaccccaggggctccacaggcgctgtcatgcaaaccaatacagtatctagtgtctgtgtgagcacaagagtatagtataggtgtgt

SEQ ID NO: 3714 - DNA, 310 bp, Homo sapiens
aaaaaagcaagagagaacactgtagagtttaaacacggtttctttatctggtgcccgcatggggagatgaaggtaaagaggccaatttatccagcaaatgtgcccaagcaagtcgggaataattacctcccttgacatcttacaaacttgtctgcatcccacaaaaattctatagggcagtgcctctcacgtcatattcagagagaccaccatagtcaagtgagcgtcattattattactatatcgctcgtcgtcgcagtactgcacgagtgtactctggagagtctacatatatatcgcggtctactat

SEQ ID NO: 3715 - DNA, 311 bp, Homo sapiens
gccgcagaagcgagatgacgaagggaacgtcatcgtttggaaagcgtcgcaataagacgcacacgttgtgccgccgcttgtggctcttaaggcctaccaccttcagaaggtcgacctgttggcaaatgttggctacccttccaagcgcaaagagaaagtatatacttgaggtgccaaggcttaaagacgcgaatacacacgcgactgtgtcggatgtagggcacatctaaattgtatatcacgagagttcacagcatatgagtctctgtaggacacacatctaacccagagagcagcatgctgtcagcagt

SEQ ID NO: 3716 - DNA, 330 bp, Homo sapiens
gtactttccaatctcagtcactctaggactctgcactgaatggctgacctgacctgatgtccattcattccaaccctctcacaggttcggacttttctctccctctcttttcttaagagagacctgagactgggcaggacttcaaataaaatctctggtgttctatattaattaattgggccttccctgtaaggaccttcggggtcaaggcaggagacaggactctactctgggtgtagagatcatgtgccctgtagagtacatctcccagcccagagcacaagagactctcttagaggtcgccggcagcagcatctgtgtgtgtcctac

SEQ ID NO: 3717 - DNA, 322 bp, Homo sapiens
gtctttcgggggctccgtaactttctatccgtccgcgtcagccttgccaccctcatcttcaatatgcctgggtctgacccccagttgcacttaacgttggattcttaaggcggtcttccaggaaagcagtgtggccgccgggcggcggatatcactctttccgcaagaggaaatatgcagctgttggacacagagtgtcacagcgcacacactctcgcacaggacaccgggggatatgtcgctgattatacacaagagtatacatctggtctcacagttgcgtcctgtcacagtatagatgatgagtcttctgcacatcgct

SEQ ID NO: 3718 - DNA, 379 bp, Homo sapiens
ttccactgttaaaataaagcttacatagttttcttcctttgaaagactgtgctgtcctttaacataggtttttaaaggctaggatatttaatgtgaaacatccgttttcattgttcacttctcaacccaaaattatgtgtttgccacaacccaaaccaggttcatgaatatatgggtctatatatagatagacacatactctgagcgctaattgtttatactctgtataatatattcacagggttaaacacactactcacacactgtgtcgtcttcgactacaagcgcaacaaccttaagagcgcgatcatatcatgagtactctacatgctgcatcctggctagaacgcagctctgtgtatacagtatcagtatatca

SEQ ID NO: 3719 - DNA, 334 bp, Homo sapiens
aaataacaattttcaaaaatacatttttgtagtaaaaacgcaccatcggtgttacattacttgtataaatcaaatttgcttgaaggtttattaaacatttttattgtttactttaaactttggacattattcaggtctatcttgcttgtctgacgacattggctctcaatatataaatatcaccgttttcctgcttcaaggctcacattctcacagaggtaaacgcgtatatgtaggggatatactctagtcacatgaggttgtttgtaggaaccccttatcacatatggagagatcactgatattcttcatcggcctaggatcagtcgcctag

SEQ ID NO: 3720 - DNA, 349 bp, Homo sapiens
ctaaatctcaagcttggacccacgggttattttttttttccaaagcagtaatcactgttctcagcatttcttttaggatcgtgatttaccaggccatacccttcaaaggtcctcataagtgtataaagtaggatattagtattggaggcagcatgaaattgtgaggaaggtataagcaggatgctagaagattcttatagagtaggaaaatatactctacctactctaatatagtgtaacaccacagatcataggtgtgtcactctcctctaaagatgtgatgatactctatctataggtttacaacccaatatatacatggtcacacacactggaaaaaaaaaaaaaa

SEQ ID NO: 3721 - DNA, 283 bp, Homo sapiens
ctcgtgtgtgtatgtgtgcgtgtgtgtatgtgtgcatatgtgtgtgtgtgtgtgtgtgtgcacgtcgcgcctggagggggggcatgagttttgccagaatgtgagtgtgagagtaataatgcaggggtgagtgtgagagggactgcgtttgcattttataatcaaaagcttaatatatcccatctttttgagttaaccctttctggactctgagccgtgcaatcactccactgatttctctattctccggggagaacaataaatgtgattacgtgagcagtga

SEQ ID NO: 3722 - DNA, 368 bp, Homo sapiens
tgctcatcgacagcacaccgtaccgacagtggtacgagtccactatgcgctgccctgggccgcaagaagggagccaagctgacttctgaggaagaagagattttaaacaaaaaacgatctaaaaaaattcagaagaaatatgatgaaaggaaaaagaatgccaaaatcagcagtctcctggaggagcagttcagcagggcaagcttcttgcgtgcatcgcttcaaggccgggacagtttggccaggcagatggctatttcctatagggcaaagagttgagtctatcttgggaaatcaaggcccggaaaggcaaataaatcctttgtttgtctcaccatgtaataaaggggttattgttttgttccaca

SEQ ID NO: 3723 - DNA, 196 bp, Homo sapiens
cggcacgagaagttccagtagttagggcattcatttaatgtgcataggcactttctgtttatttaagagtcaattgctttctaatgctctatgggccgactatcaaggatattagtaagaaaggatcatgttttgaagcagcaggtccaggtcactttgtatatagaattttgctgtattcaataaatctgttttg

SEQ ID NO: 3724 - DNA, 209 bp, Homo sapiens
gggagttggtgctttcttttcctttttttttttttcccaggggagggaggagagaaggaaggggataagactttcccaaagggggaaagccgttaggttttaagagggccaaaaccaggccccgcaaaagtttttacctttcataaggtggtattggggtttggggaaaagccctcaacatcgtcctactttagaatcttcaaggggaa

SEQ ID NO: 3725 - DNA, 360 bp, Homo sapiens
tgccttcatgcgcctgctggccaactatgcctctcagacatcacctaccactgcaaggacagcattgcatacatggatgaggagactggcaacctgaaaaaggctgtcattctacagggctctaatgatgttgaacttgttgctgagggcaacagcaggttcacttacactgttcttgtagatggctgctctaaaaggacaaatgatggggaagacattcattgatacaaacaattagccatcacgcttgcccttccttgatatgcaccttgggacatcggtgtgctgcacaggattcttgtggacatggccagtctgttcaaataaatgactcatctaattaagaaggaaggaatttga

SEQ ID NO: 3726 - DNA, 193 bp, Homo sapiens
atgtaaacagatagagattatattgtagtgatgtatttattaagtatatttgggttaattttaccacctgaggcttattgttgaaccttattttcaaccaacctgtcagttaaatttgtatacgtattcacatactgaggatgaccgtaagtggccttaattttgggttcctcaatagcctgaattcctggca

SEQ ID NO: 3727 - DNA, 194 bp, Homo sapiens
tcatcaggcatgacaagtttctcatatatgatgtaactgctttaggcagtttaatgtgcttttaagcttaattttgtcatgcaactattttttcgactttgggaagtcagagtctttcaaatccaaccgttatttacctggagtcattgataagctgcattgcattggtcaggcttagcacacattttcgactc

SEQ ID NO: 3728 - DNA, 138 bp, Homo sapiens
gtaagacatttgtgattacatttcacattagatcactttcatataagaactagcagctgtagatgcatttaatattcatatgatcctcagcatcagctgttttgcagtttttagtaccggtaagaacctgcacctgga

SEQ ID NO: 3729 - DNA, 149 bp, Homo sapiens
agagtttgtgacatttatcactccttgaaagattaagacaccaaagaagttgggtgagtggaagcagaggaagtagtctttaaggctatgtattctgaatggctagtctgaagcataacctacattttggtaacggtcctaaggtaaag

SEQ ID NO: 3730 - DNA, 151 bp, Homo sapiens
tctctttgttatgtgtgtcatgacaacagatattcttctgatccgggagctgatccagtagaaaacatttaatcactctatatactttggatgaccaaacttttttttataggaagggattactgctaggattgctataatgaaaccttca

SEQ ID NO: 3731 - DNA, 154 bp, Homo sapiens
atttgatggtcccaaagtacggcagctgcaaaaagtagtggaaggagattgtctacgtgtcttggagaaaattagttaggaattttggatgggtaaaaggtacccttgccttactccatcttattttttttagccccctttgagtgttttaact

SEQ ID NO: 3732 - DNA, 182 bp, Homo sapiens
ctcggccccacgtccttagaggccagagcacatctgataactgcaatcacagccgtccgctggaaaaacgttttcgaagcacagtggccagcgagcgagcacgtggctactccctgttgcatgtcaaatccacacagatgtcagcggcagctgcttcgggcagacccagccctcgggctcgg

SEQ ID NO: 3733 - DNA, 195 bp, Homo sapiens
cggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgttgggatctcgcactctggtgtctccatatagag

SEQ ID NO: 3734 - DNA, 206 bp, Homo sapiens
acctgtttcaaagagtcagccggtaactcctgaaaacatcgagctagacaagacaggcatggcttttgggaggaggacaagaatttggagatctggcgtgaggcaatatggaacagggaaactggtctaacataactgttgcatactaaattcaccaacccgacacaggtgtcatgttaacggcacacatgggggcccatgaggac

SEQ ID NO: 3735 - DNA, 204 bp, Homo sapiens
gcaattggtcaggatttagacaatcaccttaactttagtctcagcagcatcatcagaatgggataaaggcccctgtgtttggtctccaaaatatacccttaaggaccactttttaaacattcctacttgcagcttcggttttctccttgctctggtttatatatatattgcagggcaccactgagatgcgccatgaatatccac

SEQ ID NO: 3736 - DNA, 195 bp, Homo sapiens
ggacagctccagcttctacgtggtcatgtggaagcagatggagcaaacgtattggcaggcgaaccccttcccgtgctgtggccgagcctgggcatccaactcaaggctgttgaagtcttccacaggccccggggaacaactgccgaacgtctgttgcattacagagacacacacgtccccagtgcgcgctctctg

SEQ ID NO: 3737 - DNA, 203 bp, Homo sapiens
gccaaccccgtgaactatggccggccctacagactttcctgcgtggaagcgtttgctgccaccttctgcatcgtaggctttccagaccttgctgtcattttgctgcggaagtttaaatgggcaagggcttctttggaccctaacccccagactctcggacaagagacgcgggctctcggcagaccccgaggaggtgtctctca

SEQ ID NO: 3738 - DNA, 190 bp, Homo sapiens
caaagttctgggaaagggaaagctcccaaagcagcctgtcatcgtgaaggccaaattcttcagcagaagagctgaggagaagattaagagtgttgggggggcctgtgtcctcgtggcttgaagccacatagagagagtttcactaaatgctaactcacttttaaaaaaaaaaaaaaaaaaaaaaaaaaaa

SEQ ID NO: 3739 - DNA, 185 bp, Homo sapiens
cgttggtaggatggtctggatggtatatattcaaggaaggtactagaatgaagtgcttaggacagagtacagaggtagtgcaccgccattcctggcttatagcaacttagtttctccattttttaaattttttggagggtaaatatatccattcttattttttcatagaatttttaaaatgggga

SEQ ID NO: 3740 - DNA, 331 bp, Homo sapiens
tcaaatgtttattttatatacaaaggaattatcatggtttttcattgagtagatgcccggataatctctgaagggaggagcatttagtccaacttattgaaaccgttatccttcgcgtactgacggaaccattggcggcacaatattgaggccatatttccgggatcagaccgtgccggttttgaccaggcacgcaaggagccagacccctggccgaattttcgcgggtggctccagtacaagcctcgtgccgaatttcggcacgaggttaaattgttaatttaggcaaaacagggggtaaagaattagccatcatctttcgcctgagagc

SEQ ID NO: 3741 - DNA, 280 bp, Homo sapiens
gtctaactgaaatttctcttcaccttgtacaattgacagctgaaaaaaaacaacatgggagtaataatgggtcaaaatttgcaaattaaggtactgttttggtgtgggagttgtcatgaggctgttttgaggtgcctaatctatgtggggaattgaggtatccattgacatggatttgttcagccatttaccattattgagcatttaaatgcaccagatatcatttcaggtgacttaacatgaatgattaaaagtcactgctattggattgttaaaaaaa

SEQ ID NO: 3742 - DNA, 206 bp, Homo sapiens
gttgaaggacaccagcttgcggaatttgcggctttggcagattgaaatcatggcaggtccagacagtgatgcgcaataaccagttcactggttttaaaaaaatatttcacctcttttaactttcacaggtgggatgaacctttttcctggcccacatatggcagcatgccattgtattgtccttatattgcaagttcgaggttcca

SEQ ID NO: 3743 - DNA, 322 bp, Homo sapiens
cagagtggtggctacagtgaccggagctcgggcgggtcctacagagacagttacgacagttacgctacacacaacggggtaaaaaccctttcctgctcaaggatcggtccttccaaattggcttgtgttgtttaaaggattgttgggggctttcgcttgaaccgttaaatgtgtaggtaaaatgcaccctccttgtaattcccacctttcggtagtcaatttcgggttctggatctttgtcaaacccagcctgaccgctttttgaggccggggatggcctcgttactagacttttctttttaaggaggggctgttttttttt

SEQ ID NO: 3744 - DNA, 298 bp, Homo sapiens
ggagactcaccaatacctggagctggagcctattctgacgatacttcagggacagccgcagccactgggaattggtgatatatttatgcgcttcctgccaagctaccaagctgtaggatacatgagaagggggagaggtccaaccatagctttccaaacagtgatttcaagagtccagaagcattttccagaattcttttggggctgttatatgttccaatgtgacttgagggtacggtgctgctttcaataaactttcacatttactcaggttagggtcatggggtatatttcggaa

SEQ ID NO: 3745 - DNA, 256 bp, Homo sapiens
ccactcttaatcagtggtggaagaacggtctcagaactgtttgtttcaattggcattaagttagtagtaaaagacttggttaatgataacaatgcatcgtaaaaccttcagaagggaaaggggaattttttgtggaccctttgggtttcttttttgcggtttgcagtttaagtattagttttaaaatcaggacttttaattggaacaccttgccaaattttcacacaattttgggccccttaaaaggttaatggga

SEQ ID NO: 3746 - DNA, 295 bp, Homo sapiens
cttggatgctatcagatcactgttctagaacctgcctcagcacagcccagccggccacatgcaggccatgagggcagggggctgctattcacggtcacccgcagggcaaaggaaaacaaggccagacccttttccagggcggccttgggcccaaagccgggcttcagggaccttgggcttgggccaccttagggttccccagtctttaggggaatttcccaacccaacccaaggttccgccaaggcccccaaattagcacaagcccaggcattggtagaaaccagctcctgagga

SEQ ID NO: 3747 - DNA, 233 bp, Homo sapiens
gatcaatcccactctaatatcagtttctgagttacaagacttttgaggaggaggagagatctcactttcctgccaaccgaaaaaaaaaggggatttgaccaaaattgaccagttgggttggtccctccaagtggaaagtagggaaaaggacccctcaaggcacaccaagccagtgtggggaggaccttcccatataatgtctatactttacaatgggttgagattgctcccct

SEQ ID NO: 3748 - DNA, 319 bp, Homo sapiens
tgataatgcctgtgttctttttgccgtctctgttcttatgtttataatcagttcaatgctggtttatggagcaattttctttatcaagtggggttggctgattccattcttcttgttacccacttttttgacttcgtgccccaagttgcccgggttgctattagttctctcacccattttgccaagagtcaaaagggtatcttggatcaactacccctattttccctacaaaagttgacctcctcgggcctttggctccagctgcctccccttcatagtgctcgtggtgcttctgcctcattcatcatcatttgagggg

SEQ ID NO: 3749 - DNA, 387 bp, Homo sapiens
catgctggagccaagtgctaacatgccttggttcaagggatggaaagtcacccgtaaggatgggcaatgccagtcggaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggagtgaaatctgtcggaatgcaccatgaagctttgagttagctctttcctgggggacaatgttgggcttcaatgtcaaggatgtgtctgtccagggatgttcgtcgtggccacgcttgcctgtg

SEQ ID NO: 3750 - DNA, 241 bp, Homo sapiens
cacagagggaagtttaacaccacacttcaaaggtttaactacctcacaacactttcccatgagtgtgatccacattgttaggtgctgacctagacagagatgaactgaggtccttgttttgttttgttcataatacacaggtgctaattaatagtatttcagatacttgcaggatgttgatggtgctagcaggaatttgcagaaggcatactcctgtattgagttgtatcgtgtggtgtat

SEQ ID NO: 3751 - DNA, 504 bp, Homo sapiens
tgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgaccaagctgcagaccaaggagcatgtgattgaggccctccgcaggccaagttcaagtttcctggccgccaagaggatccacatctcaaagaagtggggcttcaccaagttcaatgctgatgaatttgaagacatggtggctgatagcggctcatcccagatggctgtggggtcaagtacatccccaatcgtggccctttggacagtggcggcctgcact

SEQ ID NO: 3752 - DNA, 235 bp, Homo sapiens
cggcacgaggtcaaattttagtttaattggcattgcttgttttttgacactgaaattacctgagtttcattttttctttgaatttatagggtttagatttctgacagcagcatgaatatatcacctaacatcctgacaataaattccatccgttgttttttttgtttgtttgttttttcttttcctttaagtaagctctttattcatcttatggtgcagccaattttcaaatttg

SEQ ID NO: 3753 - DNA, 329 bp, Homo sapiens
gaaatctcctggagttcctggcgccgcgggacccggcgcaagacctgcttgctggtgacgtaattgtgcatgcgcggcccatccgcacgcgggctagcaagtactacatccccgaggccgtgtacggcttgccccgcctatccggcctacgcgggcggcggtggctttgtgctttccgggggcacgctgcaccgcctggctggcgcctgtgccaggtcgagctcttcccatcgacgacgtctttctgggcatgtgtcttcagcgccttccgctcacgcccgagcctaaccctgccttccgaacctttggcatcccccagccttcagccg

SEQ ID NO: 3754 - DNA, 121 bp, Homo sapiens
gaagaacgcagctagctgcgagaattaatgtgaattgcaggacacattgatcatcgacacttcgaacgcacttgcggccccgggttcctcccggggctacgcctgtctgagcgtcgcttga

SEQ ID NO: 3755 - DNA, 211 bp, Homo sapiens
ctcgtgcgaattcggcacgagttgatgactaaaattatttcaagtttgatgaaagtttcacacccacacagcacaatcaacttattcaaaacctgtgataaagggaaagtcttaaaagcactctgatagacaacacatgctatacataggagagcaaaaataaagataacagtagattccatattagggacaatgcaagagagaaggcaat

SEQ ID NO: 3756 - DNA, 301 bp, Homo sapiens
ctgcaatgtattggcatctaaaaactcccttatgaaactgccagacttgttctggaacatttcaattacatgcaaaattcaggttctcaagttggaacaagtctaattgacacacctgcataggttttaaccttgccctccccctacttcccaacagatttccaagttttttgagaaggaaccttgctctggcccaggctggagtgcagttgcgccatcttcggctcactgcaacctctgccttcctgggttcaagtgattctcagcctctgaggtagctgggattgcaggcacctgcacc

SEQ ID NO: 3757 - DNA, 202 bp, Homo sapiens
agggtttctctaaagcagttgtatctaagtgctaagttgtttccctggcctaaggtggtgctgtttatttagagcttgttaggttttaatatttcatggtttatcatgtaccctcttatttttgattagccttggtgacaatttcttaccatttaggatattattacaatggtgctaacaagaagctagataaagatataga

SEQ ID NO: 3758 - DNA, 242 bp, Homo sapiens
acggccaaaatccataaagattataaaagcaaactaagttgtgaagctatagtacatgtaggcatttagttaagtatagcaattcaaactgacctgcatccatccaaaacaaattcctccttcaaccttatttttacttgacatttgctagaaggaatagccaacccgaaatttgttttatgcatgagttaataccactggctcagcaaatacaaggttaggttgctttaagcaaggtacct

SEQ ID NO: 3759 - DNA, 240 bp, Homo sapiens
ccggaacaggaccgccagcagcttggaggaggacttgttcgccaagattcccttgccttgaggcagcagctttataaactctacgaggccgactttgttcttttcggctaccccaagcccgaaaaccttcttcgagaacttaaagcttttcgcgttgctttttytcgcgtgtcctttgaaccttaacgaacgcgcacttcacgtttttttattagcctaccgttttttgaatcttggctt

SEQ ID NO: 3760 - DNA, 242 bp, Homo sapiens
cttggatgggagctcgggctgagccggtgctagagcttgtatccatcactgaccacaaggacaactgtccttgagaccgagagtgtcccattacacacggggcgcgcgctgcgcgctctgtggggccccacgacctctaactctctcgcacagagttccgctgtaggggtgtactctccgcgagagagtgtgtgactcttatgatgatataagggggtacaacactatggctctagagagtg

SEQ ID NO: 3761 - DNA, 227 bp, Homo sapiens
ccaaaatgtacaaggccacaccggatgtcatctttgtatttgggatcaggacttaattttgttgtgcgcacagacacactctgctctttgcactatatattatatatatccctctgatatatatcacaagagaaaatagagacccccaacatatgagctctgcacagcagcatatggcctgcttatagtagagagagaagagagctctaagaagaagcgaccgcgag

SEQ ID NO: 3762 - DNA, 162 bp, Homo sapiens
ctcgtgccgaattcggcacgagcttgtgcttaatttggagctattcaagcagccaaaaacctgagtccttccatgtagtaatacaatgagatctctagagtttggttatatacgttttgcgcaaggagtgtcacattgtgtggggaatatgagaagagctca

SEQ ID NO: 3763 - DNA, 122 bp, Homo sapiens
cacttggaagatttctctctgggaatttgagggtttgaggaaatgttgcccttggaaagtttcatgcactatatgtctgtctatctttctgccagagagagctttccacagagagagtaatg

SEQ ID NO: 3764 - DNA, 295 bp, Homo sapiens
catttttgcaagccaaaagtcgatcaatcgcattcattttaaggaattataactttttagtacttgcttgagagagatgattcagagggtaaatcacatactcttgttttagagagagcgagaggggtttataccccagtcacaccagactctgtgcttctataacataagacacgacactctgtggaagggatttgaaatgtcagggttacacagtgtgagggggagaacgtgtgacaccatctctcactcgagacatcatcagagatcattttatgagctgatatacaaaatt

SEQ ID NO: 3765 - DNA, 245 bp, Homo sapiens
gtgcggcagccacccctgaggcctgttgcttgaactcttgacccaggcctttttcttcaggccttcctttacttcaaacctcttctctgctctcttttcctcgagatagtgtctttggctttcctctgtgtgtccagaaagagaggcactcaccacaagagagccctctctaaagcgttttcagagcaaacacgctttgagagtgcctctagagggagtgtgcgaagcgctcaatatcaaactac

SEQ ID NO: 3766 - DNA, 503 bp, Homo sapiens
  misc_feature 490, 493: n = A,T,C or G
gtgcggcagccaccctgaggcctgtggctgacctctgaccccagccctctttcttcagccctccctttactccaaccctctcctgcctgctttcctgagatgtcctggtcttccttggtgccagaagagggcactaccacaggaccctctcaagcttctcaggcaacagcttgaggtccctgaggggagtggcaagccctaatgcaactcaccctcatcctggtgcttaggtggcagagggtgggcagcaggggacagggatgggatggcaaaacaccaactgcccttggtggcaagtgggtggagatgggatgcgtgccaacctcagatgccaactcaagtcatcaaggccaaggacagtggcgaaagtgagtcttggggtaccttaggccttggctagtctgcgttcctctccctgcatgctgtgtatcctaactccctacaacaacccctcaaataaatcacatctagtgactggtaccaacaaggnggnaaaaaaaaaa

SEQ ID NO: 3767 - DNA, 170 bp, Homo sapiens
tgcaaccttccgggaaccatcttctcgggacatcttcctgccttcttggaacctgccagcaccggttttgtaggtagagttcctcttgggccaaccaaccatgagagtctccagagatcgcgcagagattatattccacacccgcgcgtgagagcacgacccctgcaaac

SEQ ID NO: 3768 - DNA, 158 bp, Homo sapiens
gctcaagaggtatctctcagccacagagctgtgttggttgtgctgagtgcggattacaaccatcttaaggctggccggcgtacaaaatttaggcaagaggaactctggcaaggttaccgggtttgccatagatctgtgggcatcctttggggtgcaac

SEQ ID NO: 3769 - DNA, 370 bp, Homo sapiens
ggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgaggggcctcaataaagtttgtgtttatgccaaaaaaaaaaaaaaaaa

SEQ ID NO: 3770 - DNA, 372 bp, Homo sapiens
cgccgcgccgccatcatggacaccagccgtgtgcagcctatcaagctggccagggtcaccaaggtcctgggcaggaccggttctcagggacagtgcacgcaggtcgcgtggaattcatggacgacacgagccgatccatcatccgcaatgtaaaaggccccgtgcgcgagggcgacgtgctcacccttttggagtcagagcgagatgcccggaggttgcgctgagcttggctgctcgctgggtcttggatgtcgggttcgaccacttggccgatgggaatggtctgtcacagtctgctcctttttttttgtccgccacacgtaactgagatgctcctttaaataaagcgtttgtgtttcaaaaaaaaaaaaa

SEQ ID NO: 3771 - DNA, 410 bp, Homo sapiens
cgaagatggcggaggtgcaggtcctggtgcttgatggtcgaggccatctcctgggccgcctggcgcaatcggtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggccccaagccgcatcttctggcggaccgtgcgaggtatgctgccccacaaaaccaggcgaggccaggccgctctggaccatctcagggtgtttgacggcatccaccgccctacgacaagaaaaggcggatggtggttcctgctgcccttaaggtcgttcgtcttaagcctacaagaaagtttg

SEQ ID NO: 3772 - DNA, 377 bp, Homo sapiens
attttttcttgagctgtaagggttttaaaaataaatacattctgaatgcaattatcatcagatcataatttgcagagttctcctactctgcagttgtcttttcactttcttgatagtgttttttgaagtgtaaatgtgattttcattaagttcaacttaatatttcttttatcactgttgcttttggtatcataactaagttattactgtctaattcaagatcatgatttactcccataaatccttttcttccaaaaaatgtatagttttagctcatacatgtaagtctatgatacacattaacttttatgtatggtgtgagatagaggaccaaatcaattcttttttatatggatatccatttgtctcatcaactt

SEQ ID NO: 3773 - DNA, 408 bp, Homo sapiens
cccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgcccctgagtgactcccccagcccaggccagaagacctcctttcaggtgccgggcgcaggaactgtgtgtgtcctacaacaat

SEQ ID NO: 3774 - DNA, 215 bp, Homo sapiens
ctcgtgccgaatttcgggcacgagaggaaacctggggcaccaggactggagccccctccggagacccaaactcacatcccctacagtccctccccaaacaggggtactaggactgcagccccctgtagctcctctctgcttacccctcctgttgacaccttgcactctgcctggcccttcccagagcccaaagagtaaaaatgttctggttctga

SEQ ID NO: 3775 - DNA, 411 bp, Homo sapiens
gcacgagcttggtttgaggggacctaaaggtgacttgggagaaaagggggagcgtggccctccaggaagaggtcccaacggtttgcctggagctataggtctcccaggtgacccaggccctgccagctatggcagaaatggccgagacggtgagcgaggccccccaggggtggcaggaattcctggagtgcctggacccccgggacctcctgggcttcccggtttctgtgagccagcctcctgcaccatgcaggctggtcagcgagcatttaacaaagggcctgacctttgaaaggcttactgctgcatggctgtctgcatgaaccacgccttggtgaaggagccttgggtaagaaccaccatccaaagcttggggcaaaggatgattaccttcagcatgattacattgga

SEQ ID NO: 3776 - DNA, 324 bp, Homo sapiens
tctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaagcacagcagaacaatgtggaaccacaaggttgaaactttttctggtgtctataagaagctcacgggcaaggatgttaattttgaattcccagagtttcaattgtaaacaaaaatgactaaataaaaagtatatattcacagtaa

SEQ ID NO: 3777 - DNA, 384 bp, Homo sapiens
catcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcagatctttcgtgaagacccttactggtaagaccatcaccctcgaggttgagccagttacaccatcgagaatgtcaaggcaaagatccaagataaggaaggcatcccttccttatcagcagaggttgatctttgctgggaaacagcctggaaggttggaccggaccctgtcttacatacaacatccag

SEQ ID NO: 3778 - DNA, 229 bp, Homo sapiens
cccaaacccactccaccttactaccaaacaaccttagccaaccatttaccaaataaagtataggggttagtcctgcctatattatgccttgggtataaattttcatctttccttgcggtactatatctattgcgccaggtttcaccttgtgccgaattcggaacggggcttaagggggaatccagcgggtggcacgagccttgcttatggagcccaattcccctaggac

SEQ ID NO: 3779 - DNA, 329 bp, Homo sapiens
ggatggccatttatttaatatccattcatttcatgttagtggactattaacttgtcaccaagcaggactctatttcaaacaaaatttaaaactgttttgtgggccataatgtgtttaattcctgggtaaagataaagcttcataatgctggtttttattcaacaaattaaccagctgttaaacacagactttatcaagggtagggcaaggttttcagggttccatacagagagagtctatagtgcagtgatttgtgaagcagagtttcacatataagagctctctaggctcttgatgccctactctttaaggggtgtatagtgttgtga

SEQ ID NO: 3780 - DNA, 385 bp, Homo sapiens
ctggatttagcaaagatcatttttaaaaggcaagaaacaaagaagcacagctttatgctgcccaggcacatcttaaactcggagaaggtaggtgttggatcttaaaactatgttcaagctgttgaggagttcccgtcctgccttaacctgcaggaacagtacctggaaggccacggccgtcttcttgcagagaacccactatccagctgggctttgcttatgggtacaactctcagtatgatgagggaggtggcacagatcagcacatctatttgatgtgatttggcagcagcagtgtctgtgctcacgcgcagcgggagggggctgcggggtcgtcttctgcattacaacgaagaagttttggggctacggggctcctcccccc

SEQ ID NO: 3781 - DNA, 284 bp, Homo sapiens
ggaaagtaaaagtacagaaaatttgttaaaggaaattaaatgagatcatgtctcaataatctctgagcagacaaaattagttaggtctcataagtgtatctcaacctccgctttgatttgcaaatacaaacaaaacttacatatatttcttgtagctcgcatattgaaaaaagagagatgaagctcaaccagtcagaagtagccaacaacctctatatatatagagactgtccccacacaggtgaacagacacacacaaaacactataaaaaagttgtgcttcc

SEQ ID NO: 3782 - DNA, 342 bp, Homo sapiens
tcacattccaagattgatgtgtgggaaatagggattacaaacatattgtatttaaaaggatccaaacttgattctacatgaaagtatctatattattacaatggccaaggcctactctctgggcaactttgacccttagtattccagggatacttgaggtagagaccagaaaagacttgagctattctgtcactctagtaacatggtgctcatcatgtccagagcaattttgcaatattcacatacaagacctgtctcagtattacttccatgtgggttttttttggccacaatttatatttatttttgctactttccttcaaggccacccctccatatctt

SEQ ID NO: 3783 - DNA, 288 bp, Homo sapiens
ccacccatgccagcgcaggccagggctcagatggggcctggctgttgtgtctggagcctgcaggcaggtgggggctgcgtccctgctcagcccatcccctgcctctatccctgggcacctgccagggctccctcgggctggtgtcttgagaccagcctgccaggccttccagcaggaggacagagttcccttgggaatacaccttcctgcccaagggacgtggcgttgttggtgtttgaggtgctgccccctcgcttttgcggccccaaaggccctcaaggtttccca

SEQ ID NO: 3784 - DNA, 242 bp, Homo sapiens
cgaacggcatactaacggctcaaacatttttttgtaggccacaaggcttcccacggacttcacgtgcattattggctacaactttccctacactattctgccttacattccggccaacctaattattttacactttacaatccaacacatacacttttgggctttcggtaggccggcccgccttgaatacttggccattttttggatggtatgtgggtttggacctatttcctgtatgtcct

SEQ ID NO: 3785 - DNA, 250 bp, Homo sapiens
  misc_feature 193: n = A,T,C or G
cgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggtttgactatttctgtangtctccatctattgatgagggtcttaaaaaaaaaaaaaaaaaaaaaaaaaaaaaaaa

SEQ ID NO: 3786 - DNA, 330 bp, Homo sapiens
ctcgtgccgaattcggcacgagggggaaagcggactggatgctgctggacacgggctctaccagttcctgggggaggagggaccgggcagccctcttgccagctgttggcgggccatcatcctccgggacgacgccgccataaggccgaacgcagccgaactgggggtgcaagactacctcctgttcgccgagatgctcatgcagcgcccgtgcgctggggcagctgtggggctcgcacctactgagccgcgagaggcggcctacatggtggacatggcccccgagcgcttcgaggccgtatggcggtcctcagggagctccgcgcccat

SEQ ID NO: 3787 - DNA, 274 bp, Homo sapiens
tgagaaaggtcctggtccgcgccagagcccagcgcgcctcgtcgccatgcctcggaaattgaggaaatcaagggacttcctgcttcacagcccgacgaaagggattgccaaatctgtcaagatcaagaaaaataagggcaacgtgaagtttaaagttcgttgcagcagttaccttttacaccctggtcatcactgacaaggagaaggcagagaaacttaaggcagttcctgccccccggtttggcagttaggaactcaattgaccagacacact

SEQ ID NO: 3788 - DNA, 246 bp, Homo sapiens
ctcgtgccgaattcggcacgaggtttgtttcaattggccatttaagttagtagtaaagactggttaatgataacaattgcatcggtaaaacccttcaagagggaaagggggaatttttttgttgggccacttttggttttctttttttccggtatggcaagttttaaggttattagtttttaaaatccagtacttttttaattgggaaccacctttgaccaaaaattttgtcacaggattttgggg

SEQ ID NO: 3789 - DNA, 220 bp, Homo sapiens
cccgtgtgaagctgccctccggctccaagaagggttatcttctcagccacagagctgtggttgtgtggtggctggaggtggccgaattgacaaacccatcttggaggctggccgggcgtaccacaaatataaggccaagggggaccttcctggccacgagtacggggtttggccaattaatcctgtggagcatccttttgggaggtggcaaccaccaaca

SEQ ID NO: 3790 - DNA, 243 bp, Homo sapiens
aaatagttttgtgatttatttcttgccccatatgtaaatatttagagtctcatttcttgcaacttattttgaagctgagttgtgggtttgggttttgtttgtttctttggttgcagggtggggtggggggttgcagggaaggaaggaagggattttttgtaccctggaggatggagataatcttgtggtttaaagcaattctccactgaagttattcaaattatcaccagatttttccaggtt

SEQ ID NO: 3791 - DNA, 260 bp, Homo sapiens
aaatattttgtgatttatttcttgccccatatgtaaatatttagagtctcatttcttgcaaacttatttgaagctgagttgtgggtttgggttttgtttgtttctttggttgcagggtggggtggggggtggcaggggagggaggaagggatttttgtacctggagatggagatatcttgtggtttaaagcaaatgtcccactgaaagtgattcaaatatcaacagaattatttcaggttaaaaaaaaaaaaaaaaaaaa

SEQ ID NO: 3792 - DNA, 194 bp, Homo sapiens
tcagattcagcatttgttctttgccagtctcattttcatcttcttccatggttccacagaagctttgttttcttggggcaaggcaggaaaaagtttaaatttgtaccctattttttgtatattgtgaggatggtttaaaataaaattgttggaaaaaaaatggaaataaaggcatgttttgggttttcccaaag

SEQ ID NO: 3793 - DNA, 173 bp, Homo sapiens
cttggacaaaactgtcgtcaataaggatgtcttcagagatcctgctcttaaacgcaaggccgacgggaggccaaggtcaagtttgaagagagatacaagacaggcaagaacaagtagttcttccagaaactgcggttttagatgctttgttttgatcattaaaaattttaagg

SEQ ID NO: 3794 - DNA, 267 bp, Homo sapiens
gatgcaagcatctaagagagaggttaatcacactatagaggcataagtggtatcagttttcatttttctaattgtttaaacttgtgttttataccagtcgttttgcaagtaatttggggtgtttagcttgagattggttaaaggttggttttggggaggggacttccgtttttaattggtttttcttttaaaaaatgttttcccacctcccctgaaatttttcctgaaaagcattgggcttggaacaagttcaacaatccctgggct

SEQ ID NO: 3795 - DNA, 393 bp, Homo sapiens
caacattcttgtactgtggcatgtatgggaccacccctccaaagattgtggtcacagcagcccccaggaaaccagattggtgcggcaggacaaaaacccaattccaaggcctttttgctttccattgcccaacaattttttcccacccaggtagggcaagggtattgtccaacttgccttaagcctttatatttatgggtttcctgaccctgccaattaggggtatctccacttgttacagctgttctgtcagtcctatcacaatggctgtcctggtctgccaggacatatgctctgtcctctgtttgatggagaccccttatgatttcgtaatacctcttcctccctgtagtgtactgtgtgtagaatgcagtatataggctaggctcagtg

SEQ ID NO: 3796 - DNA, 514 bp, Homo sapiens
caacattcttgtactgtggcatgtatgggaccacccctccaaagattgtggtcacagcagccccccaggaaaccagatggtgcggcaggacagaaaccaatccaagccttctgcttccatgcccaacatctgtgccacccagtaggcagggtgatgtccaccttgcctaagcctctcactctcatgggctcctgcacctgcacattgagggttatctccacattgctacagctattctgtgcagtcctctaccaatgactgtcctgatctgccagggcactcttctctgtccctctgtttgatggagaaccccttatgattttcttaataactttttcttccctctagtgtactgtgttgtaagaatgcagtatataaggctaggctcagtggctcatgcctctaaccccagcactttaaggggccaacgtaggaggttcacttgagcccaggagttcaagaccagcctggacaacatagggagacccttctctacaaaaacaaacaaacaaga

SEQ ID NO: 3797 - DNA, 394 bp, Homo sapiens
cctggctctgctgggtgctcctggcaaagatggactcaacggtctccctggcccattggtcccctggtcctcgcggtcgaactggtgaatgctggtcctgttggttccccccggccctcctggacctcctggtccccctggtcctccaagcgctggtttcgacttaagcttcctgccccagacacctaaagagaggtctaacgatggtggccgttactaccgggctgatgatgacaattgtggttcgtgaccgtaacctcgaggtggacacaccctcaggagcctgagcaagcagatcgagaacatccggagcccagagggcagccgcaagaaccccgcccgcaccttccggtgacctcaagatgttccattctgactggagattggagagtac

SEQ ID NO: 3798 - DNA, 244 bp, Homo sapiens
gtttgtttaactaaacacagaaaaggtacaactaaaatgtattattttatggacactgtcatatatgtgggtcatcactgaccaaaatgttatataggatattactgtaccctggttttaacctcagagctttgtattttacatattattaaaccaaattaaatttaggggggtaattcttaaaatcaccaaccaggtttctgtcccccggccaaaaggcttacacaggctctggttttccccc

SEQ ID NO: 3799 - DNA, 121 bp, Homo sapiens
cctggacggtgcggccatgagggcctcatgttacggcattgccttttcttctgtagatcagtatcttcctcggctttttagggagcaaggaaaaatgcgtcttagaaccaacttttttttt

SEQ ID NO: 3800 - DNA, 316 bp, Homo sapiens
gattgatcagagcattgtgcaatacagtttcattaactcctttccccgctccccaaaaatttgaattttttttcaacactcttaccacctgtaatggaaatggtcaacccttgttaggaaacccaaattaaaatttggaaaattaaaaccccttaaaccatttgcaccatctgtgtggctttgtgtatatctccccaaagggggaaggtttaaaccccactctcccaggggtttaactctccctcacacacttctcccgtgtgtgtgctccacattgtggggtctgacctagacagagatgatctgagctcctcgt

SEQ ID NO: 3801 - DNA, 212 bp, Homo sapiens
atctctcgggacaactggcacaagcgccgcaaaaccgggggcaagagaaagcctacacagagcggagtatgaagttggggcgccaacttgcaacaacaaggtttggcccccgccgaatcccacacagtccgtttccggggggttaccaggaattaccgtcccttaaggttgggacgtggggatttttcctggggttccagagtttttttttc

SEQ ID NO: 3802 - DNA, 265 bp, Homo sapiens
cggaggcgttcagctgcttcaagatgaagctgaacatctccttcccagccactggctgccagaaactcattgaagtggacgatggaacgcaaacttcgtactttctatagagaagcgtataggccacagaaagttgcttgctgacggtcttgggtgaaaggattggaagggtttatatggttcccgatcagatgttgggaaccgcaaaccaaagtttcccccttagagccagagtgttttttacccctaggccctttccccctcc

SEQ ID NO: 3803 - DNA, 292 bp, Homo sapiens
ttttcattgaagaataggatgtggttctctagtgatcacaaattgtatggtgtatagaagagagtgaaatgcttttcttctccattattacaaggacataggttcttttgcctcaaagacaatctgcttcttcgctcaatcaatgccatcctacaaccagaggtattttccaccctgcagtcttctctcctactggcatccctggccttgagacccgcagatctgacctcatccaattctgtgtctctatgtaattgctatctctggagtggcatgatctgtttgtcatcat

SEQ ID NO: 3804 - DNA, 229 bp, Homo sapiens
cgcgcctgcaggtcgacactagtggatccaaagaattcggcacgagttttcattgaagaataggatgtggttctctagtgatcacaaattgtatggtgtatagaagaaagtgaaaatgcttttcttctccattattacaggacatagttcttttcctcaaagacatctgcttcttcgctcatcatgccatccttcaaccagagtattttccaccctgcagtcttcttcc

SEQ ID NO: 3805 - DNA, 291 bp, Homo sapiens
cgaataacttcgcttcaaggaggacctcctgaactatggccagccgaggttaacatacgagatagattgctcgtcgactgctaggtgctgacagtgcaactgtctttaatattcaggagccagaggaggaacagctatcagggatacaaagtctccagctgtgaacagagacttatcagtgaaatagagtacaggctagaagggctccctttggatatcaggggatgagggctagatttgagagtgcccttgggaatggagtgcacactctctgagtagtagtcgtagaca

SEQ ID NO: 3806 - DNA, 192 bp, Homo sapiens
gtaggacccacaggacttcagctggatctggttggttgaagctcaagattggtgaatgatctctgtagcacatgtcagtattgtacatttgccttacagccccatacaatgatttgacctttacctttggaagggtaaggctcacaagtcttacctcaggatgaggatgaacccctcattccaggtggtttt

SEQ ID NO: 3807 - DNA, 550 bp, Homo sapiens
gaaggacccacaggacttcagctggatctggttgggaaaagctcaagattgggaaatggaactttggtaggcacatgtcagtatgaaacatttgcctcacagccccatacatgattaacctttactttggaggggaaaggctcacagtcttactgcagaatgagaataaacctcatttcagtggtttataaactcttaaatgtaacagaatataggcctaaaattagacattgtattcagtctgagctctgccacttaagaattctgggactttgggcaggctgcttattatccactaacctcaatttcttcagctcctaaaagggcagttgtcatacctatattatggcactgttttgaagaagaaatgaggtaatgcctaaaagtgtttaacatagtcactggcacagagaagatacttaataaatgttgatttccttcctgttcagcaaaaccttaaggcagaaagctcctaaggcatgattatatatttcattctttcagtagcatttgccaaacatttttaccatattgttgctaagtaggtaaa

SEQ ID NO: 3808 - DNA, 300 bp, Homo sapiens
cttggtctgaggtccagagacagctcagcattgtggtgacagctctggaggtgcggcagcacctgaggcctgtggctgatctctgatcccagctctctttcttaagccctcccttactccaaccctctcctgcctgctttcctgagatgtcctggtcttcctgggtgccagagagggcactaccaaaggacctcttaagcttttagggaacagctttaggtccttaggggagtaggcagccctaatgcacttacctaatccgggtcttaggtagcagaggttggcagcaggaacaggatt

SEQ ID NO: 3809 - DNA, 335 bp, Homo sapiens
ctctgctctgtggggctctggccgcgcctggtctggtcgggaccatgttcgcgttcgggacgactgcgctgtgcggcttccatgcacgagtttttcgccaaggacatcgacgggcacatggttaacctggacaagtacccgggcttggtgtgcatcgtcaccacgtggccttccagttaggcaagatccaagtaaactacactcagctcgtcgacctgacgctccatacgctgagtgtggtttgcggatactcggcctctccgtgtaacacatctgggagcagaggctcaagtgtatcgcagagatcacagagtctcgcggctacaacactaaca

SEQ ID NO: 3810 - DNA, 245 bp, Homo sapiens
ccatcttcttcctcagaagaagatgatcctatcccagatgaattgttgtgtctcatctgcaaggatattatgactgatgctgttgtgattccctgctgtggaaacagttactgtgatgaatgtaagaagtgctgaatcttggaagatgtatattttaggatatttgtatttacttggaatggctctctccaacctcatatgttttaataataaaataaataatgttgaaaaaaaaaaaaaaaaac

SEQ ID NO: 3811 - DNA, 333 bp, Homo sapiens
ctcgtgccgaattcggcacgaggatttactaacttttccaagctcacagagctagggacttgtcgctaaaaagttcaaacattttactatcaattgccttgtctatattttctgtgcctagagtgtagcacagtgcatagtcaaatagacatatagcttgagagagtatattgtgtgaatatctcacacatatatgccctgtgtcacacaacagattataggcatatgcagtatttcactatatttgattaggcagcagcatgatcatatatagtagctactgtagtcgtcgacggcgtcaacatcgtagtaagatgatgcagctagttgtct

SEQ ID NO: 3812 - DNA, 180 bp, Homo sapiens
ctcgtgccgaattcggcacgaggatttactaacttttccaagctcacagagctagggactggtggctaaaaagtccaaacattttactatcaattgccttgtctatttttctgtccctagagtgtagcacagtgcatgtcaaatgacatatgcttgaagaatatttggtgaatattccac

SEQ ID NO: 3813 - DNA, 283 bp, Homo sapiens
tggaaatcctatgacaataactatgacaataactatgacaagtctttcttcaagtgcatgcagtcttttgcagtacctcattcagccaagtatttggttctctacctccattcagtataaggcagcctttaatttgcttaggaaggcaacatatagagaggttagagttcagcagggacatagagtttttaaaatgtgacttcactgtatatatttgagtttctctagggggtgtagagtcacacacctcttttgtagactctgcaatatgataattattttt

SEQ ID NO: 3814 - DNA, 260 bp, Homo sapiens
attggattttgtcacgtagaagcagaagtttactgtgggaaaggaaaaggcaagaacaaattgagtttttgagttcaggcttcagggagggaatggagccatgcctagcacagatcttgagtgtagtggttggaaataatattcagctgtcacaactcggtctgaaagtgtgtctctctatcattcaatcttgccaggttcatgccctgtgaaaggcagtcagggagtctcttttatgacactaggctcattgtcgccag

SEQ ID NO: 3815 - DNA, 146 bp, Homo sapiens
cttaactgtttttaaagatttttagggatcttaacacatttctctccattaaacatatggcatatgtatattcattccgttccttattaaatttcctgaaggttttaaaagggagggtcacccaggattaggaaccctttgccccc

SEQ ID NO: 3816 - DNA, 219 bp, Homo sapiens
gcggcgctcgcgccaaggggacgtgttttctgcgctcgcgtgggtcatggaggcgctgtcgctgctagccgcgaaaacttccggaccagggccgcaaccaaaggcttgcttctgcttgccgctacttcctgttcctccctgccggctggggctgttccagggctgggaggaaaaagggagagggccccggacctcgcgaggaggggtttccacttctac

SEQ ID NO: 3817 - DNA, 226 bp, Homo sapiens
ttaagcttcccaagtgtctggtctttgctacagagaagcattgttctgctttcgtatcctttatatgaattcttcaaagagactcaaattttgtcactaatttcatgtttcatgctgtgggctaagcagtttatagttttaccatatttaggctaggtttagaattttacgaatggtttgcttggtcttctgtctcctgtcccccagtttcagagaaaaaaaaaaa

SEQ ID NO: 3818 - DNA, 278 bp, Homo sapiens
gccatggctcgtggtcccaagaagcatctgaagcgggtggcagctccaaagcattggatgctggataaattgacccggtgttgttttgctcctcggtccatccacccggttccccacaagtttgaggagaagttttttccccctcaattcaatttttcctgagggaccaggactttaaggtatgcccctgaccagggggatgaagtaaagaaggattttcatgcagcgggttcatttaaaatcgatggcaagggccggaccctttatatccccccccc

SEQ ID NO: 3819 - DNA, 274 bp, Homo sapiens
ctgggacgtctagtccacaggaagacctgcaccacttgtcggcttcacacaggtgactcgggagacaaaggcgcttttgcttaagcttggttggagcttattcagggccccattaccaattgaccagattaccgttgaggattccgccgtcacttgggggttggcaatgttccctgggtcccaaggctttgtgctcgtgatcggccaagcgttggaaaaggcaaaaggtttaaagggctttcccctctaactctggggtaaaatagcacactgt

SEQ ID NO: 3820 - DNA, 355 bp, Homo sapiens
ctcgtgccgaattcggcacgagggcaatacctgatggagggcagctacaacaaagtgttctggccagggtaacaatccccgccgagagcctacaccttcttcattgacatcctgctcgacactatcagggatgagatcgctgggtgcatcgggaggcctacgagaaaatcctttcaactgaggccaccggatccttttcttaaccacacccaaaggttgacagttacgccaaggagcgaggtgggtcctggccccaaacaacttctactagttttcccagccagcagcagaggcgggagacacaccattccctccaaagtactggccaacaggtctcgagtatcccggcagctgg

SEQ ID NO: 3821 - DNA, 344 bp, Homo sapiens
cccaaacccactccaccttactaccagacaaccttagccaaaccatttaccaataagtataggcgatagaaattgaaaccctggcggcaatagatataggtaccgcaagggtaaagatgaaaaattattaacccaggcattattattggcagggaccttaaccccctattaccttcctgcataatgaatttaactgggaaatacctttgcaagggggaagccaaagcttaagccccccgaacccaggcggagcttccttagcacagcttaaagagcacacccgtttattgggcaacatggttgggaggttttatggtagaggcgacaccctccgcgccgtggta

SEQ ID NO: 3822 - DNA, 265 bp, Homo sapiens
gtcctctccgtccggagaggggaacgtgaaggaggtgaggagggagtagtgcaggaggatttgggtctctccttctttcccttttccaattctcccgaggggcttaaccaagcttggtgaagggttcttaaccaagcaaaaggagggaagcaagcccggggccccgttaagggttaaggcccccaaccaaggcaaggaaggcaaccaaggaaggagggaggaacccgaaggccgcaccttctttaaagcgccattcctaaatata

SEQ ID NO: 3823 - DNA, 310 bp, Homo sapiens
cgaaaagtgactgttcacagacctcagtgatgtgagcactgttgctcaggagtgacaagttgctaatatgcaggaaggggatggggtggataactttcttggctttcttcatggatggcatggttttctggtatgttaatgacttttttcgggtagctattaaggtactagaaggttgataaatgtgtacagggtccctttgcaataaaacttgggtatgacttgatccaagtgtttaacaattggggctggttaaggctgacacacatcactctgatagagtgtggggcttttcaggggggagagacac

SEQ ID NO: 3824 - DNA, 304 bp, Homo sapiens
gaaagttgacacttcaaattgctcacaaggactttaaactctacaataggtaaaatgtggagtaccttatgttttcagaccaaatgattttgtaatttgaattcaaaattttttttagtcttcacagtagtcttagcattaaaagcatagttatttttaaatattttgataaaatattctatttcattaattttgtataagggcatgtgtgagaagcattgatatttttaaaatataaaaatacagcccctctcttaataagccagagcactttttgagttttaaaatttgtgtttttgggggc

SEQ ID NO: 3825 - DNA, 378 bp, Homo sapiens
gaaagttgacacttcaaattgctcacaaggactttaaactctacaataggtaaaatgtggagtaccttatgttttcagaccaaatgattttgtaatttgaattcaaaatttttttagtcttcacagtagtcttagcattaaaagcatagttatttttaatattttgataaaatattctatttcattaattttgtataagggcatgtgtgagaagcattgatatttttaaaatataaaaatacagcctctttctaataagcaagagcaattgttgatttttaaattttgtgtttttggaggcttccattcacaaatctgattgtttaaataaatctgtctccagtaaatatgttggcacttaaaaaaaaaaaaaaaaaa

SEQ ID NO: 3826 - DNA, 265 bp, Homo sapiens
gattacttcactcctggactgtgactttcagtgggagatggaagtttttcagagaactgaactgtggaaaatgactctccttaacttgaagctactttttaaaattttgaggggtcttggaccaaaagaagaggaatatcaaggttgaagtcaagatgacagataaggtgagagttaatgactaactccaaagatggcttcactgaggagaaggcattttaggattttttaaaatcttgtcagaggtcccagagaggtctaattt

SEQ ID NO: 3827 - DNA, 218 bp, Homo sapiens
ctcgtgccgaattcggcacgaggggaattcggtgtggacataggggccggtctgcttcttgtaaaacctgaaccagaacaacaacaattccgtttgcaaaacccaaaggacccaaggacttttccaatctcaggtcaactctagggcctcttcacttgatggcctgaccctcaccctgatgtccattcaatccacctctcacagatcggacttttctc

SEQ ID NO: 3828 - DNA, 226 bp, Homo sapiens
gccaagaaggttgatgctggtggcaaggtgaaaaagggtaacctcaaagctaaaaagccagaagggaagcccattgcaggccgcaacccttttccttttaagaggaatttggaaggtatttcccgatcctgccatgtattccagaagggccatgtcaagaggaggtactcagccgctaaatccaaggttgtaaaggaaaaggaggaggaggtcttgcactctacaa

SEQ ID NO: 3829 - DNA, 242 bp, Homo sapiens
aaatacatcaacaaccgaaacgtgccggagattgctgtgtaccctgcctttgaagcacctcctcagtacgtttggccaccctatgaaattgggccggtgaaaaatcgccttaaaaaaggacccacccaccctccttaccttacccttgccttaaaggagattcttgcctttgacaataaatcctatacccagcttttggtttggtttatggttacaggaatgctgcaattcagggcgctctc

SEQ ID NO: 3830 - DNA, 270 bp, Homo sapiens
gagaagagtaagctttcatgggggttgcacctgcaggagcagctaccactccagggctggagaacctaaggaagagttttgaagggaggggtttccagaagcctctttaacccagacatactgagggagggcgggctcaaactcaagcggggagctgggggtcgttccgcggtgtttaagaaaaggacttcctgcactcagacctctgcgggagggggcacatacagactggttgctggggtcgtctcatgtcctccctctattcaataa

SEQ ID NO: 3831 - DNA, 580 bp, Homo sapiens
gagaagagtaagctttcatgggggttgcacctgcaggagcagctaccactccagggctggagaaccctaaggaagagttttgaacgagggttccagagcctgtgacccagacatctgaggagggggctcaactcagcgggagctggggtctccgggtgtgaagaaaggactcctgcacccagacctctgcggaaggggcacctgccagctggtgctggggtctctcaggtcctgccttgaatcaaaaggaaggagactgagcctctcagaggaccaggaaccaagccaaggcttgacaaaaccagcctctctctctctgctgtctggaaaggtactgcccaccacccaccacccccatcactcctctaagattttccactgttggtcatatgtgcagagactgccagcagctttcatggtgaccgagctttgctgaggaggatcaacactttctcatgaccaaaagcaataatgtctccggaaaagcggctgtcacacatcctaccagactatgaccaacttatttgcctttcctaatattaatggttgccttagatccagcacctaacatcatagcagc

SEQ ID NO: 3832 - DNA, 255 bp, Homo sapiens
gccgctccgccgcagacgccgccgcgatgcgctacgtcgcctcctacctgctggctgcctaggggcactctccccagcgccaaggacatcaagaagatcttggacagcgtgggtatcgaggcggacgacggcccgcttcaacaaggtgatcaagttaactgaattggaaaaacaattgaaggcgtcatttcccagggtatttgcaagctttccaatttacctcttgtggggctttagcccgttcttcttccccag

SEQ ID NO: 3833 - DNA, 254 bp, Homo sapiens
cctctgccgccatgccgttcctggagctggacacggaatttgcccgccaaccgagtgccgcgggctgagaacgacctctcggcggcggtgtccttccaatcctggggcaaacctgcgggacccgggtgaaccgtaacggttacggccgggcctggccatgggcgttgagcgggtccaccgagcctgcgcgaagttgtccatcttcctctatcggcgtagtgggcacggcggaggacaaccgaagcacagccgcc

SEQ ID NO: 3834 - DNA, 150 bp, Homo sapiens
gagagagagaggccaaagaatgaatgttgtgtagtgaagttgagacctcaatcctgcagccagtaatttctaactttgggcctttaatgatgccttatatacttttaaaaaattatttggggacccaaagggattttggtgttcaatggt

SEQ ID NO: 3835 - DNA, 175 bp, Homo sapiens
caacgctggcttcaacatcaagaccctggagcaccgaggattcaagctgaacatctgggatgtgggtggcagagtccctgcggttccacttggcgggaactaacttttgagagacacaccatgggcctcaatctggggtagatggacaaagcagaccgccaagcgcaatgcaaga

SEQ ID NO: 3836 - DNA, 220 bp, Homo sapiens
agatgttggaggatgaggacgacctggcctacgcagagactgataagaagacgaggacagacttccacggtcccacgggcgccctgccttggattgcggacacttgaacaccaccgcgttccaacttggcttgcaccttattcccccagacgcttgagccaccttaagcgcaccgtggagattattcaaggattcctttgtttcagggttcttttgagaa

SEQ ID NO: 3837 - DNA, 255 bp, Homo sapiens
gttggagcgagcatcccccaaagttcacaatgtggccgaggactttgattgcacattgttgtttttttaatagtcattccaaatatgagatgcgttgttacaggaggtcccttgccatcctaaaagccaccccacttttctctaaggagaatggcccagtcctctcccaagtccacacaggggaggtgatagcattgcttcgtgtaaattatgtaatgcaaaatttttttaatctgcgccttatactcttttatt

SEQ ID NO: 3838 - DNA, 256 bp, Homo sapiens
ttctggggagtgttggatccacatcccggtgccggggagggaagcccaacatccccttgtacagatgatcctgaaagtcacttccaagttctccggatattcacaaaactgccttccatggaggtcccctcctctcctagcttcccgcctcttcccctgtgaacacccatctgcagtatcccctgctcctgcccctcctactgcaggtctgggctgccaagcttcttcccccctgacaaacgcccacctgacctga

SEQ ID NO: 3839 - DNA, 256 bp, Homo sapiens
aaacttctcctgccccaggaagttctggtggtgctgagagcacaggacccagccctcacggtcagcatgggcggtttcctccctgtcgtcaccacctatcttcgggtgaccaggagttgccttccttgtgtctccagagggctccagcccctggcgtcagggtcctgtgggcatagctggggtggccctcctgccggtgcaaggctgatgcccgtcaaccttctgaccatcaggagagactagaaaaagagaagaa

SEQ ID NO: 3840 - DNA, 522 bp, Homo sapiens
aaactgctcctgccccaggaagttctggtggtgctgagagcacaggacccagccctcacggtcagcatgggcggtttcctccctgtcgtcaccacctatctccgggtgaccaggagttgccttccttgtgtccccagagggctccagcccctggcgtcagggtcctgtgggcatagctggggtggccctcctgccggtgcaagggctgatgcccgtcaaccttctgaccatcaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagtgcgtgcctggcgccaaagcagggcgggaggagtcgagctgccgggagccctggggaggcaggaccgggagaagcagagctgggcggagtcgtcaagctgctgggagcgctgggctgggagccccaggggaggcaagagctgg

SEQ ID NO: 3841 - DNA, 120 bp, Homo sapiens
ccgctgtccagcctccctggacggccctcgcggtccctgcagcccaagatgggactcagaccctgtgccccagagctcccctgccgcagaatggggccccaagccggccccgaccgggtc

SEQ ID NO: 3842 - DNA, 260 bp, Homo sapiens
  misc_feature 144: n = A,T,C or G
ccgagcaggaattcggtgtggacatagggccggtctgcttcttgtaaaaacctgaacccagaaacaacacaattccgttgcaaaacccaaagggccccaggtacttttccaattttaagtcaactctgggggcttcttcacctnaatgggctgacctcacctgatgtccattcatcccaccctctcacagttcggacttttctcccctctcttttctaagacaccctcaactgggcagactgcaaaataaaatctcggtg

SEQ ID NO: 3843 - DNA, 110 bp, Homo sapiens
  misc_feature 79: n = A,T,C or G
ctcgcaggccgtaggaggaagatggcggtggagtcgcgcgttacccaggaggaaattaagaaggggccagataaacccnttcgaccgcgtagaaggacaatgcccacttt

SEQ ID NO: 3844 - DNA, 263 bp, Homo sapiens
gccatcatgggtcgcatgcatgctcccgggaagggcctgtcccagtcggctttaccctatcgacgcagcgtcccacttggttgaagttgacatctgacgacgtgaaggagcagatttacaaactggccaagaaggggccttactccttcacagatcggtgtaatcctgagagattcacatggtgttgcacaagtacgttttgtgacaggcaataaaattttaagaattcttaagtctaaggagcttgctcctgatcttctgaa

SEQ ID NO: 3845 - DNA, 261 bp, Homo sapiens
ccgaaaggaaagaaggccaagggaaagaaggtggctccggccccagctgtcgtgaagaagcaggaggctaagaaagtggtgaaatccccctgtttgagaaaaaggcctaaagaattttggcattggacaaggacaatccagcccaaaaagagacctcaccccgcttttgtgaaattggccccgctatattaaggttgcagcggcagagagccatcctctataagcggctgatagtgcctcctgcgatttacagttaaccca

SEQ ID NO: 3846 - DNA, 313 bp, Homo sapiens
gtacaagtccagggcaagcagaaacttgctttgcggaaacccctgtggctccgatgatgtcaataatctttttgtataagggggcgaccggggcggttactaccgaatgtttaggcaccagtatctacaagaaaattcaatgtctttacccctaactgttcattctgaacataggctctttcggggtccttgagcccggtccccctcagtccaataacccttctgccaggttgagcaggggccctttctccttgtcttgagactcttgctccgagtcaccttgttttctttttagctgagggaatttgctctt

SEQ ID NO: 3847 - DNA, 235 bp, Homo sapiens
aaactctgccacctgagtggaagagtggagactactggattgacccaaccaaggctgcacttggacgcatgaggttttctgcaacatggagacttggcgagactttcggtttcccaattccagcaaacgttcccaaggaggacttggtggagcagcaagaccaaggagaaggaacacatctggtttgagagaaccattaattggtggctttccattcaagttatgagattacaat

SEQ ID NO: 3848 - DNA, 115 bp, Homo sapiens
cattgatcctaggttcttcctgactgctttctccaactgttcacagcggatgcttggatttatgcagtaggcattactacagtacatggctaatcttccggaaacttagctcatt

SEQ ID NO: 3849 - DNA, 157 bp, Homo sapiens
gaaagaaagctgtgggaccatcctggcaaccccggtgtttgcttggttctagcgtagcgtcttgtgtgccgtggggggacctgcggtcggagttgggaaggccaatctttcaaccaagaagtggaagaggacggacttttaaggccgtaagcgccct

SEQ ID NO: 3850 - DNA, 248 bp, Homo sapiens
cgcaatcctcagcaacatcttaatgcacagccacaagttacaatgcaacagcctgctgttcatgtacaaggtcaggacctttgactgcttccatgttggcatctgtccctcctcaagagcaaaagcaaatgtttgggtgaacggctgtttcctcttattctaagccatgcaccctactctttgcttggaaaaatcataggcatgattgttgatgattgataattcagaactccttcatatgatcgacg

SEQ ID NO: 3851 - DNA, 245 bp, Homo sapiens
ggtccctggtgtgccttggtgtcatcatcttgctgtctgccttctccggacctggtgtcaggggtggtcctatgccaagctggctgaccggaagctgtgtgcggaccaggagtgcagccaccctatctccatggctgtggccctttcaggagctatcatggccccgcacttccgatttctgtaccacttcaccgcggggcagtggtggtatgatgctctccagatgtagggggctcgggcgggct

SEQ ID NO: 3852 - DNA, 229 bp, Homo sapiens
cggaggccaaatgaagtttaatccctttgtgacttcgaccgaaggaagaatcgcaaaggcatttcaatgcacttccacattcgaaggaagatatgtcttccctctttcaaagagctgagacagaaggtacaacggtgcgattcactgcccattcgaaaggattattaaggttagggtgtacggtggacacattataggtcagcaaatttggaaaagaggtcagggttta

SEQ ID NO: 3853 - DNA, 349 bp, Homo sapiens
tttcaaaatcaacaccgatgagattatgacttcactcaagtctgttaatggacacatagacagcctcattagtctgatggttctcgtaaaaaccccgctagacactgcagagacctgaccttctgccatcctgaactcaagagtggagaatactgggttgaccctcaccaaggatgcgcaattggatgctatcaaggtattctgtcatatggccactggggacacatgcataagtgccaatcctttgaatgttcacgcatacactggtggacagattctagtgctgagaagacacacgtttggttttgagagtcatggatggtggtttcagtttagctacggcaatctg

SEQ ID NO: 3854 - DNA, 380 bp, Homo sapiens
agcccaggacgctgattccagcagcgccttaccgcgcagccgaagattcactatggtgaaaatcgccttcaatacccctaccgccgtgcaaaaaggaggaggcgcggcaagacgtggaggccctcctgagccgcacggtcagaactcagatactgaccggcaaggagctccgagttgccacccaggaaaatgagggctcctcttggagatgtatgcttactctcttaggcctttcattcatcttggcaggacttattgttgtggagcctgcatttacatgtacttcatgcccaagagcaccatttaccgtggagagatgtgcttttttgattctgaggatcctgcaaattccttcgtggaggagagcctaacttctgcct

SEQ ID NO: 3855 - DNA, 331 bp, Homo sapiens
ctcgtgccgaattcggcacgagcaagccagcccgggggatacccagccacaggagcagacgtggccttcagtgtcaaccactttgctgcagggacccaaatggccaaatgttggcttattggcctattggcaggcttccatcggcaatcccattgggaagggacaatggtgcacaagggagccttcacccgtttttttgtcttttgagcaaacctcaagtattttttttcctgtggacacagccctacgttgccaagaagctagggcttcctggtcttcccctacacacaaccaaaacctggggaggtgcagtacagtcgtgatgctccty

SEQ ID NO: 3856 - DNA, 243 bp, Homo sapiens
ggcctgtccaaggcttccccaacactcgcagttgaacccgccgttcttcgcgcattgccaccaccacagcccaggcggcggccacttcttgccggccatttggtgccaccccctcgaggccaaggggcaagggcaaaggcacttaaaggggcccagttacccagttagttgggccccaaccctgttgttccccgattgcttgccgttcaccttggtccttccggcttactttgtccctttcag

SEQ ID NO: 3857 - DNA, 225 bp, Homo sapiens
gagaccagtacctgggacacctgcagcagtatgttggccgcctatcagcagctgacctctgagagggaggtgctggcataatcaagctactgcttgcaagacccaagctcgtgggaccaagctgcaagcaagcaggaagcgctcaaggggcaaaggcgggtggcccgcgtatggccccgcccaaaggagtttgcaggaaaccaagggcgcgccttggaaggcttc

SEQ ID NO: 3858 - DNA, 137 bp, Homo sapiens
gcctgcccttccttgatattgcacctcttggacaatcgggtggtgctgaccagggactctctgtagacataggccagtcttggcttcaaataaactgaacttcaatcttaaattgaagcgagggacgggacttttga

SEQ ID NO: 3859 - DNA, 310 bp, Homo sapiens
tcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtggggtacatggtgatggccacaagtcaagaaaggcaaaccagagctcagaaaaaagggtacatccagcagtggtcattcgacaacgaagtcataaccgtagaaaagatggcgtgtttcttattttgagataatgcagggtcatagtgacaataaaggcggatga

SEQ ID NO: 3860 - DNA, 380 bp, Homo sapiens
ctcgtgcgaattcggcacgagccgaaagcgaagaagtagctcctgcccctcctaagctgaagcaaagcgaaggctttaaaggacacgaagggcaggtgttgaaaggtactcacgccccaaaaaagaaggaagatccccacgtcacccaccttccgggcggccgaagacacttcgaacttccgagacagcccaaatattcttcggaagaggcgctcccaggagaaacaagcttgaacctatgctatcatcaagtttccgctgaccactgagtctgccatgaagaggatagaagacaacaacacacttgtgttcattgtggatgttaaagccacaagcaccagattaaacaggctgtgaggagctgtatgacatagatgtgg

SEQ ID NO: 3861 - DNA, 331 bp, Homo sapiens
actcacttccattctttgatttaaagttttataggtagaagagaaagtagatgtttgtaaagggctgtgaagtttccctgtcacacagaaataccccacgggggaggggttgtgggttttccctgttgcttttgtctgctgattttctggaattgagattgtggtccccgtctatgagaagtgtttctactacgaacgctgcacaattggtgaagacagatgtaaaactgcagagttctcacgttgggagcacgatgtccagctctagaaagatgtctatagagccgggcatggaaaagccaaggagacttcaagacacattgagcatcct

SEQ ID NO: 3862 - DNA, 139 bp, Homo sapiens
gatcaattcactcacttccattctttgatttaaagttttataggtagaagagaaagtagatgtttgtaaagggctggaagtttccctgcacacagaatacccacggggagggttgtggtttccctgtgcttttgtctgc

SEQ ID NO: 3863 - DNA, 394 bp, Homo sapiens
ctactgaccgctggccagaaaggtgacagtggtcttccagggcctcctgggctcaggtcacctgtaagtcattcagcctttaccaatcttgtcctccaaaaaaaccgagaagacatactgaaggcatgcaagcagatgcagatgataatattcttgattactcggatggaatggaagaaatatttggttccctcaattccctgatacaagacattgagcatatgacatttccaatgggtactcagaccaatccagcccgcacttgtaaagacctgccaactcagccacatgcaagttttgaataaggatggtatagacacaccgctgcatatacaggtaccatttagggatacgctgcctttgtgggggcagaatcacatggcaaagctttgaa

SEQ ID NO: 3864 - DNA, 225 bp, Homo sapiens
gtggcgcatgcctcattcacgtacattggagagtctacaaagtcacacgtattcataggctaaggcacattctgacacaatgtgcacataggaggacccccatcacatttttatacccttgggcgcgtatctttccctcagatgtcacagcgtctcttgtcacagagatgtgactctagactctatcatcatgatgtccagagatgtgcacacacatctgttgts

SEQ ID NO: 3865 - DNA, 168 bp, Homo sapiens
ctcgtgcgaattcggcacgagaagacaatcattgatcacagacaatagcatacgctgcctcctgataattgaacctgcagacatcggtggtgctgaccaggatttctttgtggacattggcccagtctgtttacattaaatgactctcattctaaatgaaacagggag

SEQ ID NO: 3866 - DNA, 205 bp, Homo sapiens
cttgtgctaagggcacaaaaatgcagacacatacacacgggagtgggtttcagagcgtaagtttataggcacaagcaatgggaggaagagagacaccgcgtttcctattgcagaggagggggattgtccaggcggattctctgggttttggggagagagatgtgtgcccatttatatagagggctctaacgcgagcccgatattt

SEQ ID NO: 3867 - DNA, 530 bp, Homo sapiens
cttgtgctaaggggaacaaaaatgcagacacatacacacggagtgggtttaagagcgtaaagtttaataggcaaaagaaaggagggagagagagagcgcgcttcctcatgcagaggaaggggatgttcaagcggatttctgggtttggggagagatgtggtccattttatagaggggcttaaggaggccgtatttgattcacatagggcccaggagattggattgaccaggtgtcaggtgtgccatttacatagcccgtgaatcttttattatgcaaatggggtttacctggccgttgccatgacacccacacacgggggcgacaaagagaagagaggagatatcctccatgttgaatgtacctggcttctgacatagctgccggcatttacctatgcaaacttctagcttgcttatctatgtttgcagcttgatttctcagggtgctttttgttagaaatgttttaggggctgctttttattaaagaaaaattccactgagaactcctttaacctcactaactgcctaa

SEQ ID NO: 3868 - DNA, 191 bp, Homo sapiens
agatgcaggtctggagatgtatcacggaagaagctttgctctcacactgagcctcctggctactttgggagacaagatcaccccttgccgcccaaggttaagtaagcccaaagcctaaggaaccccttgtccccgcgtcctctctttataaccctctttcccattttgggagcgtatgttttgcccaaaag

SEQ ID NO: 3869 - DNA, 640 bp, Homo sapiens
gagatgccaggtcctaggagatgtatccacggaagaagctttgctctcacactgaagccctccctgggctactttggggagacagtaccaccccctgccgcccaggtgaagtaagcccgaaagcctcaagaaaacccctagtccccggcgtccttctcttgataaccctctttccccatttgggaagcctaagtttagccgaaaagcaactgcaataagtttcccaagggcagataggtgatgttggggggagagggtagggagcacgagagtgccagagaggtcttcagctgcgcacaaaatcagcaagctaaagtgcatcttacttaccaaggatttggtctccgggtttcccatcggcgaactgaaactggtccgtgaagaagtggcaaagtaacataactcctgcagcggccaagtcggccttcgggaacctcgccatgccgccgccgccacctccctaccccacccgccagtccttcgccggtgctcgggggctcccgatgcaataggcacgaccgggccaaacgctgcgggatcggtctcggtaggacccggagggcctttgtaaatgtcgctgcgatttcacagtagggaaccgagaagagggaagaagcgaacgcgagtaggagcgcaacgc

SEQ ID NO: 3870 - DNA, 191 bp, Homo sapiens
aagaacctcccacaaaggttttttgttggttgatttgagcccggatcacttctgaagaacacttacagaatatttgtgaggctttgtgagagatttatcgatatctcagactctcccattggatcacacaccacacatatatcgaggagagggagtttcgtttttatatacatatactctatataagagac

SEQ ID NO: 3871 - DNA, 245 bp, Homo sapiens
ctcgtgcgaattcggcacgagggagaacttgttctacacgcgagctgctttcacagcgcggcacctgtacttcggggtggtacgctgacgtagctctcatagaccacagatactatgtgggggacgtgcagagaaaacgcgcgtgtatatcccaggagcactctcagagcgagggctctcacagaggtgtgtggccccccgcgtgtctctcacagcgcctctgagggggtctctaaaaatatgtg

SEQ ID NO: 3872 - DNA, 147 bp, Homo sapiens
aaagaatcatgctcatgagcatttcctggatcttggagaattcaaaaaggaacagcaaatcaacacaattatcgtacaagatcttcattggagggacttctaggccctcagagagggatagagcacatgtgcgagagagagttttta

SEQ ID NO: 3873 - DNA, 181 bp, Homo sapiens
ctgataatgaggcagagcgggttaaaatgatggaagaagtggaaaaactttgtgatcggcttgaacttgcaagcttacaagtctttgaatttacacaatcacatcatgcacaacagagagtgaggggcagggctgctttttgggaacacagagtatagaggacactacaatttggcgcaat

SEQ ID NO: 3874 - DNA, 192 bp, Homo sapiens
atttaataactgttaaaatgttgtatcttgtaaacaaaagaaagattgcctgctaggatgtgcatcttaaatttgactattgggcatttgcaggacagtaaattctttgttttttggacagagggtctctttaccagtgtctctatctattccttctttaatatccacgggtccctatggtatagggacttt

SEQ ID NO: 3875 - DNA, 370 bp, Homo sapiens
gctgtatgcgccattagtgttgaaggtaataacgaattatttggccatgcagttttaaaccatgtgtgaataacctgctaatcatactttggtttttctgttttgtgctcttgcacgccgaattgtttatggtttttwattygcgggagttttttttgggtgggtccgagaattctcaagccagatttttgttacagcccagggtatgtcacaggcgctgagagactttgagtcacatatatcccacaggttgcgcaatggttctcctcgagagcctagagtatcacacagcactctccagtggctcatgttcctcgcacagcagagtcctgagaagagcctgtgagtcagactccaggaccgggcgtag

SEQ ID NO: 3876 - DNA, 270 bp, Homo sapiens
atttaacatggtgctgagctagccaggactgatggagccccttggggtgtggtatggagaggtctcagcagtcattcccagggccccatcttgatgggccaagggctaaacatgcatgtgtcagtggctttggagcaggttaggctggggctcatcgagggttctcaggccgaggccacttcggtgccagtgcccccctgaggtatacggcagtcagctggggccactgggtccatggagcctggataaacagtgctcttgaggctctgg

SEQ ID NO: 3877 - DNA, 248 bp, Homo sapiens
caaagatgtaattatcacaaaccgttcatcttgggatgacagataacctagctctgaccctagttgagatagaggactctacctaggagacaacttggtaaagcctaaggctatgtggtaccaggcattctaggtgtctgggtgaccaggctgtctttcttccccactgggcctcaatttcctctatatcaagtacacaggacttggctctaaataagtttcccgagtattgtctcttctagacacat

SEQ ID NO: 3878 - DNA, 129 bp, Homo sapiens
attcactggataattgtttttatattaagtcggtcagaggccaaactgaggctggacctgcattcaggctggacttggattttggttaggttttcggaggattcaacaataccgctttccttgaaccga

SEQ ID NO: 3879 - DNA, 570 bp, Homo sapiens
attcactggataattgtttttatattaagtgggtgagaggccaaactgaggctggaccctgcatctcagggctggagcctggactgtggcttaagtttctagaggtatcatcaatacccctttcctgcagccagagagaccacaggtccaacaacaggaataccacctacaaaggaatctatgggctcacatagtgaggctgtgtaacaagaaggggagagcaataaattatctacccattagaaacaggaagggagacagtgtgtgatagccaaaaagcagaacagaaagaacagctgagaaggcctgagaaccaagtgaatggcctggaggaaggatgggggcaagcaatgtggatagctggactcaggggggttgaccatttaatattgtaaactgctgaaacacaagggctcagggaactctgattatttttgtaggcaagcaaatatactgcatgaacaaagaatagttcctgtattaatttgaatttaaaatgtaattcctaggtaacaatataggaattctgtggatcctcatgaactagtttctgtatcaagtttgactaca

SEQ ID NO: 3880 - DNA, 135 bp, Homo sapiens
aacccgatatggctgagatcgagaaattcgataagtcgaactgaagaagacagacacgcagatgaaatccatgcttccaaggaacacgttgaaccagagagagcgcagcgcagcagatcgtattaagaggctcgc

SEQ ID NO: 3881 - DNA, 278 bp, Homo sapiens
agcggtgtaatgattgagccttttggcctggcttgtttgcaaaggccttggcaacgtcacattggagctatcttcaattgagggggccgttggacctcttccagcagctggtgctccaccaccagagaggtcctcccccttcacactgctgttctctccacttagaggagaggagtgtggagccagagagagaagattccgaggagtctcatgatgacatgggtctcgggtctgtgaactacacctctcatatacatgytacactaagcgctgcatct

SEQ ID NO: 3882 - DNA, 190 bp, Homo sapiens
cttattcgcagaatgggggtttattaagttgttaagaataggcctactttaagagatacagtaaattgagacggcgagaaggtaaaacctattattattctccgcaccgtttgtgataccaggtaaacataaataccacacacacccattcacagttgtaggttcgtgttgccacagagatatccttgtc

SEQ ID NO: 3883 - DNA, 145 bp, Homo sapiens
gcgtggaggatgagctgagggaaatagcctcagagcctttgcagagcactacttctacacggctgacttcaggaccatcaaccagataggcaagaaggttgcagaaggaagatctttgtggaggaggaccgtgtgcctccgagtc

SEQ ID NO: 3884 - DNA, 113 bp, Homo sapiens
ccggtgggggttgaggcagaggagttcgaggatgctcctgatgtggagccgctggagcctacacttagcaacatcatcgagcagcgcagccttcaaggtggatcttcgtcggg

SEQ ID NO: 3885 - DNA, 185 bp, Homo sapiens
accccgcccgcacctgccgtgacctcaagatgtgccactctgactggtggagttggagagtactggattgacccaaccaaggctgcaacctggatgccataaagttttctgcaacatggagactggtaggacctgcgtgtaccccactcagcccagtgtggcccagaggaactggtacatcagca

SEQ ID NO: 3886 - DNA, 159 bp, Homo sapiens
cagctacaggccaaacccagaccagaggaggcctcagtttacacttcagccactgcctgtgaccctatcagagaaggcagtggcaaccaatatttcttagggtccaagggcttctggagaattgagacagttttcccagtccttagacatggcttcagg

SEQ ID NO: 3887 - DNA, 140 bp, Homo sapiens
ctccacgcagcgcgcttcgctcgcgagctccaccgagagaagggggtagtaggaggtttgtaccatggctcgtacaaggagactgcccccaatcgcccgtggtaaagcacccaggagcactgctacaaagccgctcgcag

SEQ ID NO: 3888 - DNA, 187 bp, Homo sapiens
ccgcgccggtgagtagcactctctgagagctccaatttcatccgtctgccatcggcacccatcctgcaatctaagccacaatggtgcgcatgaatgtcctggcagatgctctcaagagtatcaacaatgccgcagagagaggcaaacgccaggtgcttaattaggccgtgctccaaagtcatcgtcc

SEQ ID NO: 3889 - DNA, 192 bp, Homo sapiens
accagacttcgctcgtactcgtgcgcctcgcttcgcttttcctccgcaaccatgtctgacaaacccgatatggctgagatcgagaaattcgataagtcgaaacttaggaagacagacacgcaagagaaaaatccacttccttccaaagaaacgatttaacaggagaagcaagcaggcgaatcgttatgaggc

SEQ ID NO: 3890 - DNA, 168 bp, Homo sapiens
ctgcctcagcctcccaagtagctgggattacaaacatgtgccaccaagcctgattaattttgtatttttagtagaggtgggttttcaccatgttagttaggctggtttcgaacttctgacctcaggtgatccactgtctttgcctcccaaagtgctggcattacaggt

SEQ ID NO: 3891 - DNA, 208 bp, Homo sapiens
gaagactgaccaacttccctttgaaaagcctattaaaagctccagattctcaaaccagaggctaagatgaatgaggggtttgagtggcaactgaaattataccaggcaatgggatacgaggggatacctctagtgcaatttataagcaatatcgtttacaaaaggttacagagaagtatccagatttgcagagtttacctcaaggact

SEQ ID NO: 3892 - DNA, 242 bp, Homo sapiens
ggcaagatgaaagtcctcaagttttgcctgcaagtacaaaaagaaggatcccaaggaatgggcagctcagtaccgagaggcgatggaagcggatttgaaggctgcagctgaggctcagttggaaagccaaggctagggccgagattagagctcgaatgggcatttggctcggctcggagaatgctgccgggccctccaacctgggacgagcttatatcggaccctggcccaaagccggatcc

SEQ ID NO: 3893 - DNA, 241 bp, Homo sapiens
ttcctttcaaccacgtgtgccctagggagcagacaacatggcgctgggcaagtggaaagcccacttgcgtaataagatgagggtggggtggccagcttcccccatgctatgtaaacgtcacacctggttcactgatctttggatctatgtaaatcagacacacctctcaaacctgtctataaatccggtgcactctgtcgcaggccagaggtcacatttggggttccctctctgtcgcagg

SEQ ID NO: 3894 - DNA, 130 bp, Homo sapiens
cagcagcattaacatcaactgggattttcttagacatgcagaatatcaggccccacaagagtcctgctagatcagaacctgtgtttttcacaagaaccccagctcatttatgtgcacattaatgtttgac

SEQ ID NO: 3895 - DNA, 179 bp, Homo sapiens
cagcagcattaacatcaactgggattttgttagaaatgcagaatatcaggccccacaagagtcctgctagatcagaacctgtgtttttcacaagaaccccagctcatttatgtgcacattaatgtttgaaaaacactgatctagaaaacaagtgcctgcctgcctgatttttttttttt

SEQ ID NO: 3896 - DNA, 144 bp, Homo sapiens
tccatttcacagaggaggacaaggctactatcacaagcctgttgggcaaggtgaatgtgggaggatgctggaggagaaaccctgggaaggctcctcggttgtctacccatggacccagaggttctttgacagctttggcaccct

SEQ ID NO: 3897 - DNA, 221 bp, Homo sapiens
ccttaagctgatggggtcaaatgaaggtgaattcaaggctgaaggaaatagcaaattcacctacacagttctggaggatggttgcacgacacacacttggggattggagcaaaacagtctttgaatatcggacacgcaaggctgtgagactacctattgtagatattgcaccctatgacattggtgggtccccatcaagaatttggtgtggacgttggccc

SEQ ID NO: 3898 - DNA, 200 bp, Homo sapiens
tgcatatctgcttctgtgtttttctgtaattacagttctcctgtgacccaagtctgtgctttgccttgtcctgtgtctggtgcactttcccttggccctcggtggtctcaggctccagcatttggtaacggcccctgttccagggtgctgtgctgatggcgcaagtggccccctttaggggaatccctccatgtctaact

SEQ ID NO: 3899 - DNA, 450 bp, Homo sapiens
tgcatatctgcttctgtgtttttctgtaattacagttctcctgtgacccaagtctgtgctttgccttgtcctgtgtctggtgcactttcccttggccctcggtggtctcaggctccagcatttggtaacggcccctgtgccagggtgctgtgctgatggcgacaagtggccccctgtaggtgaatgccttcatgtctaactgtgtgtgtgtctggtgggttgagcattttcaaggctttgatacatatcaccttccaccaagattacacttttaaaaccattgccaaaatacgacttttgggaatggataccattctaaaggaagaaaatcgtgtctagttttaagttgcatttctttgagtgaaattagacctcgttcatgcggatgttggctatttattctcgccaactgtgcctaattgtataagcgcgttcttgtttttttccttt

SEQ ID NO: 3900 - DNA, 168 bp, Homo sapiens
ggaaggcattccccccgaccagcagaggctcatctttgcaggcaagcagctggaagatggccgtactctttctgactacaacatccagaaggagtcgaccctccacctggtcctccgtctaagaggtggtatcagattcttcgtgaagaccctacccgccaagcccat

SEQ ID NO: 3901 - DNA, 130 bp, Homo sapiens
ataagattcaccaatccctacatttggctacttgaactctattaataatggtagtattatatatacacggccaatactctattctcaagtgggtaaggccactgcacttattttatgcacaggcctttca

SEQ ID NO: 3902 - DNA, 550 bp, Homo sapiens
ataagattcaaaaatccctacatttggaatacttgaactctattaataatggtagtattatatatacaagcaaatatctattctcaagtggtaagtccactgacttattttatgacaagaaatttcaacggaattttgccaaactattgatacataagggttgagagaaacaagcatctattgcagtttctttttgcgtacaaatgatcttacataaatctcatgcttgaccattcctttcttcataacaaaaaagtaagatattcggtatttaacactttgttatcaagcacattttaaaaagaactgtactgtaaatggaatgcttgacttagcaaaatttgtgctctttcatttgctgttagaaaaacagaattaacaaagacagtaatgtgaagagtgcattacactattcttattctttagtaacttgggtagtactgtaatatttttaatcatcttaaagtatgatttgatataatcttattgaaattaccttatcatgtcttagagcccgtctttatgtttaaaactaatttcttaaaataaa

SEQ ID NO: 3903 - DNA, 200 bp, Homo sapiens
cgctctcttgcccaggctggagtgcaatggcacgttctcagctcacggcaacctccgcctcttgggttcaagcaattctgctgcatcagcctcccgagtacctgggtttcacaggcatgtccccaccacgcccggctaattttgtatttttagtagagacggggttttcccatgttgcgccaggctggctctcgaactct

SEQ ID NO: 3904 - DNA, 105 bp, Homo sapiens
taatgatcaggattgagattaatactgtagtataaattgggacattataccagattccatattttatttcctaaaatctaaattcagtctataatgaaataatat

SEQ ID NO: 3905 - DNA, 121 bp, Homo sapiens
ggaattacaccattcagtcttaaattttggcccatgaggggaggaaattttggaggaagaggctctggccccaatggcgtgtggaggccattacttctgcaaaaccacgaaccaacggtgg

SEQ ID NO: 3906 - DNA, 285 bp, Homo sapiens
cggcacgagcagaacatgatcaagggtgttacactgggcttccgttacagatgaggtctgtgtatgctcacttccccatcaacgttgttatccaggagaatgggtctcttgttgaaatccgaaatttcttgggtgaaaaatatatccgcaggtttcggatgagaccaggtgttgcttgttcagtatctcaggcccagaaagatgaattattccttgaggaattgacattagcttgtttcaaattcagcggctttgattcagcaagccacacagttaaaacaggat

SEQ ID NO: 3907 - DNA, 265 bp, Homo sapiens
ctcacagaaagttctccgctcccagacatgggtccctcggcttcctgcctcggaagcgcacagcaggcatcgtggggaaggtgaagagcttccctaaggatgacccgtccaagccggtcacctcacagcctttctgggatacaaggctggcatgactcacatcgtgcgggaagtcgacaggccgggatccaaggtgaacaagaaggaggtggtggaggctgtgaccattgtagagacacaccatggtgtttgtggcattttgggc

SEQ ID NO: 3908 - DNA, 400 bp, Homo sapiens
aggtcgacactagtggatccaaagaattcggcacgagtgtgatttctctactggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagacagcattgcatacatggatgaggagactggcaacctgaaaaggctgtcattctacagggctctaatgatgttgaacttgttgctgagggcacaacrggttcacttacactgtcttgtgatggctg

SEQ ID NO: 3909 - DNA, 315 bp, Homo sapiens
ctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtagggaggttcccacctataaacttataaccccagctgtggtctctgagagactgaggttcggggctccctggccagggcagcccttcagggctccttaggtaag

SEQ ID NO: 3910 - DNA, 285 bp, Homo sapiens
ctcgtccaaatttcggcaggggggggacatataaaggcagctgtgtctggtgtgctgtcttttcagactcacttgataatgctagtgtcagtttcaactgaagcgtgttccagattccagacagcttgagctggcatttcagagaggttaattgtgaacttgaggaggaaattggcacattctctctaagatggctattcaaatatagtctctctcctccccccagagctttctggggctcagctcacttttgtctgctccacgtaaatgcatagggacactgcg

SEQ ID NO: 3911 - DNA, 580 bp, Homo sapiens
ctcgtgccgaattcggcacgaggggacatataaaggcagctgtgtctggtgtgctgtcttttcagactcacttgataatgctagtgtcagtttcaactgaagcgtgtgccagattccagacagcttgagctggcatttcagagaggttaattgtgaaacttgagaagaaaatgggcacattcttcctaagatggctattcaaatatagtctctttcctcccccccagagctttctgggtctcagtctcacttttgttctgcttccacgtaaaatgcatgaggaacactgagccttttccccttggcagctcctatattgccatctttgctgggactgctttgccttgttaaaatgtgccccgtgtattaaaatggaattgtcactgctgggtggtgcagcgtaacatggtttgacactaagcgccggcagctacagaaaacagacttttattgcatttaatccttcagagacgggagtctctaaaggctcacagcagacattcacttagttaaatctgaatgaacccaaaagtgaacaatctactctgctgtctttgtgttcatagaaacagcccccatc

SEQ ID NO: 3912 - DNA, 245 bp, Homo sapiens
agcagtggcatttaaagacagggagaaatcccatgccatttagggctttgtgtctgaaaggcatacgcctccgttctgtggccatttgcacttacacagaagccctcactttcctctaatgaactctactcattatccaagtggataagccatcgttcgatcagcagatgtttcccgagcacctactggatgtcagctttctgcaggcatttcaggcacaacttttaagtaaacatatggggctt

SEQ ID NO: 3913 - DNA, 250 bp, Homo sapiens
aaaaagcttggaactccatcacgtggaaaaactagatcctgttggttatagcatttgtgagttctccacgtctgtctctctcgctcatgtaatatactctgacccccagtggaaggggtttttgttctgtttttattttacctacatgtactatttagcttcagtgtactagtcctgccacctgtgtattttgagggtgctatggaaataatgaaaagaaacggggatttcagaagaaattgtcaccaat

SEQ ID NO: 3914 - DNA, 215 bp, Homo sapiens
ttgttcgtgttacccagaggagtcgcttggtgatttgggagctcaaccctggttcagtgctcttcttcatcaagtggtcttggaggagggaggttgccagcattgtgcaggatacacaccccggcaggcacattcctccttattttgtggctttggtgccacaggaaggaagagttggatgaccacgacaattcaggtactcctccaggcttcca

SEQ ID NO: 3915 - DNA, 186 bp, Homo sapiens
tcatgatccgcctgcctcagcctcccaaagtgctgggattacaggcatgagccaccgcgcttggacaactttgtcttcttaattgcataagattgtcttttaaacatgaaaatggaggtcaacataataaaactgcaattcatattttcccaatgtgtgttctgaggagacacggtaaactagaga

SEQ ID NO: 3916 - DNA, 361 bp, Homo sapiens
aaacatcccagccaagaactggtattaggagctccaaggacaagaaacacgtctggctaggagaaactatcaatgctggcagccagtttgaatataatgtagaaggagtgacttccaaggaaatggctacccaacttgccttcatgcgccttctggccaactatgcctctcagaacatcacctaccactgcagagcagcattcatacatggatgaggagactggcaacctgaaaaaggctgtcattctacagggctctaatgatgttgaactcgttgctgaggcacagcaggttcactacactgttcttgtagatggctgctctaaaagacaaatgaatggggaagacaatcattgataca

SEQ ID NO: 3917 - DNA, 117 bp, Homo sapiens
tgatgggtggggtggggagggaatcactggtgctatagaaattgagatgcccccccaggccagcaaatgttcctttttgttcaaagtctatttttattccttgatatttttctgtct

SEQ ID NO: 3918 - DNA, 227 bp, Homo sapiens
attccatgaaaaaggaattgtgtggacaagtaacctgttggaacacagcatttcattttatattcatctcttggagatccacagcacacattagcacttttatgactggtaagtcctgcatgcctcattaacattgtttaattcagcatttgtaaattaactctaatatggtatttttaaaatagggacatgtgaggagtatgcttctcgagatatcgtgagcacay

SEQ ID NO: 3919 - DNA, 284 bp, Homo sapiens
tgacggacctacgacacgagaacatgctctcgcaaaggatctccttcatcctctccagaagaggagaagaggaaacacaagaagaaacgcctggtgcagagccccaattcctacttcatggatgtgaaatgcccaggatgctataaaatcaccacggtctttagccatgcacacacggtagttttgtgtgttggctgctccactgtcctctgccagcctacaggaggagaagcaaggcttacagagggatgttccttcagagggagcagcactaaaagcactct

SEQ ID NO: 3920 - DNA, 232 bp, Homo sapiens
ggtgaaaagaaggcacggaaggctatttcaaactgggtcttcggcaggttacaggagttactagagtcactatccggaaatctaaggatatcctctctgtcatcacaaaaccagatgtctacaagagccctgcttcagatactcacatagtttttgggggaggccaagatcgagatttatcccagcaagcacaactagcagctgctgagaaattcaaagttcaaggtgagct

SEQ ID NO: 3921 - DNA, 130 bp, Homo sapiens
acaggttctaggactgtagcaggaactgaccaaaacaacatgtaaatcaaagagattttaaacatatgagaagttagaacactcacatgcaaacaaattttactggtatgtcaattcttccagagaaaca

SEQ ID NO: 3922 - DNA, 534 bp, Homo sapiens
acaggttctaggactgtagcaggaactgaccaaaacaacatgtaaatcaaagagatttttaaacatatgagaagttagaacactcacatgcaaacaaattttactggtatgtcaattcttccagagaaacaaaaaaaaaaattaacttcttaactgagggaaagaatgtgtgtttgttcattgatgatttggccaaactataggcatggtgagtctcaggcttagctgttgaactatcttgagtaggttaaagaagtcaacatgaaattctattatgtttttaactaatgaattctgatatggaaaactgcactggaaaacattttaatgcatttatctcacatatacttagaaattgtcttaaaagatacaattactctgtacttctgaatattagcgcttattacatataagtaaacatggatacaagagacagttcatatgtttgataccgacataaaaaagtaatcattgaagtggactatgttcatcttgccaagaactcatctatacacagagtttgagacctctgtc

SEQ ID NO: 3923 - DNA, 280 bp, Homo sapiens
gttcgacaagtcagccgcatcttcttttgcgtcgccagccgagccacatcgctgagacaccatggggaaggtgaaggtcggagtcaacggatttggtcgtattgggcgcctggtcaccagggctgcttttaactctggtaaagtggatattgttgccatcaatgaccccttcattgacctcacctacatggtttacatgttccaatatgattccacccatggcaaattccatggcaccgtaaggctgaggacggggagcttgtcatcaatggaatcccat

SEQ ID NO: 3924 - DNA, 338 bp, Homo sapiens
gcgacttcgatattaacaaggatggcggcggccgcagcaagtcgaggagtcggggcaaagctgggcctgcgtgagattcgcatccacttatgtcagcgctcgcccggcagccagggcgtcagggacttcattgagaaacgctacgtggagctgaagaaggcgaatcccgacctacccatcctaatccgcgaatctccgatgtgcagcccaagctctgggcccgctacgcatttggccaagagacgaatgtccctttgaacaacttcagtgctgatcaggtaaccagagccctggagaacgttctaagtggtaaagcctgagcctccactgaggattaa

SEQ ID NO: 3925 - DNA, 334 bp, Homo sapiens
gatgatggcggccggcgcggccttagcccctggccttgttggctactaatgccaccagttggaggttgggaggggcgggggccccgccaaattccaggacggttgagttcacgttccttttgccggcggggaggaagcagttttttctaccagttccgcgccggcccaacgcaagcctcgagaccatattaccaggtgatcggaggtgctggactggacgtggactcacgttggagaacctcaggcgtgctgttggtcagcaagtccgcaggcttatggggacaaacggtgagcaacgaggccgggactcagttttctttacactcttagacat

SEQ ID NO: 3926 - DNA, 280 bp, Homo sapiens
ggaaagttcccttccctgctcacacacaacgacaacatggtggccaaaggtggatgaggtgaggtccacactcaggttccacattgaggagggtgttatgtctggctgtagctgttggtcacgtgaggatgacagacgatgagcttgtgtatacattcacctggctgtcacttctggtgtcattgctcaggaaaactggcagatgtccggccttatatatcaggagcacatgggcaggcccagcgctatattaggcacatttgataattctatacagtaa

SEQ ID NO: 3927 - DNA, 253 bp, Homo sapiens
ttagaggtgtctgattattggccgaatccttctgctgtggctataagctacctggccactgacataggtactatgcaggacagaattaccactaccacgaggggatctatcactctgaacaggctatctatgtgcctcctgatgccttagctacccctccccttctactacggttcccattttggtgctacctctgactttcgggtgcattctgacctggcatctatcacctgtggagctctaggctcactct

SEQ ID NO: 3928 - DNA, 386 bp, Homo sapiens
gtggaagtgacatcgtctttaaaccctgcgtgggcaatccctgacgcaccgccgtgatgcccagggaagacagggcgacctgggaagtccaactacttccttaagatcatccaactattggatgattatccgaaatgtttcattgtgggagcagacaatgtgggctccaagcagatgcagcagatccgcatgtccctcggcgggaaggctgtggtgctgatgggccagaccaccatgatgcgcaggccatccgagggcactggaaacaacccagctctggagaactctgcctcatatccggggatgtggcttgtgtcaccaggaggcctattagatcaggacatgtgctggccataagggcactgctgccgtctggtccatcccca

SEQ ID NO: 3929 - DNA, 280 bp, Homo sapiens
ccggcacgagcggcacgagggacgtgggacccactcatggttcatgaggaagagaaggcaggacccgcaactgattgaaaaggagggcttgttcagtgtggaggaggattcagaaggggggattaggttaccatctcccagcctgcaggaccaaaaaacaaaaggcaggaattaaatcaggtttcactgctatttatatattgtcccttccccaaatgatttttctaagctgggagtggagcaggagggagaacagcaggtgagcagggaggctctttag

SEQ ID NO: 3930 - DNA, 307 bp, Homo sapiens
gttttcttcctccttcttcatccgataatattcatcaatggcatattggtactttggggtgctgatacccaaaacagatgcatcttctctccaaggaagtcacacactgagagagttgatgtagcagcccgaagcatgtaaaaccataagtagggaccccaggtaagttttgtcggatcaacagtaggcaaaacatctttccttctccaggccatcaacttcgtcttcaactgtctatatcctcccattgttcacactaacaaagtggatgactctctggggcttctctttttctatgctccagtct

SEQ ID NO: 3931 - DNA, 274 bp, Homo sapiens
gtccgccaagctacttctaccgccagcaccttcgtgaagcccattttcagtcgggacatgaacgaggccaagcggagggtgcgcgactctaccgcgcctggtatcgggaggtgccgaacactgtgaaccaattccagctggacataactgtgaaaatgggacgggataaagtccgagaaatgtttatgaggatgcccatgtaacagacccagggtggttgatctctggtcattaagggaaaggtcgactggagaacattaagtatggagcagcg

SEQ ID NO: 3932 - DNA, 325 bp, Homo sapiens
tatggacagaaggccaccatcctccacagagcaccctgtcctgagtaggggttgtgctcattaccccaggccagtggtagcttcctcaggagcctggccacttccaacggtagcactgaagtcatgcaaatgcatagtcaggtagattcagaccttgtccacacctttcctgggcaacccccaccatgaacctgtcagcctctttcccatagctaatagacatttcccaggccttgaggggccccaccctgtctctttatcaaacctgatggtccaggctgggcatcctctcctcctccatcccagcaatcaccaggtctatgtt

SEQ ID NO: 3933 - DNA, 220 bp, Homo sapiens
ttacttgcgaggaatgaagacttatttcttcagcaaatcagacttgtcggaccattcccagaaaaaatgtcgacatttactctgaaggggacgcacagtttatctgtgaagggcccccagaggaacccttgcgggaggggacttcaatcacatcaatgtagactcagccttcttggaagaaaaaaaagaggctccgggttgacaaatggtggggtacaga

SEQ ID NO: 3934 - DNA, 235 bp, Homo sapiens
tccagaggaggctgtaagagccatcgccaagatccggtcatacatccacatcaggcctggccagctggatgttcttaaagagttccacaagcagattactgcacgggcaacaaaggatgggacttttgtcatttcaaagacatgatgtatggggattagaaagacctcaagacactcctgctttatacagaacaaaaagagcttaacaggaccaaccagggcttagccagacttg

SEQ ID NO: 3935 - DNA, 232 bp, Homo sapiens
gcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaccatcaattgatatt

SEQ ID NO: 3936 - DNA, 220 bp, Homo sapiens
aagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaacatgaacttttttgagtaataaaattgaaaagacgctga

SEQ ID NO: 3937 - DNA, 134 bp, Homo sapiens
ctcgtccaatttcgggcaggtttggtttatcttttgttcattgtaaaggaactatgtgggatgcatttggtgatctttttaaaaaatgtataaatttcttgagtaattcctggattaaagaatatgcacttttt

SEQ ID NO: 3938 - DNA, 237 bp, Homo sapiens
gccgccgtcgctctccaacgccagcgccgcctctcgctcgccgagctccagccgaagagaaggggggtaagtaaggaggtctctgtaccatggctcgtacaaagcagactgcccgcaaatcgaccggtggtaaagcacccaggaggcaacttgctacaaaagccgctcgcaagagttcgccctctactggaggggtgaggaacctcatcgttacaggcctggtactgtgggcgctcg

SEQ ID NO: 3939 - DNA, 230 bp, Homo sapiens
caattcaggtgctaggggttattccgccccttaagtagatctgaggcagacccttggggttgtaaaagagagtcacaggtaccccaaggagtagatgccagggtcctaagttgaaaatgatgtcgattgggggcggggaacactgtatttgatatttgtgatcagtgatcattgttcaactgcgaaatagagtgtttgcttttgataatggaaaattgtattcgtttgaa

SEQ ID NO: 3940 - DNA, 200 bp, Homo sapiens
caagaccaccctggccaacatggtgaaaccagtctctactaaaaatacaaaaattggctgggcatggtcacgtgggcctgtagtcccagctacttgggaggctgagataggagaatctcttgaacccaggaggtggaggttgcagtcagccgagattccaccactgcactcagcctggtgacagaatgagactctctctc

SEQ ID NO: 3941 - DNA, 226 bp, Homo sapiens
tgacaatatacaaataacttgttttcctgaacatgctacatcggagtccctaaatttggtattgagcgcccctacacagatgcagcacctggagtgattagtgcccaagtaagatttagccatttaaggttcagaatgtcctctctttatagaatcaggtgaattaatacccacttgactctatgatttgagtcatattggctaatgctatatggacaggtctatc

SEQ ID NO: 3942 - DNA, 506 bp, Homo sapiens
tgacaatatacaaataacttgttttcctgaacatgctacatcggagtccctaaatttggtattgagcgcccctacacagatgcagcacctggagtgattagtgcccaagtaagatttagccatttaaggttcagaatgtcctctctttatagaatcaggtgaattaataaccaattgactctatgattttagtcatattggctaatgctatatggacaggtctatcataggaaggcaagggagttgacaactactttaagaaatatttacaaaccattctacagtttcttcatagggcatatgggagcctgatgcttcttaccagaaataggtgaataaaataggactcagatagatgttcatataggtttttagaaaagaaatagtctttgcccagagagcagaaaagattacaaataaattaagactacagataaagccctttttaggattatgcaggaaccatggacaagaatctgagaccatactttagtcctatacaattt

SEQ ID NO: 3943 - DNA, 262 bp, Homo sapiens
ggagaaagagaacttagtcttcgagttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctatataaagtagagcacacacattgaaagcttctgatcaacggtc

SEQ ID NO: 3944 - DNA, 205 bp, Homo sapiens
gggaatccctcacctggtgactcatgatgctcgaaccatccgctaccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccacagggaagacatcctggt

SEQ ID NO: 3945 - DNA, 209 bp, Homo sapiens
ctcgtccaatttcggcaggggccgaggagcagtgtcaggagttgatggaggctcttcgtcgggccagctacgagttcatgcggagaagcctcatcttctacaggacgaaatccggaaggtgacgggcaaggacccctggacagttcggcatattcgaggaggccaggttccagctgagttgctttcaggcgttacccagggcacggttg

SEQ ID NO: 3946 - DNA, 157 bp, Homo sapiens
  misc_feature 17: n = A,T,C or G
ccggggagcggagtccngcccgccgccgccatgccggacagcttgtacaaggatgtgtaccctgagcccccgcgccgcacgccggtcagcccaatcccatcgtctacataatgaaagcgttcgacctcatcgtggaccgaccgtgaccctcgtgaga

SEQ ID NO: 3947 - DNA, 117 bp, Homo sapiens
catcaacattcacaagcgcatccatggagtgggcttcaagaagcgtgcacctcgggcactcaaagagattcggaaatttcccatgtaaggagatgggactcacgatgtgcgcattga

SEQ ID NO: 3948 - DNA, 174 bp, Homo sapiens
cttggtcagagtgggcagtccaggctctgctttgggttgtgagtggacacccaactgggcacaggctcaggcacccatcctttttccaaacagggatatagaagtggtggaagcagacagaagaggtaagggagtctatgtgggtaacacccagcatcagggtcactgtcgcac

SEQ ID NO: 3949 - DNA, 133 bp, Homo sapiens
gtggtgacgagcggagtcctttgaggctggagtacaatgatgtgatctcggctcactgcaacctcccactcccgggttcaagcgattctcctgtctcggcctcctgagtagctgggattacaggcgccgacca

SEQ ID NO: 3950 - DNA, 215 bp, Homo sapiens
gatttcttagggtctaagcttataagataaattccttcacattctttgagtgaaagggagccacaaaaccagcgcagactcatgggaagggaaatagattccactctcttgatgggagaggtgggatgcatgcacaaaaatgaggggatttttaatggtggccacatttagagacgctatgacattatccaaattattcattattgcggtgagct

SEQ ID NO: 3951 - DNA, 610 bp, Homo sapiens
  misc_feature 253: n = A,T,C or G
gatttcttagggtctaagcttataagataaattccttcacattctttgagtgaaagggagccacaaaaccagcgcagactcatgggaagggaaatagattccactctcttgatgggagaggtgggatgcatgcacaaaaatgaggggattgttaatggtggccacatttagagacgctatgacattatccaaattattcattatttcgtttagctttttctccttttaaagaagtattttgaatattgtttantattattattacctctaaagtggttttgtgtttttaaatggctccatatcacttttttgtggttattcaataatttaattaattatgccctaatttatggatatgtaggttgttttccatttggggctattccaaacaatgatgggaagaatacctttgtatatatgtttatagggaaacatatatacatcaatttgctgcatcaaaagatgtaagcaatttttaacattgatagatattgttaaattacccttcctctaacaatgcatgagtactttgtctatatgcctttgaaagcacagtgtatcacagaaattctacgtcctttctcataagaatactgctgtattacagttt

SEQ ID NO: 3952 - DNA, 188 bp, Homo sapiens
gaaagacaatcattgaatacaaaacaaataagccatcacgcctgcccttccttgatattgcacctttggacatcggtggtgctgaccaggaattctttgtggacattggcccagtctgtttacaaataaatgaactcaatctaaattaaaagagagagatatttgaaaacactttctctttcgccatt

SEQ ID NO: 3953 - DNA, 244 bp, Homo sapiens
ctcgtccgaaaaaaataggggacagaaatcaggtattcgcagtttttccattttcatttgtgtgtgaatttttaatataaatgcggagacgtaaagcattaatgcaagttaaaatgtttcagtgaacaagtttcagcggttcaactttataataattataaatccacctgttaaatttttctggacaatgccagcctttggtttttttaaaacaagtaaatttcttattgatggcaactaaatg

SEQ ID NO: 3954 - DNA, 352 bp, Homo sapiens
cggcacgagccagcacaaagttgcattcctcccccctaatttattctaatttattaactttgacccaccctttctgagcctgcagccttcccgtgtggcctgagggctgtcgagtgagctgccccagcccctcccagcccttgcccagccttggggagtggggaaggctttggcatggcccgttggaggttgatttgctgttttgtttcttgtctttgtgtctgtggacttgctgagagaaagaaagtagcaagcagaaggaggtggaaacggaccaaacccagtgtgcctgcccatgctttctttagtggtggaaccctatgtgcaagtaattttccctcccacctctgtg

SEQ ID NO: 3955 - DNA, 310 bp, Homo sapiens
ctggcctcttgcacaggcacttgtccctcaacacactgagctccccactttcccatgcaagtttcctgatgattacaaagagatgcaggacctatgggcttagggtctgtgacaaaactaccaggcttgggtaaagttccagcaaacagccccaccgtgcgcttcatcatttcataaatgcgtatcagtccagatgctaaattctgaaactggagaggaaagagggataaccaacttaaaaaacaaaagcagttctagcatgccttttagcacatacttactgattatgtgccaaaaaatatgctgtgga

SEQ ID NO: 3956 - DNA, 255 bp, Homo sapiens
cttgcagtatgatagtggcatgatatctgggaggagaaatttggaatatcatttcggatctggatgtgtggcggtaagctcttcatcatcccttgctctagagtaggacacattttccgaaaaaggcgaccatatggatctcccgaaggccaggacaccatgacacacaactctttgcggctggcacatgtctggttggatgaatacaaggggcagtatttttccttaagacctcccctaaggcgaaagctatgg

SEQ ID NO: 3957 - DNA, 350 bp, Homo sapiens
tcaacatttaattgaatcgtgtatcctgataggtggattaggaacaggattcattcctttaactttaacttttggctaaacgacatgccttggattgagtgtatatgtcttccccaaattcatatgttgaagcttaaatcctgaatgtgatggttcttggaattgggccctttggaaggttattgggtcttgagggcagaccttcacgaatgggattaaggcccttataagaagagacatggggccaggtgcagtggctcacacctgtaatcccaacattttgggaggccgagaagggtggatcatgaggtcaggagatggagacctcctggccacatggtgaacctcgt

SEQ ID NO: 3958 - DNA, 102 bp, Homo sapiens
atatgtcgaagcgaggacgtggtgggtcctctggtgcgatattccggatttccttgggtcttccgtagagctgtaatcaattgtgctgacaacacaggagcc

SEQ ID NO: 3959 - DNA, 270 bp, Homo sapiens
gctcggtccttccgaggaagctaaggctgcgttggggtgaggtcctcacttcatccggcgactagcaccgcgtcccggcagcgcaagctcctacactcgcccgcgccatggcctctgtctccgagctcgcctgcatctactcggccctcattctgcacgacgatgaggtgacaatcacgggggataagatcaatgccctcattaaagcagccggtgtaaatgttgagcctgtctggcctggcttgtttgaaaggccctcgccaacgtaaa

SEQ ID NO: 3960 - DNA, 180 bp, Homo sapiens
ttactacatgctgggagacggcatccaagaggaaaaagattatgagcctcacacaatttgtgagcatctccagtacttgtttgccttgttgcaaaacagtaataggcgatacattgatccatcaggatttgttaaagccttgggcctggacactggacaacagcaggatgctcaagaatt

SEQ ID NO: 3961 - DNA, 220 bp, Homo sapiens
agatgctctccccggtcttctgctgcaatttagattcctttcccttctctccagttctccttcccttaccaaggagaggggagcaaatggttttgggcaaggtytttggccattcatgtcaagctggttgtgggtttttcaaggccccatacccaacccaaatatgttttttaagagcgtggggttttttaatctctcccacccttgtcaagggtgtttt

SEQ ID NO: 3962 - DNA, 172 bp, Homo sapiens
ccttgatcagtgtccatccggctaatttgcatcatgaactgaacagtgtgtgagttggtcacctactaaacccagctcttgggggcagactgtcttccccaactcttggtgtcccaaacaccgtgagatggtgcctcgtcgagaggataggaaccccatagagagagtttct

SEQ ID NO: 3963 - DNA, 226 bp, Homo sapiens
aggtcagggatcagtgaattgttttcattgaaagtctaaaactgtttgtgttactaaaataatggaaaaattttagagggtgatgtaagaattcatttgtaggctgctgtgtacagagtgtcagttgaagtgaggatagacgtcggagacacgttaacgttggggtgggattttactaccaacgtcttacgctgatactcgtacaccggggggtggggtacccgtg

SEQ ID NO: 3964 - DNA, 288 bp, Homo sapiens
tgtgttggcgagtgagatggtgtttcaaaaaggtatggtggtaaatttgttaagtcaaggttaaaagggagtaaaatttgtggcaatgaaccatgcaggtttgagtgaagttgttcctggggacaatgtggggttaactgtcaagaatgtgtgtgtgcaaggatgttggtggtggaacagttgttggtgaaagaacaaatgacaacaactggacggagatggttaactgttaggtgattatattgaccattaagggaactaagcgtggttatgtgctgtattggattg

SEQ ID NO: 3965 - DNA, 144 bp, Homo sapiens
ccttgatcagtgtccatccgcgctaatttgcatcatgaactgaacagtgtgtgagtggtcacctactaaacccagctctgggggcagagctgtcttccccatctctggatgctcctaacaccctgataagatggtcctatcagg

SEQ ID NO: 3966 - DNA, 380 bp, Homo sapiens
agagagagtgtgtgtgtgtttgtatgagtgtgtatgtatgtgtgtgtgaatgtgtgtgaatgtgtgtgtttgtgtacgtgcatgaatgtgtgtatgggtgtgtttacgtgtgtctgtgaatggtgtgtgtatgtgtgtgtatgagagtgtgtgtgtgagagagagagggagcctgcatacacacgtgcctatgtgggtgaagggttaccaaaagagggcgaattcaggaggctagctatggctttgaaactatccagaggtttcagaaatccaagaagtaccgggatttcttagagaacattaccagatgcctaggatgtggcctggtctactcagaaacctgtctggaggagtcaatgggaaaggagtggtacaagagt

SEQ ID NO: 3967 - DNA, 355 bp, Homo sapiens
agcgccgctcggcttgcaccgcgctcgctccgagtttcaggctcgtgctaagctagcgccgtcgtcgtctcccttcagtcgccatcatgattatctaccgggacctcatcagccacgatgagatgttctccgacatctactagatccgggagatcgcggacgggttgtgcctcgaggtggaggggaagatggtcagtaggacagaaggtaacattgatgactcgctcattggtggaaatgcctccgctgaaggccccaggcgaaggtaccgaaagcacagtatcactggtgtcgatattgtcatgaaccatcacctgcaggagacaggttcacaaagagcctcaggagtcatcat

SEQ ID NO: 3968 - DNA, 380 bp, Homo sapiens
ggtccttccgaggaagctaaggctgcgttggggtgaggccctcacttcatccggcgactagcaccgcgtccgggcagcgcagccctacactcgcccgcgccatggcctctgtctccgagctcgcctgcatctactcggccctcattctgcacgacgatgaggtgacagtcacgggggataagatcaatgccctcattaaagcagccggtgtaaatgttgagcctttttggcctggcttgtttgcaaaggcctggcaacgtcaacattggagctcatctgcaatgtggggccggtggactgctccagcgctggtgctgcaccagcaggaggtctgcccctccatgctgctgttcagctgaggggagaagtggagcaagaag

SEQ ID NO: 3969 - DNA, 310 bp, Homo sapiens
gcggaggccgcacgatgcctggagttactgtaaaagacgtgaaccagcaggagttcgtcagagctctggcagccttcctcaaaaagtccgggagctgaaagtccccgaatggtggataccgtcaagctggccaagcacaaagagcttgctccctacgatgagactcgttctacacgcgagctgcttcacagcgcggcacctgtacctcggggtgcgctggggttggctccatgaccaagatctatggggacgtcagaaaacggcgtcatgccagccacttcagccgaggctccaagagtgtggccgccgg

SEQ ID NO: 3970 - DNA, 360 bp, Homo sapiens
cacactcaagtccctcaacaaccagattgagagcatccgcagccccgagggttcccgcaagaaccctgctcgcacctgcagagacctgatactctgccaccctgagtggaagagtggagactactggattgaccccaaccaaggctgcaccttggacgccatgaaggttttctgcaacatggagactggcgagacttgcgtctaccccaatccagcaaacgttccaagaggaactggtggagcagcaagagctaggagagaacacatctggtttggagatacatcaatggtggcttccatttcagctatggagatgacaatttggctccacactgccacgtccagtgaccttcctacgct

SEQ ID NO: 3971 - DNA, 385 bp, Homo sapiens
ctcaaggctgcccacacctatgtctcagaagagcttagggcattggggatccccttcttgagtcgtggggctggcttcttcatctgggttgacttgagaaagtacctgctcaagggcacctttgaggaggaaatgctgctctggcgccgcttttttggacaacaaggtgctgctgtcctttggcaaggccttcgagtgtaaagagcctggttggtttcgctttgtcttctcagaccaggtccaccggctttgctggggatgcagagggtcagcaggtgcttcaggcaatccaagtggcagagaccccgtccttagagcaggagcaagtacacgaggtagctgtatttttgtgcaagccagagcactttgactgggcgtttgggct

SEQ ID NO: 3972 - DNA, 320 bp, Homo sapiens
actactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacaaagagactttatcaaaacatgattacagggccatctcaggctgactgtgctgtctgattgttgctgctggtgttggtgaatttgagctggtatctcaggatg

SEQ ID NO: 3973 - DNA, 165 bp, Homo sapiens
gtcaaactaatctgaatatggttaattgggttaatatttaaaggttagaatttttgtgttgttagctaagttgtttcatgtcacttcctttgcctgatagcagtgacaatttggggttgatttagatagaggaacattttgaatttgacctaggagagcggactt

SEQ ID NO: 3974 - DNA, 265 bp, Homo sapiens
aaatcactcacctcttccagagcacgcccctcacccccgacctgagaggagaggctcgtggtttgcgatccctctccccattagggtctgtcaccctggggctgagtagtaggtatctatggcgggtgtcttcatggaagccctggccacgcatcttgaagtggctttcatcttgtccctcscaacttaagcggagatgcatcttggagagggtcggaggtacacttagaagcatgtgtgtacgtaaaccgttgtcgtggggtac

SEQ ID NO: 3975 - DNA, 285 bp, Homo sapiens
gaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtcgaaatgtaaagtaggccctaacgctgatgggtcaaatgaaggtgaattcaaggctgaaggaatagcaattcccctcccagttctggaggatggttcccga

SEQ ID NO: 3976 - DNA, 210 bp, Homo sapiens
cgccttctgggcaggtagcagtccctggcctctccccctggctgatcactctccctcaggcagtggagatctgcgtctggacaccctcagatcctgtcattgcctgcccagagtccttcaggggcaccctctgccttggtgtgcagtccagggcttaaccaggtgccgaaccctctggggtcttctgtccagctcccttgcccatggtgc

SEQ ID NO: 3977 - DNA, 385 bp, Homo sapiens
atggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccagcttggggagcgtgctcgtcccctattgccaaggggctcaggctgtccgccaaaggcaaggccaaggccaaggccaaggccaaggtcaaccaaggccaggttgcgcccagtttagttccgtt

SEQ ID NO: 3978 - DNA, 325 bp, Homo sapiens
cctcagcccagtttgtgtctcggctgctccctgtgctgttgagcaccgcccaagaggcagaccccgaggtgcgagaattgccatcttcgggatgggcgttctggcagagcatgggggccacctgcccaggaacacttccccaagctgctggggctccttttttccctcctggcgcgggagcaaattgatcgtgtccgtgacaacatctgtggggcacttgcccgccttttgatggccagtccaccaggaaaccagagcccaggtgctggctgccctactgcatgcccttccactgaaggaggacttggaggagttggtcacattt

SEQ ID NO: 3979 - DNA, 255 bp, Homo sapiens
aagtatctcagtctagaatcacatagtcatttttttttcattggtcgattaatgtttatctcccttctgaactaacagctcccagcgaggatcaggcctttgattccccctgttgatgtccctacccacagcacagtatttggcacggcatcggaggcactcaggggatatatttcgtgtgagtgagtcccccttctgtgacatctccgagaatgaatcactcttgtcgttgaggactggtacagttttcttctc

SEQ ID NO: 3980 - DNA, 360 bp, Homo sapiens
gccggccgggcgcgacccgctccggggacagtgccaggtggggagtttgactggggcggtacacctttcaaacggtaacgcaggtgtcctaaggcgagctcagggaggacagaaacctcccgtggagcagaagggcaaaagctcgcttgatcttgattttcagtacgaatacagaccgtgaaagcggggcctcacgatccttctgaccttttgggttttaagcaggaggtgtcagaaagttaccacaggataactggcttgtggcggccaagcgttcatagcgacgtcgctttttgatccttcgatgtcggctctcctatcattgtgaagcagaattcaccaagcgttggattgttcacc

SEQ ID NO: 3981 - DNA, 230 bp, Homo sapiens
ggaaaaaggaaagaatgtcactttgagaactattaagaagaagcagaaacacaagggacgtgggacagttcgtactgtgactgagacagtttccaatgactctttctttgacttttttgcccctcctgaagttcctgagagtggagatctggatgatgatgctgaagctatccttgctgcagacttcgagattggtcactttttacgtgagcctatgtcccgagatcagt

SEQ ID NO: 3982 - DNA, 218 bp, Homo sapiens
agcagctggaggatgattgttactacattaacaggaggaaacggttagtgaaacttccatgccagaccaacatcataacgatttgggattcctatgtgaagcattttgctatcaatgcagccttttcagccaatgagaggctcgtcaccatcacgtatgcacatgccacatgacgtgcatttttccagcagagaggtgtggccctctgtaggagatgg

SEQ ID NO: 3983 - DNA, 161 bp, Homo sapiens
gcccctcttcccttggttcccacagttttagcgtccctgaaaggacattattctctctaaagcattaaggggttgacgggcccgggggagtgtttgctgttgttggcccccagctccccttccttcttggccaggtgttgggggagacttctgttgtgact

SEQ ID NO: 3984 - DNA, 184 bp, Homo sapiens
ggctgggagttctggcttctaggcctgccctgtcaccaggcctctgagtggccaggcccttccacctccccatctgtaaacgaggcagctcccggccagccttggggtccttagtggcccttcaggccctcttggcagctcttctgaccccacctctcccggccttcccttctgtcccagaggg

SEQ ID NO: 3985 - DNA, 186 bp, Homo sapiens
ctttgaaggtggataagacttcagaagaggaaaggccagactttgcttaccatcagcatctcaaatgggccaaacacacctcaaattggctgagttgagaaagcagccccagtggttccattcttgccagcactttctgcattccaaccagcatcctacctgggttttatccacaaaggtagcgcc

SEQ ID NO: 3986 - DNA, 153 bp, Homo sapiens
gtaatcctggggaacctggcttgagagggcctcagggagtcggggccttcctgggagtggaaggaccaagaggaccacctggaccccggggtgtgcaggaggacaggtgccaccgcctccctggtgtccaggccctccgggtagagcacgaca

SEQ ID NO: 3987 - DNA, 163 bp, Homo sapiens
attttgcaacaataggtgggaaatatatataaaggagttatttttctgtccagcaatatcgggcagtggactttgccagaattcagtacttcagataactgaggataatcattcttaggagccacttaagaattgtgaaggagtgtttgctgggatcactcta

SEQ ID NO: 3988 - DNA, 189 bp, Homo sapiens
agatagaggtagagagagtaatgctgcagttttgacttaggtaactcagttaggggctgaagcatgaacctgtggtagggagatggtggttaacaaccgtggacttctggataaaccctgtatgcgttcaaattctggttctaccattctgtctatatgactgaatgaattatctactcactctaacct

SEQ ID NO: 3989 - DNA, 191 bp, Homo sapiens
ctacttgggggaacaagatcggcaggccccacactgtcccttgcaaggtgacaggccgtgcgcttctgtgctggtacggctcatccttgcacccaggggcactggcatcgtgttccgcacctgtgcctaagaagctgctcatgatggctggtatcggtgactgttacacctcatgcccgggctgactgcca

SEQ ID NO: 3990 - DNA, 204 bp, Homo sapiens
gaggaagtggatgagctgtacagagaagcacctattgacaaaaaggggaatttcaattacatcgagttcacacgcatcctgaaacatggagccaaagacaaagatgactgaaagagctttagctaaaatctcccagttacattgtctcactctcttttacttctcagacacttccccaccctaatagaacctgttgcatgcact

SEQ ID NO: 3991 - DNA, 155 bp, Homo sapiens
ctgagcccaggctgctatgacacctacaatgcggacatcgactgccagtggagtcgacataaccgaacgtgcagcctgggaactacatactcaaggtgcacgtgaacccaaagtatattgttttggagtctgacttcaccaacaacgtggtgaga

SEQ ID NO: 3992 - DNA, 200 bp, Homo sapiens
gtggattgttcatcaattggcggggttccatttttccagcataaaaaatcacatgggaaaggacaaagaaaacagaggcattaacacactggagaggtttaagtggaagatactacagagcacttggttacaagagcaggttacctctgacgggcccgatcaacctttaattcacttgggggttggcaattttattttta

SEQ ID NO: 3993 - DNA, 175 bp, Homo sapiens
tgacggcccggcgacgcgacgtctctttttgactaaaagacagtgtccagtgctccagcctaggagtctacggggaccgctcccgcgccgccaccatgccaacttctctggaactggaaatatccgtcggaaactcgaggattgctcaagtctggcggtgaatttattctaggag

SEQ ID NO: 3994 - DNA, 205 bp, Homo sapiens
aaaaaacgggagctatttcacagagctgagcttctgccaaatttcattcctcaaacctttcaggaggggtggttggcgtttctaaaatgtttatgggatttgagttgcaggtgtccccttaactgactagctttgataaccaatgtcagattttcactatgaacacgacattcccttgtgcatttttatattgagtcctattttt

SEQ ID NO: 3995 - DNA, 250 bp, Homo sapiens
ctctgccaaggaaataatatggaccatttacctggcaggcagtctgctctctctcaggatcaccacgcatctcaggattggtctaaacttcaagtctcaaccaagtgtctaaggtgaactttgcattgaataaatttttgccatggaaagcacatcacacaggccactcatctctacagagataagagaacaggtttggcagacaagagacagagcccgtggagattcagagggggcacagtcagtttag

SEQ ID NO: 3996 - DNA, 270 bp, Homo sapiens
gtccaccagccccatcacagtctgtcatggctccggtatctcctgtggcaatgcacaaagtgatgcagctcacaatgctttgcagtatttaaagataatagcagaaggaagtaaatctggagcaacttaaaaaatctttcagtagcacataaaaagttcccctctggccccttycccaagtaaaacttttaccctagtgtttatgtctgtttctaaatctctcatagattccctccacactccagatttaattatctcccatagttgtat

SEQ ID NO: 3997 - DNA, 215 bp, Homo sapiens
gtgggtcctgctggtcctaggggccctgctggtccttctggccctgctggaaaagatggtcgcactggacatcctggtacagttggacctcctggcattcgaggccctcagggtcaccaaggcccttctggcccccttggtcccctggcccttctggacctccaggtataagcggttgtggttattatttggttacgatggagattttcacaggt

SEQ ID NO: 3998 - DNA, 190 bp, Homo sapiens
gtcggtctgggtgttaagtgctccaaggaggtggccaccgccatccgtggggccatcatcctggccaagctctccatcgtccccgtgcgcagaggctactgggggacaacattcgcaagccccacactttcccttgcaaggtgacaagctgctgcggtttgttgctggtgcgcttcttccttcaaccggg

SEQ ID NO: 3999 - DNA, 185 bp, Homo sapiens
cgactcctctcagatctatgcacacttgaggaaatctcggtgggcagcgacctgccagggtctgtccctaaggaggtggtccgctgacctctcaaggggtgggggtggggtcagagcttacaggtttctgtcttcttgtgcttttagatgcagtttctctcccctacccaggatcacccgcccct

SEQ ID NO: 4000 - DNA, 114 bp, Homo sapiens
agtatgccaggtacctgcctcacagtgcagggcggtatgcgcaaaaccgcttccgcaaagcttaagtgtccaattgtggagcgccttcactacctccatgattgattgacacgc

SEQ ID NO: 4001 - DNA, 119 bp, Homo sapiens
cgagaatgaagactattctcagcatcagactggtcgacattccagaaaatgtcggccattattctgaaggggacggacagtgatccgtgaggggcccagaggaaccctgcggagggact

SEQ ID NO: 4002 - DNA, 194 bp, Homo sapiens
ggactccccaatgctgctggctgacctgcctgacctccaggacccctgaaggcccccaagcctgtgccttgctgccacagaagacctagttccaggatccatggaagcattctaaagggcttaggcctggaccagaaggtaaggctcgcttggataattctgaaggttaatctaagaccacctttaagcctaag

SEQ ID NO: 4003 - DNA, 175 bp, Homo sapiens
gccaggcgcgcagtggctcacgtctgaatcccagcactttgggaggctgaggtgggcggatcatgaggtcaagagattgagaccatcctggttaacatggtgaaactccgtctctactaaaaatacgaaaaattaggtgggcgtggtaacctgtgccttagtctcagctactcgg

SEQ ID NO: 4004 - DNA, 210 bp, Homo sapiens
gagatgactttcaggttgcagccagaaggggttttttaaatgacttctactggatttcaggtttcttgactgttgaaaaaaggaacaaagcgttactgaaaagaagggtaacctttgttggatgtgggacttagactacaggtacagactactactctatgttctccagaagggtgctaagtcacctactgagagagaaccaactgactt

SEQ ID NO: 4005 - DNA, 282 bp, Homo sapiens
gggcggcggcgttggcggcttgtgcagcaattgccaagatcaaggctcgagatcttctgcgggaagaagaaggaggagctgctgaaacagctggacgacctgaaggtggagctgtcccagctgcgcgtgcgccaaagtgacaggcggtgcggcctccaagctctctaagatccgagtcgtccggaaatccattgcccgtgttctcacagtgattaaccagactcagaagaaacctcaggaaattctacaagggcagaagtacagccctggacctccgcctaa

SEQ ID NO: 4006 - DNA, 259 bp, Homo sapiens
gtttttgcatattttcttaggtcacagtgacaggtttctgagttgtttcccttttcaagtctctgggaggccagtgcagcagcaggtctgtgtttcaccttcttcccatgtgagcttggaaaactttggcatcttaattagtcttgaatcatacacctgatccccaaacattgcctgctctcaatgaaacatgctttggagatggagggactcagaaagtcgaaatcccaggaactccacgccaaaagtgttaggtttt

SEQ ID NO: 4007 - DNA, 312 bp, Homo sapiens
cccaggggtggcaggaattcctggagtgcctggacccccgggacctcctgggcttcccggtttctgtgagccagcctcctgcaccatgcaggctggtcagcgagcatttaacaaagggcctgaccttgaaaggcttactgctgcatggctgtctgcatgaaccacgcctggtgaaggagcctgggtgagaaacacatccaaagctggggcaaagatgattaccttcagcatgattacaatgtattaccttcagtatgattacagaggtcctacttgacaatcacatatagaggacggtgctattcagtaggt

SEQ ID NO: 4008 - DNA, 286 bp, Homo sapiens
gagaaagtatgtgcttaaatgatgaacactctcttaggtagtctatggaaagaatgattgtttcaggaacaaccatcctcctagtttaagagtataaaaagaacgcctacattttaaatgttttcccttatactcattattggcacactttactcaggacttagtagtcagttttaccatgtattctaacttcaccttcacctttgtactctaaaatttccttgcattaggatcagtttagaggtatcctcttatctcaaagtcaattctacacctatgttttcag

SEQ ID NO: 4009 - DNA, 425 bp, Homo sapiens
gagaaagtatgtgcttaaatgatgaacactctcttaggtagtctatggaaagaatgattgtttcaggaacaaccatcctcctagtttaagagtataaaaagaacgcctacattttaaatgttttcccttatactcattattggcacactttactcaggacttagtagtcagttttaccatgtattctaacttcaccttcacctttgtactctaaaatttccttgcattaggatcaagtttagaggtatccttttatctcaaagtcaattctaccaactatgttttcagagagaaatgttatcataagcctgaaatcttatgccagataattagaggggctcttaatgctgttttctttttccagcaaagtactttaaataaatgcttcataaaagtagttcttatgtaaaaaaaaaaaaaaaaaa

SEQ ID NO: 4010 - DNA, 265 bp, Homo sapiens
gaaaaacaagacataaaagataattcacaccagaggttttcaaactgtatcccaggctctatggccaacaaggtcaaaataacttccattataattcctgtggggtggttcatcttttcactctcatttcctcacgagcttgcagcaggctctccatgaacttggtgccttgacacggcacctgcaccatgatggctagtgtgtgttggtgctttcacagctctctgtttaacattccaacatggtaagtagctggagatagatt

SEQ ID NO: 4011 - DNA, 648 bp, Homo sapiens
gaaaaacaagaaataaaagataattcacaccagaggttttcaaactgtatcccaggctctatggccaacaaggtcaaaataacttccattataattcctgtggggtggttcatcttttcactctcatttcctcacgagcttgcagcaggctctccatgaacttggtgccttgaaacggcacctgcaccatgatggctagtgtgtgttggtgctttcaaagctctctgtttaaaattccaacatggtaagtagctggagatagaatttatccacagacactctttgaaatcctcaactttttaaaagtatgaagagatcatcataacaaaaagtttgaaaactgctggcttatattttgattgaacacaggagtaacatttatgagatagaaaagataaggtgggaaatgaaattgtgggaaagtcaagagttccaagagttctgccaaatatcatgaagcaaaaacattatgtaatatattctgaatggaccttagacaagttgtgtgttggatattaggttttactgtccttattaatgtagccaatacaaacccatctacctggagcaaagatatagtgggtcccagccaaaatatagtcagcactgctaaatatgtcagacatatgctggtttctagggacaaaa

SEQ ID NO: 4012 - DNA, 281 bp, Homo sapiens
tcggtccttccgaggaagctaaggctgcgttggggtgaggccctcacttcatccggcgactagcaccgcgtcccggcagcgcagccctacactcgcccgcgccatggcctctgtctccgagctcgcctgcatctactcggccctcattctgcacgacgatgaggtgacagtcacggaggataagatcaatgccctcattaaagcagccggtgtaaatattgagcctttttggcctcgcttgtttgcaaaggccctggcaacgtcacattggagcctcatct

SEQ ID NO: 4013 - DNA, 306 bp, Homo sapiens
cggcacgaggaagaagggacgacctggaggacacaggctcatgtgtgggtcttcatcctgcctgaccggcagatcttcctctacaccttgggcaaagtctatgcgaagatggtttcttagctctccatttgccatgattttcctcccattcatcatgagggagtttctcaaaccaggagtttatatttatcttctagagaatacacacttttcaggagacacctgagcatgattttggattctcacctcccccagtctctgcacctgggattcagctcaaggattcagtgtcttcattttacaaag

SEQ ID NO: 4014 - DNA, 185 bp, Homo sapiens
ggtgaaacccatctctactaaaaacacaaaaaaattagctgggcatagtggtgcctgcctgtaatccagctacttcggaggcggaggcaagggaatcgcttgaatccaggaggcagaagttgcagtgagccgagatcaggccactgcactgcagccctggaagacagagcaagactccatctcaa

SEQ ID NO: 4015 - DNA, 118 bp, Homo sapiens
tttaaatttaaaatccctaaaaaccgtttattataaacgcgagtttcgcgtaacgatggggttatcggtaggattttcggtagcgagcgcgggaaaagggtttaaaatttttccggat

SEQ ID NO: 4016 - DNA, 290 bp, Homo sapiens
tacatgggttcaacttcctccctggccaatttttagctgaattaccttgaacctcaattccctcatctaaattgggataataatttgtatcatataggagtgacatgaagatgcatgggagatgaaatgaaaattaaagcagatccagagatagaatagccacacatgatgatgatgataaaggctattattatgaactatgtgacaggcactccatcaagggctacacatacacatttggatctctcaacacccccattaagtggcgtttactatcccagacttacaca

SEQ ID NO: 4017 - DNA, 510 bp, Homo sapiens
tacatgggttcaacttcctccctggccaatttttagctgaattaccttgaacctcaattccctcatctaaattgggataataatttgtatcatataggagtgacatgaagatgcatgggagatgaaatgaaaattaaagcagatccagagatagaatagccaaacatgatgatgatgataaaggctattattatgaactatgtgacaggcactgcatcaagggctacacatacacatttaaatctctcaacaaccccattaagtagcttttactatcccaaacttacacaaggcaaataacattcaaggacattttaaaaaactagtcaaggtatcaccattattagttgaccatatgggattattgaacccatgcctttgtgataccaaaagttgagcttcttattaccatacttatacaaaacctcaggtgcagtatctgggatagaatatatactcagcaaaagtagactagttctgtgtaagtgtatgcgtatgtattttactaga

SEQ ID NO: 4018 - DNA, 192 bp, Homo sapiens
ccttcagctcctcttattggtctattcagagattcacactctctctcctggtttagtcttgggagagtgtatgtgttgaggaatgtatccacttctctctagattttctagtttatttgcgtagaggtgtttgtagtattctctgatggtagtctgtatgtctgtgggatcggtggtgatatccccctatca

SEQ ID NO: 4019 - DNA, 247 bp, Homo sapiens
ggaacgtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaggagggtgct

SEQ ID NO: 4020 - DNA, 265 bp, Homo sapiens
caagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaggcagctggctagtggcttatttacttgtgactggacctctggcctcaaatcgagttcctctacg

SEQ ID NO: 4021 - DNA, 122 bp, Homo sapiens
atcagcaaaattagcacttctgggtcagctgacaaacaggcagacagccttactccactagagagacagacaactttgtcatcgagttaggttctatttctttcaagtgctatttagagtca

SEQ ID NO: 4022 - DNA, 370 bp, Homo sapiens
tagaaaatcagcaaaattagcacttctgggtcagctgaaaaacaggcagacagccttactccactagagagaaagaaaactttgtcatcgagttaggttctatttcttttaagtgctatttagagtcacacaaaggaaatacaaagccaaacaaacacataagtatattttgaggtgatgcgactccgatgacaggacctgtacttctgaagggcaggctctgcacatctggggagcccctgctgcaatattaggcagtgaggctggggctccaagactccagctacgggaggggctgctgagtgtgggcttcctttagggaacagtgagtggctttcaatcaaggtatgggattttatgagtcgctgga

SEQ ID NO: 4023 - DNA, 187 bp, Homo sapiens
aaaaacctttgacctgattaacatttatagaacactcaacaactgtggaacacacctacacattcttttgaagttcacatggaggatctaccaaggtagaccatattttgggtacacagaaaaaggtctcagtacatattagaggatagagttatacaatggatgtcccaagactgcaatagattta

SEQ ID NO: 4024 - DNA, 460 bp, Homo sapiens
ctcgtgccgaattcggcacgagcaacttgacctgattgacatttatagaacactcaacaactgtggaacacacctacacattcttttgaagttcacatggaagatctaccaaggtagaccatattttgggtcaaagaaaaaggtctcagtacattttaaaggataaagttatacaatggatgttccaagactgcaatagaattaaattagaaatgaataacagaaaaatccttagaaaatcccaaaatatttaggaactaaatatcgtacttctagataactcatggatcaaagaagatattagaaagtagtttgaggctggacatagtggctcatgcctgtcatcttagcactttgggagactgaggcaggcaaatcacttgagctcaggagttggagaccagcctggccaatgtggcaaaaccctgtctctactaaaaatacaaaaaaaaaaaaaaaa

SEQ ID NO: 4025 - DNA, 244 bp, Homo sapiens
cggcacgagccggtttttggctctagactggtctcatctccattgccttaatgccaggtggcccaggagtacccatgcacagcagctgtggggtgtgggcatcttcaggtggtgttctggtaaaatcgttagaatagctgtatgaaggacaccagtgggaggaaatgaagttttcaggatggtggggatgtgatttagacagtccacatgctgttagggctctcactagggagtcgccttcatg

SEQ ID NO: 4026 - DNA, 224 bp, Homo sapiens
gatgcctggagttactgtaaaagacgtgaaccagcaggagttcgtcagagctctggcagccttcctcaaaaagtccgggaagctgaaagtcccccaatggtggataccgtcaagctggccaagcacaaagagctttctccctacgatgagaactggttctacacgagagctgcttccacagcgcggcacctgtacctccggggtggcgctggggttggctccat

SEQ ID NO: 4027 - DNA, 231 bp, Homo sapiens
ctccctgggctatgacctgcccatggtggaggaaggggacctgaccctgagttcgaggcaatctggacacgtgatccgaacagagattggccatgtcttccttgcaagaataaatggcttttaatgattcaagcccgcgaaacttaggaaccgtcaagttccaggcgaggagaattgggagcgcccttccgggccctcagctaaaaggggaaagaccttaggtgaacccag

SEQ ID NO: 4028 - DNA, 224 bp, Homo sapiens
aggcagtcatggatcaggtaatgcagtttgttgagccaagtcggcagtttgtaaaggactccattcggctggttaaaagatgcactaaacctgattagaaaaggaatttccagagggattgccaatggcaccagcattaaggattttgtctataatggggattcaattggccttctttgtgaaaattgatccatcatttccatttaataaaccaccaatgttgg

SEQ ID NO: 4029 - DNA, 144 bp, Homo sapiens
cacacctgtagtcctagctgcttgggaggctgaggcaggagaaattgcttgtaacccaggaggtggaggttgcagtgggccaggattcacaccactttcacttccaaccttggacaaaacagaggcgaggagcttccattcttc

SEQ ID NO: 4030 - DNA, 210 bp, Homo sapiens
ctgaggtgagttggggggtatctatattaggggtagggtattacagaagataattggcttgatgtcctagaagttctttgatcccagaaggtgggttccagctgaaaagtaaaccaagaattgggatttgccagtttacaatagtatttccctcccccagttccccttttttattttgcagaggctgttaagttttgtttaacaaattag

SEQ ID NO: 4031 - DNA, 231 bp, Homo sapiens
gagaaatgaccacaggatgagtcccagggcccactggacccactgtaagtcaacctgagctaaactcattaattaccttacctccatatgcctttactttaactggggggccaaaaattacattttgggtcccctggaattcaaagtcaaactcaaaagccaatttcaaaattcataattggcattaacataccttgtagttggcaaaaaccccccaattggttccctact

SEQ ID NO: 4032 - DNA, 265 bp, Homo sapiens
ggagttgaagccaaacagccaaattctgccattagggagtgtgtaagggtccagctgatcagatggcagaaatcacagcctttgtacccaatggacgggttgctttgaactttatttgagggaaatgatgaaggttcttggttgctggatttggtcgcaaaggtcaagctgttggtgatatcctggagtccgctttaaggttgtcaaagtagccaaatgtttctcttttggcccttacaaaggcaagaaggaaagcccaagatca

SEQ ID NO: 4033 - DNA, 203 bp, Homo sapiens
cagatgatgcagccaccaaaatcatcaattgaggtatcaaagcctctggcccaccacatcctgtggagagatctgtgagaagcttaagaaggagggccagccagatatgttgagcttaagtatgacaagcagatcgacctgagcacagtggaccctaaggagctccgagttaaagagctgaggagatctggatgacttggggg

SEQ ID NO: 4034 - DNA, 248 bp, Homo sapiens
gaacagctaaaagagcacacccgtctatatagcaaaatagtgggaagatttataggtagaggcgacaaacctaccgagcctgggtgataagcttggttgttccaagataagaatctttagtttcaacttttaaaattttgccccacaagaacccctcttaaaatccccctttgttaaaattttaacttttttaggtcccaaaggaggggaaccagcctcttttgggacaactagggaaaaaaacccty

SEQ ID NO: 4035 - DNA, 236 bp, Homo sapiens
aatttttgtattcttagtagagtcagggtttcaccatattggtcaggctggtctcgaactcctgacctcgtgatttgccctccttggcctcccaaaagtgctggggattacaaggcggtgagcaaggcaaatgccctggcccagtggatccttaatttgtagccttttgaagggatggccctgtgttagatcaatcattgagtgccacaaattgaaaggcttccacggtttaatgt

SEQ ID NO: 4036 - DNA, 185 bp, Homo sapiens
atgatgtgtaagtatgagatagatttgggactttaagctggggaaggacttcttaatatgatcacagagcactaccatagggggagaatggatagatttgtctacatcaaaatagaggatttctgttccacgaagctccccacagataaagtaacagacagatgggactgacttgagagggttgc

SEQ ID NO: 4037 - DNA, 272 bp, Homo sapiens
gccgtctctggagagcagcagccatggccctacggtaccctatggccgttggctcaacaggcacaagtgacagacgttagcaaggccaggcacagcgacggcgcgggctcttgaccaacacaacagttcgttcgggacattgatcggaaggtgtgttgcttttgcccgtacggcggcgcgccattgagttatcgtaggtcttcagggcaaacgggccttaattatctagggaaggtttggagcgaaatccggcaagggaacgcgagatctag

SEQ ID NO: 4038 - DNA, 157 bp, Homo sapiens
cagtaacggagcttaatcgtgacctttaaatttcaaacatgctcagattcttgaagtcagatgcctcatacttgcttgcttgctggtgtaatggacagggatcaggatatacttgactttgtcaaggtgccttgcttaaaggctaaaggttgcatag

SEQ ID NO: 4039 - DNA, 645 bp, Homo sapiens
cagtaacggagcttaatcgtgacctttaaatttcaaacatgctcagattcttgaagtcagatggcctcatactttgctttgctgctgtgtgatggaaagggatcaagtatacttgacttttgtaagtgactttctttaaagctaaaagttgcatagaacacatttgttgaaacaattagaaaactttatctgtaattctctttgcaaattacatgattctgcaagcctcattgttcccagtttctgaaatgggaataatcattcatcctgcatatctcttctatttattataaaagtgaagataacttaaaatattataaattaatgtgtaagtgtaagaaaatattaactgtggagtgctacactttctgaccttgtgaacgtttgattttctttaccggaaacactgaaatatactgaatatcaggtacctctccagagcatgcatgtggttctacagttgcttgcctaaaaatggtaaaggtcaactatccagaggggagaaatggagaggacagaaatgctgttaattaattagcataggaaacacatagagtcatagagttttctgtcagctgaggaagtgccttctctcctctttctcacacatgcatatatgctcacatatgcatcaatataaatcct

SEQ ID NO: 4040 - DNA, 202 bp, Homo sapiens
ccacctcgtgcctcaagatggcagtcaccttcatttggcaattagcacagccatccaggagctcttcaagcgcatctcgagcagttcaacttccatgtttccgccggaaggcctttcctcccacttggtacacaggcaagggcattgacggagatgggagttacacccgaggcttgagagcaacatgaccgacctggtctct

SEQ ID NO: 4041 - DNA, 308 bp, Homo sapiens
gaacgcctcggctgggaagtcagttcgttctctcctcttcctctcttcttgtttgaacatggtgcggactaagcagaaggtgttccaggcactttacagaaaagtggtggctgtctcgagcccccagaaagggtgcttggttctgccacctctgccactaattcgacatcagtttcatcgaggaaagctgaaaatgaatatgcaggagggacccccgtttgcgtgcgcccaactcccaagtggcaaaagggatttgagaattctttaggttgctccctaaagattctgaaaaagagaatcagattccg

SEQ ID NO: 4042 - DNA, 142 bp, Homo sapiens
agctcgtgccccttctgtgtgggctgcacatggtgacttccttcaagaagcacagatgtggagtaggcaagcgttccacagtgggagagcccaacccactgtctcagcccaaaggtcaagccttgacccataaccgagaggt

SEQ ID NO: 4043 - DNA, 164 bp, Homo sapiens
cttttcatccttctgtctctttgtttctgagctttcctgtctttccttttttcctgagagatacaaagcctccacgactcttgtttccccccgtccccttctgaattttaatttcgcactaagtacaatttgcactgggttgggagtttgtgggagacggccct

SEQ ID NO: 4044 - DNA, 270 bp, Homo sapiens
tgggactgagctgactgctgccacggcccaggctctggtcctaggggtcctttcagtctagaggttaggcagagcccaggttgggccagttccatgcgagtcccttcctgtggccccacagattcgtccagtccagccagttggccaatcatattcgccaccacgacaacatccgcccacacaagtgcagcgtgtccagcgaggccttcgtgacactggggccctgtccaagcacatcatcattcacactggagagagcttacctgtgtg

SEQ ID NO: 4045 - DNA, 267 bp, Homo sapiens
ctgaactggctccttccagtcaaggttatctggtttgattgtataatttgcaccagagtaaatgtttatgactctctgttcctgcctgaccaggcagagagtacacattgggttaattcaatttcagtcaagtcaattagatggcatccctacatcagggttgcccagatgggtgataacagtttagggccttgggctctagggcatccacgactgggacggcactactgatgtcctgtgatacatcaggttcagcacacacttaca

SEQ ID NO: 4046 - DNA, 183 bp, Homo sapiens
gttctgtttggagcccatttctgtgagacctgtatttcaaatttgcagctgaaaggtgctgtacctctgatttcaccagagttggagtctgctcaagggaccggttgtaatgtgtacaatctgtgtccatgtgtgaccatgtgtctgtgcaggcagggacatgtaatctctgcatgcatagta

SEQ ID NO: 4047 - DNA, 300 bp, Homo sapiens
ttataggtaagttcgctcgggtggactcctttttttttttttggctttraattraggattagtttatgctgtgagacagtccatgacccttttgtgggtttacaagtgggctgaacaagtcattggcaagaagctcagttttttgctttggctggggttcgggggcccaatccctttaaccccagcactttgagagggcaggggggatttctttagaatcagccttgccaacaaagcaaaaccccgttcttctaaaattacaaaattggccaagtgtggtggtgcgcccctataatccca

SEQ ID NO: 4048 - DNA, 230 bp, Homo sapiens
cttgggccacgcgtcagagtcggctgggccttggagggacggtgcccgcccttgtgagggcgttgcctctagggtcaagccaagcgcagagggccttaggtcaccccggtgagagagccacacgcggggtgtctcagagagcaaagcgccccttcccgaggctctgtgcgagccagttatgtcctctcacgggccacatgtgagctgcgttttagagcagtgtcacacac

SEQ ID NO: 4049 - DNA, 234 bp, Homo sapiens
cttggggccaccgcgtcagcagtcggcggggccgtgggagggacggtgcccgcccgctgtgaagggcggtggcccttctagggtcaggccaagcgcagaggcctgaaggtcaccgggtgaggagccagcgcgggtgcctcagaagccaagcgccccgtcccgagccctgcgcgaaccagtatgaccttccaggaaccagatgagaactgcgttttcaagaagcagtgccagaca

SEQ ID NO: 4050 - DNA, 308 bp, Homo sapiens
aagtttcctgaggcctccccagtcatgcctcctgtacagcctgcagaactgtgagttcattaaacctcttttcttcataaattacccagtctcaggtagatctttataacagtattgagaattggacggatacggggtacacatcaacataaaggtttgggaattcaattggcacttggggcttcccaaagggggaagggttgggagattgcaacggttaaaaacgtaccccattggtacactactcactacttttggggatggggacactagtagaacctcattccaccactattctatataccccy

SEQ ID NO: 4051 - DNA, 220 bp, Homo sapiens
caggagttgaccagcctgggcaacaatagtgagaccttgtccttattaaataaataataataggttgggcactgtggcgtcatattcttgtcacttcccacgcactttttcggggtttgccacgtgcacggggggggtttgctttgaggcccccgggagttttggagagccccagccttgggcagagattaggcacaggttcccaccttctaccaaatta

SEQ ID NO: 4052 - DNA, 209 bp, Homo sapiens
cctaccccatgttttcataatattcttctatggtttatacattatattttgattttgacatttaaatttccatctcatattaaagttttgtttaaagatgttgaggttaaggttcgagatacatacatagacatagcagttttattgtatatgaacacagcccctgacatatatcgctgaacctcaaaataaaaacttagagagataca

SEQ ID NO: 4053 - DNA, 210 bp, Homo sapiens
cctaccccatgttttcataatattcttctatggtttatacattatattttaatttttacatttaaatttccatctcatattaaattttgtttaagatgtgaggttaaggttgagatacatcatgacatgcagtttatgtatataacaaacctgcacatatatcgctgaacctaaaataaaacttaaagaaatacaaaaaaaaaaaaaaaa

SEQ ID NO: 4054 - DNA, 185 bp, Homo sapiens
gaaaataatcccacattgtgtatgcaccactcacctcaatcagcaacgatctaattgtcgcgaatgccaagcaagcaaactttttttacccttgggctgagtttggggcattcttcaatttccctcgtggccttacagggcccgttccgggccaggggagaggggggggatttagtttatgaggg

SEQ ID NO: 4055 - DNA, 249 bp, Homo sapiens
gaaaaaaataaatcccacatttgtgtatgcacccactcacccctccaaatcagcaaaaccgcatctaatttgtccgccgaatgccaaagcaaagcaaacttattataacccttggactgagtttagagacatttcttcaatttcccatcgtgcctttccagggaccagtgcagggacagggggagaaggggaggggttaagttaaataaagaagattatttttgtttcaaaaaaaaaaaaaaaaaaaaa

SEQ ID NO: 4056 - DNA, 195 bp, Homo sapiens
aggaactaactggtgtgagtcaaatgccccctgagtgactgccccccagcccaggacagagagctccttcaggtgcgggcgcaggaacttttgttgttttcctacaacaatggtgctattcttgtgttaaaacaacctctgtatttttttaaaacatcaattgatattaaagctgaaaaggttattgggaaggta

SEQ ID NO: 4057 - DNA, 239 bp, Homo sapiens
atactgccattcgtcaggacaccacccacccagtgttatattctgcctcgccgagtggtgttccggggcacttgccgaccagccccttgcggtcccaaggtttgcagctctccccttgggccattaaccaatcctggccccggggcttgcctgtctgaccttcgtggcctaggtcgggggctctccatcttgtctcctcccctgtggtccccaatgtcttcaaggggggggcccctctt

SEQ ID NO: 4058 - DNA, 292 bp, Homo sapiens
gaaagtcgggatcgtcggtaaatacgggacccgctatggggcctccctccggaaaatggtgagaaattgaatcagccagcacggccaagtacaacttgctcttttctgttggcaaaacccaagatgaaggagacgagctgtggggaatctggcactgtggttccggcataaagacagtggctggcggtgcctcgacgtacaataacacttcgctgtcacggtaaagtgcgccatcagagactgtaggggttgtaagaccactagacgctcctctactctttgagacatcact

SEQ ID NO: 4059 - DNA, 289 bp, Homo sapiens
cagaaaccgacaagggccaggcgcccggtggctccgaagcggggaagtgggacaagatggttacatctcgaacggacaagtgttggacagccggagttcagtctccatggagattatctttgataacagattttcttctggggaatagctgagtttgtggttttgtttttcaaaactctgcttcagcaagatgtgaaaaaccgaaggaggctatggagactcatctgattccagatattagtgatggaggaggggcaccacgagaccctcccccaggaatgggtaggad

SEQ ID NO: 4060 - DNA, 205 bp, Homo sapiens
cagctggtcactccccagagaagctgggccttcatggacacatggaactaagcctcccaaatggagttctggctgagccagggtgggggagatccttggaaggggaggcacttgagggaagacggcacctctttccccattggaagggttgttaaggagggcaggttttgaatttgtggcagtatttgcaatctaaagcaagggg

SEQ ID NO: 4061 - DNA, 201 bp, Homo sapiens
ctttactgggcactctgccaaataactggagtggcacttgtactttagtccaattggctatcctttcaccctggcatttcatcaaccagaagggaaaaaaagaagacaattttaaaagcggaggagaagcccccctatttggggtcttttcgagctctcaagtctattttagagtgcaatattgggggcccccgcaggggg

SEQ ID NO: 4062 - DNA, 177 bp, Homo sapiens
cctgccaggccttagacacagaggcccacctgcgagggggacagctgcggctggacctacctcatacagacaccctccttgtcttggatgaggggccacagagcaacttaaacacaatgtcagagggaggacaactctttgtggtttcccccacccccttgagtgttaaaataccca

SEQ ID NO: 4063 - DNA, 157 bp, Homo sapiens
gacaagctggcccaggttgggctggtgcagtactcaagctctgtgcgacaggagttccctggtcgctcacacacgaaggacatcaaggcggctgttcgggaatattttcctcacataggggaagggcacaaattactctgggcttccttcaaggacc

SEQ ID NO: 4064 - DNA, 192 bp, Homo sapiens
gattagttatgttaaacgctacttgcaagtcttgcttcttttggatatcaaaatgtatttgtgatgtactaagatacttggtcctgaaggctacccaaatattatagggtcaatttaggccaattcaatatctcttatatagtataaaacgatggccttggaaatgggctgaggaatttatgccattgtgat

SEQ ID NO: 4065 - DNA, 155 bp, Homo sapiens
acaagatgtgccctgatggagctgaagttgattcagattggcaccttttcttccccttcctcctggttcctttgttccttgaggtcacggaggaattccatttttttggtaagagacaaggttaaggttaaggaattgccttatatttttaaagg

SEQ ID NO: 4066 - DNA, 261 bp, Homo sapiens
tgaccgtgtgcttacacaaattggtacctcaattcaagactttattgaagcagaagatgacctttcatctttttagaggcagctgccatcacatcggacatattggaggcccttggaagagacggtcacttcacactctttgctcccaccacatgaggcttttgagaaacttccacgaggtgtcctagaaaggatcatgggagacacaagtggcttccgcagctcttatgaagtaccacatcttaaatactctccagtgtg

SEQ ID NO: 4067 - DNA, 380 bp, Homo sapiens
catttctatgtagatgagttggtatgagaatatatggatttttaagggactgtttaaatctttgatttgtagactattaaatataccgtatgcataaagtaagcctttagctctaaggtaaagacgacacgttttcggtttgtgactacaaataggttaacaatagattttcattttattaaaaatataattccatgcaggttgtttgaagcatctgtcttcatatgatggcattagaacaccttggtataataaaaagttaccgtaatttatgattatttgaatttatccattctgaaaattaataagatctaaaactggcatgacaatcaaggatttgtatttagtggaaatttaacattaaatgtaggccatagttt

SEQ ID NO: 4068 - DNA, 218 bp, Homo sapiens
ctcgtgccgaattcggcacgagggcagaggcaggaaactaactggtgtgagtcaaatgccccctgagtgactgcccccagcccaggccagaagacctcccttcaggtgccgggcgcaggaactgtgtgtgtcctacacattggtgctattctgtgtcaaacacctctgtattttttaaaacatcaattgatattaaaaatgaaagattattggaaagt

SEQ ID NO: 4069 - DNA, 338 bp, Homo sapiens
ggctcccaacactgccaacgtccagatgaccttcctacggctgctgttcacggaaggcttccagaacattacctaccactgcaagaacagcattgcctatctggacgaggcagcttggcaacctcaggagggccctgctcatccagggctccaatgacgtggagatccgggcagagggcattagcaggttcacgtacactgccctcaaggtatgtctgcacgaaccataccggtatgtggggcagtctgttatcgagtaccgttcacagagatctcacgtctcccatcattgacattacacctatggacataggaggccccgagcaggtattcgctgt

SEQ ID NO: 4070 - DNA, 320 bp, Homo sapiens
ttcccacaacacttttctcgggcctatccgggaatggcccgacgttactcggactaccccgatgcatacaccacatggaacatcctatcatctgcaggctcattcatttctctaccagcgtattattaataattttcatgatttagagaggcctccgcttcgaagcgaaaggtcctaatagtagaggacccctccataaaccctggagtgatctatatggatgcccccaaccctaccacacattcggagaccccgtatacataaactctagacacaagaggagggtctcgccccccacaaagctggtatcacgccacccc

SEQ ID NO: 4071 - DNA, 341 bp, Homo sapiens
gtttgtgagcctgtggsgcgggcttctgtgggccggaaccttaaagatagccgcaatggctgaaaatggtgataatgaaaagatggctgccctggaggccaaaatctgtcatcaaattgaggtattattttggccgacttcaatttgccacgggcacaaggtttctaaaggaccagataaaacctggatgaaggctggatacctctggagatatgataaaattcaccaggttgaaccgtctaacaccagactttaatgtaattgtggagcattggcaaatccagggcagatctcatggatatcagttaagataacctaaaatcagaggtctccaagcaaac

SEQ ID NO: 4072 - DNA, 341 bp, Homo sapiens
  misc_feature 317: n = A,T,C or G
tcacccccaccagccagagggaacagccagaggaaaagagagttgggtttaggtcgtaccaggggtttgtgcctcctcttgatacctgggcagccaacgcggtgagtttgtttttaagatgatgggaagggctccagcctgggccctggcctgccctaggtgcctttcccctcccgcccccaacatgccctgttggagttctgtttgtttcctgtgcacaggcggcatcacccccacccaagtccccagcgcagatggcagcagccccacctcagagactgcacaagagagagactcctggccccatgttcccttcnctccagccctatgtggtgtctgca

SEQ ID NO: 4073 - DNA, 216 bp, Homo sapiens
gatcatctctccttggggtttttctttaaaaaggggaatctgctataaaggttctgttgcttcaaaccaatgtcaaatagacttgaatttttagagtcaattggattaccaagtccaaccttgaatttttattccccctacttgctaattaggtgtggcaggccttggttaaaattgtatacctccggtttaacttgtgtggtagagtgaatggct

SEQ ID NO: 4074 - DNA, 106 bp, Homo sapiens
tctagagtgcagtggctacagcctcgaacttctgggctcaagagatccttcccatctccacctccaagtagctgcgaactacaggtgcaactgtttctccaatggg

SEQ ID NO: 4075 - DNA, 130 bp, Homo sapiens
ttagaagccatcagaggtgcaagggcttagaaaagaccctggccagaacctgacttcactcttaaaccttggtcttcttccttggcggtgctgttagcagcacagacccatgagcattcccaacccacaa

SEQ ID NO: 4076 - DNA, 118 bp, Homo sapiens
agaaaacgaagagaaagaaattttgaaaaacaaaaggagaggaagaagaagaggcagcaggctaggaagactgcatcagttcttagttaaagatgatgtgggcacctcttcagtgggt

SEQ ID NO: 4077 - DNA, 217 bp, Homo sapiens
gacagactttctaatgaacccaatggttatgatgatgggtcttcctttattgatatttgtgcttctgcctaaagtggtcaacacaagtcatcctgacatgagacgggaaattgagcagtcaatgaatattctgaattccaccatagagttgcctgatgtttctgagttcatgacaagactctttctcttcaaaatcatcttgcaaatctagcagcgs

SEQ ID NO: 4078 - DNA, 228 bp, Homo sapiens
ctgacctgacctgatgtccattcatcccaccctctcacagttcggacttttctcccctctctttctaagagacctgaactgggcagactgcaaaataaaatctcgggtggttctatttatttattgtcttccccgtaagaccttcgggtcaaggcagaggcaggaaactaacttgtgtaagtcaaatggcccctgagtgaacttccccagcccaggttagaagagctc

SEQ ID NO: 4079 - DNA, 219 bp, Homo sapiens
aaaaagaaggattgatcagagcattgtgcaatacagtttcattaactccttccctcgctcccccaaaaatttgaattttttttttcaacactcttacacctgttattgggaaatgtcaacctttgtaagagaaccacaaataaaaattgaaaaataaaaaccataaacatttgcaccacttgttgcgttttgaatatctttccacagagggggagggtt

SEQ ID NO: 4080 - DNA, 165 bp, Homo sapiens
ctgtggcggacgttgccatcctgcccgcactgaagcagaccccgaagaacaactttgccgagaggaagaaagaggcttcaggcaatgcagaaacggcgcctgcatcgctcagtgctttgagccaccccaatctggtcagtgccaggcccaccaacctgcagctgg

SEQ ID NO: 4081 - DNA, 116 bp, Homo sapiens
cagagatccattgccatcagtgatctcactaaaaatatacagctacttcccagctaatctccacccaatgaatgatgatggtatagtatgtgcataatggaaagttaccttactga

SEQ ID NO: 4082 - DNA, 116 bp, Homo sapiens; identical to SEQ ID NO: 4081

SEQ ID NO: 4083 - DNA, 149 bp, Homo sapiens
aggtgacaaaggagaggctggagagcctggcgagagaggcctgaagggacaccgtggcttcactggtctgcagggtctgcccaggccctcctggtccttctggagaccaaggtgcttctagtcccgctggttcctcttgccctagaggt

SEQ ID NO: 4084 - DNA, 108 bp, Homo sapiens
ctcgtgccgaattcggcacgagctttcatcgagttgaacaggacttaaacgaatcatcaggggcccgatatttcttatttctcacacgggatttttaacctttaatca

SEQ ID NO: 4085 - DNA, 200 bp, Homo sapiens
cactcacaacaaaactaactaatactaacatctcagacgctcaggaaatggaaaccgtctgaactatcctgcccgccatcatcctagtcctcatcgccctcccatccctacggatcctttacataacagacgaggtcaacgatccctcccttaccatcaaatcaatttggccaccattggtactttaacctacgagtaca

SEQ ID NO: 4086 - DNA, 185 bp, Homo sapiens
gtgaatctttcattatctttaatgaagacaaaggaatctagtgtaaaaaacaacagcaaacaaaagggtgaagtctaaatgaagtgcacagccaaggtcatgtttaccaggggctttaggggcgtttgaggaggttactcatcttttttggattccgacctagggtccggcatttaggcccagtt

SEQ ID NO: 4087 - DNA, 133 bp, Homo sapiens
taaatcctggataagaagtgactgctgtggtctggctgcatggtcctgaggacctgaaccagggtcaaggggcattgggagggaagagcctacacaagtgtaattggctaaacctggggacaattttgaatgt

SEQ ID NO: 4088 - DNA, 100 bp, Homo sapiens
gcgaggaagggacccctctctcatggttgtctctttccccgctatgtcataggtagtggaggaagccaaggaagttaaccctgaatttcacgcatttctt

SEQ ID NO: 4089 - DNA, 136 bp, Homo sapiens
ctcaggtggtggatccaaaacttaaccacatcttcaggccacaaatagaacgggcaatttatgaggttcctggcgggcccaaaaaaaagcagcttttccagcacccccttccagaggcccgaagggcaaggaccct

SEQ ID NO: 4090 - DNA, 105 bp, Homo sapiens
cgcaggcttaagcgcaaaagaagaaagatgaggcagaggtccaagtaaaccccttagcttttttgcaccctggaggccacaaggggcagaaacattggatttcca

SEQ ID NO: 4091 - DNA, 118 bp, Homo sapiens
ctcgttccgaattcggcacgagaattttattaagggtccagtgaaaaaagacctgtttcaggggctttacgtacttacttgatttgcacccagcattaatcttctggtgtggtatgag

SEQ ID NO: 4092 - DNA, 124 bp, Homo sapiens
cagccttcctgggatacaaggctggcatgactcacatcgtgccgggaaggtcgacaggccgggatccaaggtgaccaaggagggaggtggtggagccttttaccattttggagacaccccccat

SEQ ID NO: 4093 - DNA, 182 bp, Homo sapiens
atccagtgggtgtccgacttcagcgagaggatcaaacagctgcagaacatctcactggcagctgcatctggtggcgccaaggagctaaagaacatccacgtgtgcctgggtggcctgttcgtgcctaaggggtacatcactgccaccaggaagtatgtggcccaggccaacagctggtccct

SEQ ID NO: 4094 - DNA, 158 bp, Homo sapiens
ggcacgagaatcaacatggcagacggtacagaaaagccacggaagggtgggagtctttggctataaaatcaagagggggcctccactgccctgtcctgtttacaaatttttctaataatgttgtctttaaccaggaaattttcatcaaaaccagctgt

SEQ ID NO: 4095 - DNA, 221 bp, Homo sapiens
tgaggctgccaaggaagctctggaggcattggttcctgtcaccattgaagtagaggtgccctttgaccttcaccgttacgtttattgggcagaaaggaagttggatccgcaagatgatggatgagttttaggttaacatacatgtccggcaccttagctgcagtttaacataattggcattaaggggccttggtgcaattttgggcccggccmagggtggc

SEQ ID NO: 4096 - DNA, 221 bp, Homo sapiens
cggcacgagtttctagcaaatgagtgacacttggtaaatgttggttgatagaatgaatgatcatctacattttatgaaatggatgaaaaaataggctagttcatccatagtagacatcagattatagtatagttcttgctgattctaaaatcaaagatctttttattttgctgcatctgggatttccaggaaaatcaattttaagggactttatttcccaa

SEQ ID NO: 4097 - DNA, 154 bp, Homo sapiens
gttacaatgttacttcagcccacagtttatttctatacttgagttcttaagtacagaagatagaagtgatttaaatggcatagtatatatatcattttctggcccttttaaaatttatttgagacctcttgatgaaatggacaaaatatatatt

SEQ ID NO: 4098 - DNA, 300 bp, Homo sapiens
gtttacaatactgcttctgtaattccagctctcctgccacagctcctcaccccctgacaatgttcgcctgctccaaggtttgtctccactcccctccttgctagggtcaagagcacctcacagctgctgagccgtccgctatctgcagtggtgctgaaacgacccgagatacttacagatgagagcctctaacagctttgcaatgtctaagtgccctttactaattgtgtctagggccgagttcccaaaccgagcgctattttgggggaaatcgacacaagagccaagtttatggggagc

SEQ ID NO: 4099 - DNA, 305 bp, Homo sapiens
aggtcgacactagtggatccaaagaattcggcacggccgctgggcgggcctacctcgacagggctttcccatcatctttcacggcgtaattggcaaaatagagccttaaggcaacagcccatcttcttcaacccttaagagggttccacagttacttcctacccttaaggtgcttccctggcccttcttcaagagaggggaaagcccccttagaccctgcaaggttggggtgaagttccctttcccgaacacaggtgagagaattccctttattattacaccatattagacagggagtttcgagg

SEQ ID NO: 4100 - DNA, 299 bp, Homo sapiens
atgttctaacctttacatgaggactctattctttaactcccattaccatgtaatggcagttatattttgcagttcccacattaaaggaggcctaggatgtattccccaaaagcggtagcttaaaaatacaaggcttccatatttaaattttttggtggcaattaggtctacagtaaggcctataaaaaatgctgggctatagatgtcttttcccatatatctaaatatggactgctcaggaaccgagactttccattacaggtatttttaattaattgggccagcttttcaaacaaaga

SEQ ID NO: 4101 - DNA, 288 bp, Homo sapiens
cggcggcgttggcggcttgtgcagcaatggccaagatcaaggctcgagatcttcgcgggaagaagaaggaggaccttctgaaacaacttgacgaccttaaggttggactttcccaacttcccgttgccaaaagtacaaggcggttccggcctccaagttttttaagaccagagtcgtccggaaatccattgccctgttttctcaagtattaaccagactcagagagaaacctcaggaaattctacaagggcaagagtacaagccctggactccggcctaagagacacg

SEQ ID NO: 4102 - DNA, 291 bp, Homo sapiens
ctcgtgccgaattcggcacgaggcaagatgaagtagagcagaagaagaagcggaccttccgccaagttcacctaccgcggcgtggacctgaccagcttctggacaatgtactacggacaacttatgcaactttacaattcgcgcgcaaggcggccggcttaaacccggggcttcgccgaagagagaatctccctctctaaaggcccctccaaaggccaaagaaggaggcccccccatggagaagccgaagtggtaagacgaccttcgaccattatatcctacccagatgtt

SEQ ID NO: 4103 - DNA, 296 bp, Homo sapiens
  misc_feature 250: n = A,T,C or G
ctcgtgccgaattcggcacgagcttccctcctcctggagcctccagcccctcacactgctgttcccagtgatatttgggatctgacttaagccagaggctctgtaaatcagaccatagttgaagttctcagaccccttggccctttcgcgactctttctctcccccagtttccaaagagagcaatttaaacacagagaggggaatatagacacagggcacagtggacagtagctgacggtagagacagangtacagtttgggttcccttcctggttcccttacagtcttgggttgt

SEQ ID NO: 4104 - DNA, 168 bp, Homo sapiens
tttgctgtaaagtgcaaggaaattttaaattctgggacactgagttagatggtaaatactgacttacggaagttgaattgggtgaggcgggcaaatcaactgaggtcagcagttttagactaggcctgcaaacaatattggaaccctttctttctcttaaaatacaca

SEQ ID NO: 4105 - DNA, 296 bp, Homo sapiens
tgtcatcaggaagttatgacaaagcacttcgcttcctgggatcaaatgatgaggagatgtcctatgacaataatccttttatcaaaacactgttatgatgggtgtgcgtccaggaaaggctattaaaaggccttccattaaatccattcacaccaaaatttgagcaggtaccctatgttggagtgtcatgatcaatgactttgggtgatcagagtcagaggttcggatttgatgttgggccctgtttgttttctgggctaagattaagacagagcacatatcagctccaccagaga

SEQ ID NO: 4106 - DNA, 255 bp, Homo sapiens
tagcagtaggaggactaggctccattataagagttcttacagcaagaaagactgtttaaaaaaaataaaaagactcatgttaccttgagaagaattctgtgatgcccaggcttgtgaagagagggatttacaatggacccacttctctaggactcccaagtaaaacctatttacagagacagtatatttcgtgaaattgtaatttaatttccacgggtggggggaaattcgttcttgtcccaaatcactctttaa

SEQ ID NO: 4107 - DNA, 127 bp, Homo sapiens
agaaaatcggcattttcccacctgcaatttctatctccagcatccccctgctgccttcttccgtccgcagtgcggccttctaggtgcttccattccacccctcttttccacagcggggacccgaaat

SEQ ID NO: 4108 - DNA, 112 bp, Homo sapiens
ctcgtgccgaattcggcacgagttataacaggtttattgcagtttcctgttctgtgggaaagtgtaaagcattccaacaaagggttttagtctagatttttttttttggaag

SEQ ID NO: 4109 - DNA, 185 bp, Homo sapiens
gccgaaatgggcaagttcatgaaacctgggaaggtggtgcttgttactcggcctggacgctactccggacgcaaagctgttcatcgtgaggaccattgatgatggcacctaagatcgcccctacagccatgctctggtggctggatttgaccgctacccccgcaaagtgacacttgccatgggca

SEQ ID NO: 4110 - DNA, 107 bp, Homo sapiens
ggtatttckgtgggacgggtggtaaaagcatgtttctacactttggacacattcagggtcttgggatttggcagaacaagtttggatttttaggacctagagcacga

SEQ ID NO: 4111 - DNA, 114 bp, Homo sapiens
ctggacttgtcttggttacagaacctcacgaccccgcgacgcgacgtctctttttgactaaaagacagtgtccagtgctccagcctaggagtctacgggaaccgcctccggggg

SEQ ID NO: 4112 - DNA, 134 bp, Homo sapiens
cttgggtttgcatgtttacagacttcccctggggcgaggggtcagagctggctcttggggagctggactaggaagaggaggtccagcccagactctttcctagccttctctaaaccaaggtcctttgccatcct

SEQ ID NO: 4113 - DNA, 125 bp, Homo sapiens
caaatggagggaagttttctgggtggggaaggactgtttggcatttaggggaatcacattggctattccaactaatgaattcacacttattaccggggatgtgcttacagggatcacacttaaat

SEQ ID NO: 4114 - DNA, 293 bp, Homo sapiens
ctcgtgccgaattcggcacgagcagccttctctcccccataaggactggctgtaaccttaagcccatcaaagttacttccagcctggagagaacctcaccaaacagcttgtgtggccttagggtggccatggtgggaaatgggcattagaataaatacctccccaaattcaatctgagcccagcaggagaggatggtagggttgccagggctcagaagtgcaagctgattactcaccccaccctgtctctgcgcaactcttctctgtttcccttggtgaatgcagggagagtc

SEQ ID NO: 4115 - DNA, 301 bp, Homo sapiens
ctctggtcctcaatcgagttcctctacgaagaacacaccagaaatttgtcattgccacttcaaccaaaatcgatatcagcaatgtaaaaatcccaaaacatcttactgatgcttacttcaagaaggagaagctgcggaagcccagacacacagagaaggtgagatcttcgacacagaaaaagagaaatatgagattacgcgagcagcgcaagattgatcagagagctgtgggactcacacattttaccacaaatcacagctatttctcagctccacggctacctccgatctgtgtgtgctc

SEQ ID NO: 4116 - DNA, 306 bp, Homo sapiens
ctcgtgccgaattcggcacgagcagtcacgcaccacaacccccagctacttttttttttattttgtattttttctagagactgggtctcactcttttacccagacttgtctcaaactcctggacttaagcaatctgcacacctgggcctcccaaagtgcttggattacaggcatgagtcacacctctatcaatttagtgttttaaaagcatatctttgagccaagcgcggtgtgctctcgactctgtgtgcccgcactctttggaggccacgagcgcgcagatgatcgacgctcatcgaggttctt

SEQ ID NO: 4117 - DNA, 311 bp, Homo sapiens
gccgtgttaggaggggtcggggagaaatcaggctctcgaagctcataaaattcaacgtgaggaagcaagtgacaaggacgcccgaagcacagttgacggtcattaaggagccggggttttgcaagcgggttacgtccaggagagaggagcgcccccttgctttcccctctggccgccgcacttgacgcgcggggccttttccagacgagcacactcatatcggctctcgcgtctacagagtatctctcaaaggggcctatctcttatacctctatgcccagcagttttagagaagagaggagggtgtagta

SEQ ID NO: 4118 - DNA, 253 bp, Homo sapiens
actggcaggcctcggcctaaaggtctggagggtgagcgacctgcgagactcacaagaggggaagctgacagagatacctacagacggagtgctgtgccaaccttgtgcccgacaaggaagccgaggcttgggctgggtcagcaaccgaattccagtttagagagcgcgattttgtcgtggacgtgtgtcagacgacactcagatataaaatttgagagagatctcttgcacattgatatactctcacacccac

SEQ ID NO: 4119 - DNA, 246 bp, Homo sapiens
ggacggccttggagagtactcgggttcgtgaacttcccggaggcgcaatgagctgcattaacctgcccactgtgctgcctggctcccccagcaagacccgggggcagatccaggtgattctcgggccgatgttcttagggaaaagcacaaagttgatgagacgcgtccctcgctttcagattgctcagatacacaagccctctgtgatacacatgtatccaaagagactctgctatcagaagcaga

SEQ ID NO: 4120 - DNA, 224 bp, Homo sapiens
aaagaatgccaaaatcagcagtctcctggaggagcagttccagcagggcaagcttcttgcgtgcatcgcttcaaggccgggacagtttggccgagcagatggctatgtgctagagggcaaagagttggagttctatcttaggagaaatcaaggcccgcaaaggcaaataaatccctgttttgtctctcacccatgtaatataagagtgtgtatatgtgtttgtt

SEQ ID NO: 4121 - DNA, 290 bp, Homo sapiens
cttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccggcaatattgcactgtacatttcacaaggattgtctctcttattttactctctcttagctctgttaactctgtaagatgcacagagggttggagcacgtgtatatagctctgctgtccctgtcaca

SEQ ID NO: 4122 - DNA, 301 bp, Homo sapiens
aatgcatggtaggagataagtttggagaagtagacagagaacagatcacataagccattataaagaatctgaatttaatgaaaatgcaaataagaatttgcagggaaatctgctttttgttcagaaataggctgtaatgagtttggcattttgcatacacactgtgttatttttgaggggagggacagtttaggggttttggaactgctgctttttaaactattttaggtgtaaccagtgcacaggggaaagaggaggaggaaagtggtttggcagagctagggtaaaaatagtgactacc

SEQ ID NO: 4123 - DNA, 296 bp, Homo sapiens
gtgaactcagtttgtgaactcaagataaatgcttaatttgacaccatggtaaatactactgttgagtttaaagttgtctcagaatccagcatattaatgaaaagttactgctttctagtcctttattcatatttttatagcttttaaaattattattctgtagattttgaatgcttaaaactacagacttagaaaataatattcaaatatgtgtgatcaaccatctaaaataatacatgctaacctctgtcatttttgcatcagctattttaaaataattaavatattatacctac

SEQ ID NO: 4124 - DNA, 220 bp, Homo sapiens
gaaggaaagaaaaaaaaaggaaaaaatgcaaggaaggtatttggtgaatctataataataaaaatgtatttgtcatttcccttttctgtgctctcattctataaaattgagtaaaaaatctatatatagtttcaaacacattaatagaattcacacaagttagctgagtcaacattgtagagacataatatttctgtatgtcacagacatagacaccatt

SEQ ID NO: 4125 - DNA, 205 bp, Homo sapiens
agaagtcccatcacttgaaagaaatgaaggtcgaatttctcagccccaccatggtgtgccatatttcagaaatatccttcagtccagaaacttagaaattaacttccacattctacgagtggggacaggaaactgtgatttggacattccagatggaggttaaagagttctttgacacagcagttaggtcaaacaaggtctctct

SEQ ID NO: 4126 - DNA, 250 bp, Homo sapiens
aaaaaaaggtcttggtgaggtgccgccatttcatctgtcctcattctctgcgcctttcgcagagcttccagcagcggtatgttgggccagagcatccggaggttcacaacctctgttgtccgtaggggccactatgaggagggcccttggaagaatttgccattttcagttgagaacaagttgtctgttactatgctatagatgtgtttgtactcttgatcttcatatgctacacacttcttgtagtaag

SEQ ID NO: 4127 - DNA, 254 bp, Homo sapiens
ctcgtgccgaattcggcacgagcacagatccctacctgcctggctaagacccgtggccgtcaaggactggttcggggtggattcaacaaaactgccagcttttatgtatcctcttcccttcccctcccttggtaaaggcacaaatgttttgagaactttatttgcagagacacctgagaatcgatggctcagtctgctctggagccacagtctggcgtctgacccttcagtgcaggccagacctggcagctgga

SEQ ID NO: 4128 - DNA, 301 bp, Homo sapiens
cggcacgagccaagatgtcgttcccaaagtataagccgtcgagcctgcgcactctgcctgagaccctcgacccagccgaatacaacatatctccggaaacccggcgggcgcaagcgaagccggttggccataagagcccagctgaaacgagagtacctgcttcagtacaacgatcccaaccgccgagggctcatcgaaaatcctgccttgcttcgttgggcctatgcaagaacaataaatgtctatcctaatttcagacccactcctaaaaactcactcatgggagctctgtgtggattta

SEQ ID NO: 4129 - DNA, 299 bp, Homo sapiens
ggtaaatgagagcacagtgtgcctgatgggacatgaaagaagacagactttaaaccttatcaccatgctggctatccgggtgttagctgaccaaaatgtcattcctaatgtggctaatgtcacttgctattaccagccagccccctatgtagcagatgccaactttagcaattactacattgcacaggttcagccagtattcacgtgccagcaacagacctactccacttggctaccctgcaattaagaatcatttaaaaatgtcctgtggggaagccatttcagacaagacaggagag

SEQ ID NO: 4130 - DNA, 299 bp, Homo sapiens
acggagcggacgccatggcgaccaacatcgagcagatttttaggtctttcgtggtcagtaaattccgggaaattcaacaggagctttccagtggaaggaattaaggccagctgaatggtgaaacaaatacacccattgaaggaaaccaggcgggtgatgcagctgcctctgccaggagtctaccaaatgaagagatagttcagaagatagaggaagtactttctggggtcttagatacagaactacgatatagccagacttgtaagagggctccagaaaaaggtagatgcgtatcttta

SEQ ID NO: 4131 - DNA, 254 bp, Homo sapiens
aaacaccctcaccactacaatcttcctaggaacaacatatgacgcactctcccctgaactctacacaacatattttgtcaccaagaccctacttctaacctccctgttcttatgaattcgaacagcatacccccgattccgctacgaccaactcatacacctcctatgaaaaaacttcctaccactcaccctagcattacttatatgatatgtctccatacccattacaatctccagcattcccctcaaacctt

SEQ ID NO: 4132 - DNA, 290 bp, Homo sapiens
cttaggcttttgctagttttagaaattagggagcagcccttgatttgtggattaaaagcaaccatttgagcgatgatgcacaacatccaggaaaattgggcggttggacaattgaggctgaggattggagttgacatgagcagggagaggaaggttcgcccttcttatctttgattgttgctcacctagtttgctgattgtttacatccagcagttacaattttttaaaattatacttttacaattaatttaaattttgctaccccaggtaattcctccaagggggttca

SEQ ID NO: 4133 - DNA, 298 bp, Homo sapiens
ttgtcctctyccttttatccaggcaggaggattctatatcctgatgggtaggagacagactccaggcagccctggacttgctagcccaaagaagggaggatgtggttaatctgtttcacctggtttgtcctaagggccatgattaaaaggtaccagctctgcctggggtccttaaggcccaggccaggcagrccaaatttttccttttctggcatacaacccttgcttcaaatttagctatacctcatgagtaggtggctttgccttagagtgggctggggacacttaattcctccca

SEQ ID NO: 4134 - DNA, 312 bp, Homo sapiens
ccaagcgggacgcccaaaatgaagtttaatccctttgtgacttccgaccgaaggaagaatcgcaaaaggcatttcaatgcaccttcccacattcgaaggaagattatgtcttccctctttccaaagagctgagacagaggtacaacgtgcgatccatgcccatccgaaaggatgatgaagttcaggttgtacgtggacatataaaggtcagcaaattggcaaagtagtccacgtttcaaggaggaatatgttttcttcaatgaacgggtgcaacgggaaaaggctataggacaaatcttcccgtggggcttt

SEQ ID NO: 4135 - DNA, 198 bp, Homo sapiens
gtcgcagccgcgccgaggcacgccagaaccgccacatcgacctgcagttcagctacgcgccacggcactcgcgccggaacgagggggtcgttggtggcgaggactacgaggaggtggacaggtacagccgccaggcccgagttggccgggcttggcacttgcggggcccagcagagccgccaggaagcttgaggtacc

SEQ ID NO: 4136 - DNA, 224 bp, Homo sapiens
ttggcctcggcttgggccgttcatgtagcagcaaccggcggcggctgccaaggaagcagcgttcggtttttgttttttaaattttgaaaactgtgcaatgtaattaataacggctttttatatctaaatgtaattctgcacgggaagggtcaacttggtcccagggtgttaaggctttaaggggcaatatatataaatgttaattccctcctgaactagtgcca

SEQ ID NO: 4137 - DNA, 317 bp, Homo sapiens
ccaagcagatgcagcagatccgcatgtcccttcgcgggaaggctgtggtgctgatgggcaagaacaccatgatgcgcaaggccatccgagggcacctgggaaaacaacccagctcttggaggaaactgctgccctaatatccgggggaaattgttgggctttgttttaaccaaggggggacctactaggtccaggggcaatgtgctggccaattagggtcccacttcttccccgcctggtccattgcccccatgtagggacattgtcacaccaagacatggtctgggcccggagagcactcttttcacaggtttggg

SEQ ID NO: 4138 - DNA, 312 bp, Homo sapiens
ctcgtgcgaatttcggcacgagaaaaaacatcaactcctgaagttagaaataagaatggtttgtaaaatccacagctatatcctgatgctggatggtattaatcttgtgtagtcttcactggtaagtgtgaaatagttcttccacctctgacgaacacttccaatcctgtacgtacttcatttccccttgagcaaggtggatgtttaccgtgtgttatatacttcctgggtcctacactgcacatgcctagtccaacatttttccccagtgagtcacatcctgggctccagtgtataactcaatatcatgtc

SEQ ID NO: 4139 - DNA, 325 bp, Homo sapiens
ctttaatgccttcctcttcacccagctgctgtgttccacctgtcagtcccacagcagctccccagccacactcagggtcccagtgttcttgttacaatgagtccagtcactggcatttacccagttaacctgtctaatcctttccaccagggaattgaaattttaaagggacacagggcccccctggagggacccgttaaaaggtccttttgtaatgggcacaggggggaattctctagaacacatctttttacgagacccaatacactgcctaatgataatgtgggctctagagggctctcaacctgcagcttccctatgagga

SEQ ID NO: 4140 - DNA, 239 bp, Homo sapiens
gcacggcgctcccagatgagggccggactgcctccccttaagcagctgtgttggaggtactgcccagaccgctgcaggtccctggggatctgcatttctaacgggctcctgcccccaagactgctctggtggaaaatccagcctgggagcccctggagtggcaggccttttctgggtacaggtggagccacccccaggagttgcgtgtgttttcttaattgaaagacttccccaaaagg

SEQ ID NO: 4141 - DNA, 166 bp, Homo sapiens
  misc_feature 87: n = A,T,C or G
ctcgtgccgaattcggcacgagcttgaatttggaaagtgttcattttttggcctactgttcggggcaggggggctgagccaggttgngcattagaagcaggggttttcccctcttgccagtttttttggggagctgcccaggccacccttgcacccttcccgtttc

SEQ ID NO: 4142 - DNA, 129 bp, Homo sapiens
ggtgatggcggctatagctgcatccgaggtgctggtggacagcgcgggaggaggggtccctcgcttgcggcggcgggagcttggcccgttcagaaaggcgcgaacagagacttcgcaaattccggggag

SEQ ID NO: 4143 - DNA, 110 bp, Homo sapiens
gaacacttgcaggggtccctgctagttagcgccccaccgccgtggagttctgtacccttttccttaggaacttttaccaggaaggccaaggtcttccctgggaggccctt

SEQ ID NO: 4144 - DNA, 149 bp, Homo sapiens
  misc_feature 134: n = A,T,C or G
gcagtgtccgagtctaccactatttccagtggcgcagggcccagacgccaggccgcagaaggaccaagaggacctcaggaatcatgtagaactggggggctttttctcctgagcagaggaggcccaagcgcatnctctggagacacttc

SEQ ID NO: 4145 - DNA, 110 bp, Homo sapiens
cggtggctcacgcctgtaatcccagcactgagaggccgatcacttgaggtcagagagttcaagaccagcctggccaacatggtgaaaccccactcttttacttaaaaaat

SEQ ID NO: 4146 - DNA, 129 bp, Homo sapiens
cctctgggaggtgcagttatgctgttactagtgattttagggctttgttatttaacttatttcaagggtgctgtgctcagccctgcccatggctgtgcagctccctccgtgcctcagatctgctgtagg

SEQ ID NO: 4147 - DNA, 144 bp, Homo sapiens
ctcgtgccgaattcggcacgagccgctgctggtgtggttgacataggtgatggccacagtgcaagaaaggcaaaccagagctccagaaaaaaaggtgacatccagcagtggtgaattcgacaacgaaagtcataccgtagaaaa

SEQ ID NO: 4148 - DNA, 102 bp, Homo sapiens
attttaataaacaaatgatcagcattttacacaatccattttcttgcagaaaatctagaggcaagggataaacttcattacctcagtgccgaattcggcacg

SEQ ID NO: 4149 - DNA, 138 bp, Homo sapiens
gcatgctctccctgccttgggcttttctttccgtcatgttttccttttcgtgttccttctctgatttctcttgtctctgctgctcacaggccttcccatcagtcagtacagatactcagtgtcttgtttccttgccca

SEQ ID NO: 4150 - DNA, 135 bp, Homo sapiens
cagcagtccaggtgccacaggcagccctgggacataggaagcttggagcaaggaaagggttcttagtcactgcctcccgaaggttctttgaaagacttcggggaatttttccaggtttatttattttaataccca

SEQ ID NO: 4151 - DNA, 151 bp, Homo sapiens
gctgttttggagttcctgggggccttcacccctcgatgttcccaagacacacctgccaggggtttgttggagcaggctgaggctcttaagggccaagggaggtccaggtgggtggcctttcttaagttttaatgaatgccctttgttactt

SEQ ID NO: 4152 - DNA, 134 bp, Homo sapiens
ctccaccttactaccagacaaccttagccaaaccatttacccaaataaagtataggcgatagaaattgaaacctggcgcaatagatatagtaccgcaagggaaagatgaaaaattataaccagcataatatagc

SEQ ID NO: 4153 - DNA, 142 bp, Homo sapiens
ccgaaaacctggctcagtgcaatactcccattgccatgggggtccttcaccatggtactgtctccacagccctcagtccccaccccaggagaggcgcctgccacctcctcctcatctccggtggttcaatcgctccggctgt

SEQ ID NO: 4154 - DNA, 142 bp, Homo sapiens
ctgcctgggagttgggttccctccaagggtccctctttcagtgtcctctctctcacctgggtctgccaccctaacaggtggcaactcggcagggctgctggggggcacttcctgcccagtgggggggtgccgcccaaccttc

SEQ ID NO: 4155 - DNA, 139 bp, Homo sapiens
cagagatatcgagcagtactattccactcagattgatgagatgccgatgaacgttgctgatcttatctgaagcagcagatcagtgggatgagggagactgttcacctgctgtgtactcctgtttggaggtatttagata

SEQ ID NO: 4156 - DNA, 165 bp, Homo sapiens
gaagagcctgccctcctatatggattcttcagggccctccacatctgaggtggctcattcccatcacacacagattgtcctgtgtgttcatttcaaggccagtgttcagcagcagcgtttttgaaagcaggttctgttggaccccccgccccgccccccgcactt

SEQ ID NO: 4157 - DNA, 151 bp, Homo sapiens
ccgccttctcccgccaccgccgccgccgccttccgcaggccgtttccaccgaggaaaaggaatcgtatcgtatgttccctatccagaacctccactctttcgaccccttttgctgatgcaagtaagggtgatgaccttctttctgctggca

SEQ ID NO: 4158 - DNA, 110 bp, Homo sapiens
cagcagccatggccctacgctaccctatggccgtgggcctcaacaagggccacaaagtgaccaaggacgtggagcaagcccagagcacagaccgagcggcgcgggggtct

SEQ ID NO: 4159 - DNA, 131 bp, Homo sapiens
atgattgcgagtggaaaaataggggacagaaatcaggtatttgcagttttttcattttcatttgtgttgttaatttttaatataaattgcggagagcgtgaaagcatataattgcaaagttaaaaatgtgt

SEQ ID NO: 4160 - DNA, 200 bp, Homo sapiens
ggcgaacgcggagagcacgccatgaaggcctcgggcacgctacgagagtacaaggtagttggtcgcttccttcccaccccccaaattccacaaggcggccctctatccccgatagcgagatctttgtcgcgctatatcatgtcgtcgccacagtgcccctctctgtgtgatctcttgtatactcacgagtataagagaga

SEQ ID NO: 4161 - DNA, 125 bp, Homo sapiens
gtgccgaggctatcaaggccctcgtaaagcccaaggaggttaagcccaagatcccaaagggttgttagccgcaagcttgatcgacttgtcctacattgtcccaccccaaggttgggaagcggttc

SEQ ID NO: 4162 - DNA, 150 bp, Homo sapiens
gctgaccgttttttgtggtgtactccgtgccatcatgtccgtcctgacggcgctgctgctgcggggcttgacaggctcggcccgcgcggctctccagttccgcggcgcgcaagatccattcgtgtgtccgcgcgcgaggggaagctttgg

SEQ ID NO: 4163 - DNA, 183 bp, Homo sapiens
tcttgactccgctgctcgccatgtcttctcacaagactttcaggattaagcgattcctggccaagaaacaaaagcaaaatcgtcccattccccagttggttcggatgaaaacttggaataaaatcaggtacaacttcacaaaggagacatatgagagagagacccagctctggtctatatagg

SEQ ID NO: 4164 - DNA, 226 bp, Homo sapiens
ggaagtgtgagttcaggtgcccctttgggctcaagtgagagttacccatagagacaatacttcagttttgctcctccattcgccatccagtgcagattatgcaatttgtcttcccacaacctcttccttaacaattcttaccgcaaatctctaactctgctgtgtaaaatctctctctctctctctcaaaaaaccccatgtgctcttatagtgcacgcgtcagact

SEQ ID NO: 4165 - DNA, 120 bp, Homo sapiens
tgccaacatgccatccagactgaggaagacccggaaacttaggggccacgtgagccacggccacggccccataggcaagcaccggaagcaccccggcggccgcggttaatagcttggtgg

SEQ ID NO: 4166 - DNA, 230 bp, Homo sapiens
acactgtggagaggcggaaggcagggagccccaaggtctcagctgcccacgctccccagtgtgatgcctactttagccaaccaagaggagcacaagcaaaggaactgttcatgtgatgaggcagaagaggagcttagaggagccagccttaccactatctgtaccactctgggattgtatcctctctgagctatagtgttctcgctgtgtcgtctagactctgagtgtca

SEQ ID NO: 4167 - DNA, 235 bp, Homo sapiens
ctccaaaatggcgtcagttggtgagtgtccggccccagtaccagtgaaggacaagaaacttctggaggtcaaacttggggagctgccaagctttgatcttgatgcgggacttcagtcctagttgcattttcggagcctttcaaagagagtgtactatcccgtactacacacacagtacactcacatgtgaagagagggggagcactctctcgggattaccatatgtgtctctgca

SEQ ID NO: 4168 - DNA, 160 bp, Homo sapiens
ccaccctgcacctggtgctccgtcttagaggtgggatgcagatcttcgtgaagacccttacttgtaagaccatcactctcgaagtggagccgagttacaacatttagaatgtcaaggcaaagattcaagacaaggaaggcatcccttctctaccagcaga

SEQ ID NO: 4169 - DNA, 185 bp, Homo sapiens
ctcgtgccgttttttttacacaaagacaattatttaagacctttattaacaggtgcttgcagtttgttgacttttttgaaaaaatcaagttgtaaacttttattacaaattaaaaatgaaggtcttaaaaatctcaacttgaccagatatgacacacatttataaaacctcttataagggcgtat

SEQ ID NO: 4170 - DNA, 240 bp, Homo sapiens
ggatgccctgatggcagttagcacactggtggaagtgttgggtggtgaattcctcaagtacatggagggctttaaacccttcctgggcattggattaaaaaattatgctgaataacagaggttgttttgcagctgtgggcttagttggagacttgtgtccgtgtccctgcaatacacacatcatacctttctgtgtacgcgggtgtatgcagactgtctctctctgagaaatttgtgggg

SEQ ID NO: 4171 - DNA, 177 bp, Homo sapiens
ttcacattctgaaggacctctctagctggccagtgctgaggaggttggagagagaaagggtgaaagcagagagaccagttcagggctgttaacagggttgcaggcgagagacttgggtgcttggcttccctagagctaggacttcagtgtcccttctctctccaagagcacaaagag

SEQ ID NO: 4172 - DNA, 175 bp, Homo sapiens
aaatttgcccacagaaccctctaaatccccttgtaaatttaactgttagtccaaagaggaacagctctttggacactaggaaaaaaccttgtagagagagtaaaaaatttaacaaccatagtagggctaaaagcagccacacaattaaggaagcgttcaagctcaacaaccacta

SEQ ID NO: 4173 - DNA, 191 bp, Homo sapiens
ctaatgcccacaaggtactctgtggatatccccttggacaaaactgtcgtcaataaggatgtcttcagagatcctgctcttaaacgcaaggcccgacgggaggccaaggtcaagtttgaagggagatacaagacaagcaagagacaagtgtgtgtcttccagaaactgcgggttttagatgctttgttttt

SEQ ID NO: 4174 - DNA, 310 bp, Homo sapiens
cggcaacgagattactaacagaatgtcccccaatgatggacactgagtataccaaactgtggactccattattacaggtctttgattgggtctttttgaggtaccccgaggtgataccatttcctataagggacattttaattttacataggaggttccaccaggtattcagctctgcctctctaccagttggattttctctggaaaaaagaggacgtatccctatgggacatagggtgtatcccccaaactttacccctggcactgactcttcacggttgtatccgcctgtaccggaagggttacctat

SEQ ID NO: 4175 - DNA, 350 bp, Homo sapiens
ttgaccagtcacagattcaggagttcaaagaggccttcaacatgattgatcagaaccagagatggtttcatcgacaaggaagatttgcatgatatgcttgctctcattgggggaagatccacctgagagtatctctggatgccatgatgattgagcttccaggcccctatcaattttcaccatgtccctaaccatgtttgggtgagaggttatatggcacagatcctgaagatgtcatcagatatgcctttgctcgctttgatgagagcatctcgcaccatacagggagattacttgagagagctgctgacaccatgggggatcggtttacagatgaggaagtggatgag

SEQ ID NO: 4176 - DNA, 95 bp, Homo sapiens
attttttcatagttttaactagatttccaagatattttggtgcatttgtttcaactgaattttggtggtgtcagtgccattatctagcaccctga

SEQ ID NO: 4177 - DNA, 136 bp, Homo sapiens
  misc_feature 136: n = A,T,C or G
ctctattgcttatgctttaaaaaaaggagaaacaaaaaacctactaacccactgcaagctctttgtcaaaattttaggttaaattgggcattgccttgtttttttgaaacctgaaattacaatggggttccatttn

SEQ ID NO: 4178 - DNA, 130 bp, Homo sapiens
ttgggtttgcaaacttctgtggctggtagttgtagtgtgtttttcatgttgtcattgttcattgtttaatcccagtattttggggaaaccactaaaaagggcaaccaggtccaataagattcttttgcca

SEQ ID NO: 4179 - DNA, 144 bp, Homo sapiens
ctcgtgccgaatttcggcacgagttttgcttaggcgcagacgggggaagcggagccaaacattgccabttggccccggagctggggttttgtcggcaaaatcttatggtgaaccccgccggagaacccttcgagaaatctctct

SEQ ID NO: 4180 - DNA, 125 bp, Homo sapiens
ttcgcgtccattactcaaggagacagcataacagatgcagaacaagtcatatttgaggatgttttgtactaaacttcatttaattattcagtttttaaagggaaaaagggcgtgagctcacacag

SEQ ID NO: 4181 - DNA, 125 bp, Homo sapiens
ctaagacggctcttgacttttcgcgggccggaagaaagagggaagacattcagctgaaggacctcgaacctgtactgtctgtcggagtctcaattaataaccacagtggcctgtggcacagtgga

SEQ ID NO: 4182 - DNA, 125 bp, Homo sapiens
cacatttgaactagtcactctcccagacttgcgtgggtcagttctttctgagtagaggacttgctggtaaaggggcagatgcttttaattagtactgataaaacaaactdagggaaacatcccct

SEQ ID NO: 4183 - DNA, 150 bp, Homo sapiens
gcaagcatcgtggaagagctgcccactggccatcagagtcaccaaccccaatgccaggctgcgcagtgaaggaaatgagtaggcagctcatgtgcacggtatactgtttaaataaatgtaaaaactgccctctggcatacaactccttgg

SEQ ID NO: 4184 - DNA, 190 bp, Homo sapiens
atcagactgagaacaaaatcctgggtgtacactgtctccatcacattgtgcttaatgtggctgtgctcctgtgtctgctggatttattccccattcctggggaaaacccttgcaacctggaagggggagtggggtctcgacccaccacccaatgttatgaggggtccctcggcttattcctacccacatg

SEQ ID NO: 4185 - DNA, 190 bp, Homo sapiens
gggatcaaggtgaaaaggagaaccccatgcgggaacttcgcatccgcaaactctgtctcaacaatctgtgtttggggagagtggagacagactgacggcgagcagccaaggttgttggagcagctcacaggtcagacccctttttttttcccaagctaagatacactctcagtccctttggcatccgagg

SEQ ID NO: 4186 - DNA, 194 bp, Homo sapiens
agattaaagccctttagatactgccaagggagcgctgtggcattcatactttgacttaaattattgattaattttcctgtcttttggtaataatctctggttactaaatttcccaagatttcctgatatacctaggatattgccccacaccactcgcattccctttcacactagggttcccattacacacgggg

SEQ ID NO: 4187 - DNA, 187 bp, Homo sapiens
agaatgaagactattctcagcaatcagactgtcgacattccagaaaatgtcgacattactctgaagggccgcacagttatcgtgaagggccccagaggaaccctccggagggacttcattcacatcattgtagacctcagcctttcttggaaagaaaaaaagagaggtctccgggttacacatatgg

SEQ ID NO: 4188 - DNA, 195 bp, Homo sapiens
gtgatgtctcacagaaagttctccgctcccagacatgggtccctcggcttcctgcctcggaagcgcagagcaggcatcgtgggaaggtgaggagcttccctaaggatgacccgtccaagccggtccacctacacagccttcctggatatacaagctctggacatgatctacacatcgtcgcgggaagtgtgcgca

SEQ ID NO: 4189 - DNA, 207 bp, Homo sapiens
ctcgtgccgaattcggcacgagagagtggtgtgaaggccaaaatctgactcctcataggaaggaaccctttgtaggcgacctgcccagcctcaacttggcactttcagtgttcttgttcttggaaggccatcttgggagacggtatattgctttcataggtgaggggtatatattgtatgccgagattcagggtaatttctacgtga

SEQ ID NO: 4190 - DNA, 125 bp, Homo sapiens
ggaaagacgctgggaggcccagggatgcccggcgcaactgagacgctcatcgggagtcacggggtcggccctcaggggaacggggactatccgtatcaacttcggttgttttttcggtttcttca

SEQ ID NO: 4191 - DNA, 155 bp, Homo sapiens
gcgtggtctacgccgagtgacagagacgctcaggctgtgttctcaggatgaccgagtgggagacagcagcaccagcggtggcagagaccccagacatcaagctctttgggaagtggagcacccaatgatgttcagatcaatgacaatttccctgc

SEQ ID NO: 4192 - DNA, 110 bp, Homo sapiens
aagacgagctgtatgaatgtatggataataatgacgaggcattatcttccatggaggctaagtataaaataggtgcttggttacaaacttttaatcaaaggcttgacctt

SEQ ID NO: 4193 - DNA, 182 bp, Homo sapiens
ctaaaggagaagcaaccgttggggggttggggtttcctaaggaatggtttcaaaaatgtacccatcaatttgatcaatagcacttttaattccttttgaagtgttgcctctaggtgggttgtttgtctttttggcatgcttaaaggccaatgtcccttaaaaattcatatttgttccccttt

SEQ ID NO: 4194 - DNA, 170 bp, Homo sapiens
actgaagacaagaccccaaggagttgtgaccttgccaccaggtcggttgccgaagaaagagttttggtaccatagccgagggttcaattgattaattaccctacttattaaatgtgtgggatcctataaatttaaattgtgtctctattacctgttgaggaaggtccatt

SEQ ID NO: 4195 - DNA, 116 bp, Homo sapiens
gctatttgaactggtgcctcttggagattttgagtctgtgtgttggggagaggcagccatggggcccaccaggacccttgagcccgggtgacagttcccgtccatcttgcaggttc

SEQ ID NO: 4196 - DNA, 281 bp, Homo sapiens
cagccgcagagattgttgatgcctaagaggagccggattgccatttatgaactcctttttaaggagggagtaatggtggccaagaaggatgtcccatgcctaagcacccgcagctggcaagcaaggattttcccaaccttcatgtcatgaaggccatgcagtctttcaagtcccgaggctacgtaaagggacaatttgccttgagacaattctacttgtaccttaccaattagggttccagtatactcgttattaccttcatcttcccccggagtttgttc

SEQ ID NO: 4197 - DNA, 272 bp, Homo sapiens
ttgtgttgacactgtagctcatactggaaaagtcgatcaatgttttgcagtttattgaaagtagttctatatataacaatgttataagcatttctttagaaatggttgaaaatgcttctaaaatgtgattatcgaccatgggatgcatgatcgttgtaattgttgacattccctttagaaggttgtgaaatgttacaacttgtgcttatgttggaccaatcttctggcttaagtaccagggcactaccttcaataaggtctattataactta

SEQ ID NO: 4198 - DNA, 286 bp, Homo sapiens
ccacatggaaagctgctcaaaatcagtacttatcagggaaaagcaaatcaaaaccccttcaaatcttctaagcacctaggatcatcagagtcaataaaatacagaaattaccaagttttgaagggtttggaggaaatgggagacttagggccaccgccatttagactttaaaccagtccaaccattttggaaaccattctggcagtttttcaaaagataaggcatttatatgccccagatattcactccctaggtatacctagaagaattgaggctgggcagcagt

SEQ ID NO: 4199 - DNA, 220 bp, Homo sapiens
ggaatgctggcttccctggcctccctggacctgctgtgagtttgatagaaaaaagctcttagtattttgctttaaataaaatctatcttatagtatctgtctttaaagagaaaaaattagtgcaaaaatatattaaagcgtatgtatttattttttagggagaaccaggaaggcatggaaaggatggattaatgggtagtcccgtttcaagggtatttat

SEQ ID NO: 4200 - DNA, 271 bp, Homo sapiens
gaaaagtggaaagcagagagagaggctcggctggcaagaggagaaaaggaagaggaggaggaagaggaggaagagatcaacatctatgcagtcaccgaggaggagtcggacggaggaaggcagccagagaaaggaggggccgcaaccaacaagaagttcattcctcacggcccttttccctcgcagcaaagattttaggatgcacttgtccaaagaagaaatggcacttctcagagtatcaagcgagccctcagcccaaagttagagcaga

SEQ ID NO: 4201 - DNA, 305 bp, Homo sapiens
ctgcgctgacccaggggctggagcgaatcccagaccagctcggctacctggtactgagtgaagtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctggtgacggtctcaggacagaggtgtttgtggtgaagaggcagaccgcggtcgggagcccattgatgtctgagcctcccgaggcgagggtcggagaagcg

SEQ ID NO: 4202 - DNA, 225 bp, Homo sapiens
cgggtcctggcatcttgttcatggcaaatgctggacccaacacaaattgttcccagtttttcatcttcacttccaagacttagtggtttgatggcaagcatgttgtgttttgcaaagtaaaagaaggcattaatattgttgagggcatggagcgcgttttggtccacggaattgcaagagcagcaagaagagtcaccatttctgactgtagacaactcgaatatg

SEQ ID NO: 4203 - DNA, 145 bp, Homo sapiens
ggaactcttctgtatctaaaacaatacatctcaatcttgggccagggaaaatgggcttcttttctgggttggcacctagccaccttagggaatttcggttgagattttcaacaagagtaagacacacacattccaggtaaagggg

SEQ ID NO: 4204 - DNA, 181 bp, Homo sapiens
gtcaagagggtaaaacttggcctagaagctatcagcaaccacaaagagacaagaaggaaagacttttttcttaggctctttcttatgggaccctctctatagataggttataaacccaggcccagaaatatatatggggttttatatatatgatatggccctatatatatatggccctata

SEQ ID NO: 4205 - DNA, 101 bp, Homo sapiens
catgcacattttgattttgtttgtcattcaaaattgtgcttgtaaaaatgtatacaatttctgaggtttataatttctagggacttggttttttcctgcct

SEQ ID NO: 4206 - DNA, 120 bp, Homo sapiens
gccgagtcgcgcggaggcggaggcttgggtgcgtccaagattcaacttcaaccgtaacccaccggcatgggcgaggaaggcatttcttctggaggtttaattggacgttaatacttcttt

SEQ ID NO: 4207 - DNA, 176 bp, Homo sapiens
ggaatgaaaaaccagttcaatctccatgagctgaaaatgaagggccctgagccagtggtcagtcaaattattgacaaactgaagcacattaaccagcttctgagaaccatgtctattcccaaaggtagggttcttggataaaaaccgggatgagggagggtttgaaagtggagact

SEQ ID NO: 4208 - DNA, 128 bp, Homo sapiens
tgatgccaagattcgcatttttgacctggggcggaaaaaggcaaaagtggatgagtttcccctttttggccacatggtgtcaggtgaatataagcagctgttccctgaaggccttgaggcttcccgaa

SEQ ID NO: 4209 - DNA, 104 bp, Homo sapiens
tggaagcccaggcagaggaggcgctgagagttagccagggctgttaggacttccagcacgctgtcacctcttaatagttcacaaaaaagacttaaccttttaga

SEQ ID NO: 4210 - DNA, 133 bp, Homo sapiens
tccgcataagcctgcgtcagattaaacaactgacctgacaattaacaagcccaatatctacatccacccaccaggtcaattatttaaccctcactggtcaacccaaccacaggcatgctcatagggaaaggtt

SEQ ID NO: 4211 - DNA, 220 bp, Homo sapiens
tcgtgccgtgagaagccatgagcagcaaagtctctcgcgacaccctgtacgaggcggtgccgggaagtgcctcgcacgggaaccagcgcaaagcgccgcaaagtttcctcggggaacggtgggagttttcagattcaagcttttaggaactaatggatcccccagaagggaccaaacgctttttcggggcacccttaagagttttaagtgccactattcc

SEQ ID NO: 4212 - DNA, 270 bp, Homo sapiens
aaaaccagagaagcctttgactcagttcaaagaggctattaggaggaaattgactaaagctgtacagactctaagacctgggcacttacattcctttgcatttcttgagggatgctttgaattcttgttctactcctagggggctctcgcaacttcagatactaatctcaaggagagttattgggtcccgaggacacaaattcccctgtccacacagagaactctaatttcaatcccctgtagatctgtagagattataattctcagggg

SEQ ID NO: 4213 - DNA, 181 bp, Homo sapiens
tttttttaatctcctacttctgctatctttgagcaatctgggcacttttaaaaatagagaaatgagtgaatttgggtgatctgcttttatctaaatgcaaataaggatgtgttctctgagacccatgatcaggggatgtggcgcgggggtggctatagagagaaaaagggaaatgcctttg

SEQ ID NO: 4214 - DNA, 245 bp, Homo sapiens
tcgaagcgaggacgtggtgggtcctctggtgcgaaattccggatttccttgggtcttccggtaggagctgtaatcaattgtgctgacaacacaggagccaaaaacctgtatatcatctctcgtgtaagggggatcaaggggacggctgtgacagactctccccctgtctctgtgtggggttacatatgtgtataggccacactgcatagagagggcacaccagagctctaagaaaagggtacaca

SEQ ID NO: 4215 - DNA, 108 bp, Homo sapiens
gcaactgcctgggggcggggatgggggcagggtggaagcggctccccattttataccaaaggtgctacatctattgtgatggtggggttgggagggattcacttgtgc

SEQ ID NO: 4216 - DNA, 198 bp, Homo sapiens
ccagagttggagcagtggttactactggattgaccctaaccaaggatgcactatggatgctatcaaagtatactgtgatttctctacttgcggaaactgtattccggcccaacctgaaaacattccagagcaaggactctgtatatgggagttcaaggggaaggacacggtttgctaggagaatctttaaattttgga

SEQ ID NO: 4217 - DNA, 280 bp, Homo sapiens
gggaccaggccaatcccttctccacttactataatggttggaactaaacgtcaccaaggttgcttcttccttgcttgagagattggaggccttggtggattttcttcctgggttccctaggccctagtaaggcaagaggaaaacccatcctctccctctctcacaccgtagagcccaagatcctctcagaggcacaggagttctcccctctccaatggtcccccgtccctctgtctgtatatgtgacccacctatgtgaggatatacacctacgcactgg

SEQ ID NO: 4218 - DNA, 180 bp, Homo sapiens
gaagtgacatcgtctttaaaccctgcgtggcaatccctgacgcacccccgtgatgcccagggaagacaagggcgacctggaagtccaactacttccttaagatcatccaactatttggatgattatacccaaatgtttcaatgttgggagcagacacatgttgggctcccagcacagttc

SEQ ID NO: 4219 - DNA, 253 bp, Homo sapiens
ctttgggaggccgaggtggacagatcgcttgagcctaggaatttgagaccagcctgggcaacgtggtgaaaccccgtctctactaaaaatacaaaaattagctgggcatggtggcatgcccgaaattccaactacttgggtgacttaggtgagaggatcacctgaacccagaaggttgaggctgcagttagccaagatcatgtcccactgtactccagcccggataacagagtgtagatcctgtctctaaagc

SEQ ID NO: 4220 - DNA, 158 bp, Homo sapiens
ctcgtgccgaattcggcacgaggaccggggcatccccttgtccccaagagacccgacggttgcttcatggcctacacgttcgagagagagtcttcgggagaggaggaggagtagggccgccttggggcttggcattccgccccttgggccaacccttg

SEQ ID NO: 4221 - DNA, 118 bp, Homo sapiens
atgggaaagtgtgtaagatttagaaaaagcattaactattagtaaactttatcttaagctctaacctttgattaggtcccacaaaaattaggtgatatgcaatttctaatttagggcc

SEQ ID NO: 4222 - DNA, 310 bp, Homo sapiens
cgctcacgcaagcatggttaacgtgcctaaaacccgccggactttctgtaagaagtgtgggcaagcaccaaccccattaaaggtgacaaagttacaaaggaggggcaaggattctcttgtacggcccagggaaaggcgcgcgtatatgagacagggagggcaggtgcggctatgggttggcacaactctaaggcgcgatttttcccgggaaaaaaggtctaaaatctcacacagagggatgtgcgctaaggtctgagagtgcgtagagcccaatctacagatctgagagagtgctggctataaagagatg

SEQ ID NO: 4223 - DNA, 235 bp, Homo sapiens
gctgaagtcgttttttaaagagtatggacaaatagaatctgtacgatttcgttctcttattccagcagagggaacgctattccaaaaggttgcagcaattaaaccggtaaattcattcctattcagaaaatatttatgcccatttgtgtgttttaaggaagagagagtctctccacgcaagcaatttaaaaggattggggccccaattccagagatggattcgcgtatagagagt

SEQ ID NO: 4224 - DNA, 321 bp, Homo sapiens
cggcacgaggtcacaggggccgttgcgtttggctttgtggagggcctggacccttccacaagaacaaccgagggttcagggcacttaggacaatgttttccagggacgagtcgaccaaggaaggacagattagtgtctctcaaggggccatatcacgcgagagctctgtatagaggggctctatgtagaatatgagatactcgtgcctctgactctttctttctcacataaaccacacctcccgcacaacacccacgagacccctctgcgtcatcatctctactactctctcctctcttgggggatatgggccctccctac

SEQ ID NO: 4225 - DNA, 211 bp, Homo sapiens
ctgaactgacaatgaagggaaattgtttatgtgttatgaacatccaaggctttcttcttttttaaggtgtcaaagaaggtttcacaaaattaggaaggacaacagttcttagctgtaatttcggcttaaactctgtgacactctatatgtagtgtcacattttaaactcgaatatatatatatatcagagccagcttaacccatacactgt

SEQ ID NO: 4226 - DNA, 275 bp, Homo sapiens
ccctggtctctcaagcgtatacttcaatcatcgccgatgattttgcagcctttgttggacttcctgtaggaagaggctgttaaaggcatattagaacaaggatggcaagctgatttcaacacaaggattgtgtctctcccagagaagacacattgtcagagggccctctgagtgtgtttctcttatacacgtgttatattcccctattcagagagctctgttcacatttcccccaaatatacccatgtgatcagcaggcagtagagcagcagctt

SEQ ID NO: 4227 - DNA, 120 bp, Homo sapiens
ggaaagagctgaccaactggccatcagagtcaccaaccccaatgccaggctgcgcagtgaaggaaatgagtaggcagctcatgtgcacggtttctgtttaaataaatgtaaaaacttccc

SEQ ID NO: 4228 - DNA, 229 bp, Homo sapiens
ctcgtgccaattcggcacgagggttgattaggttattattgcaaagcactgtcaccggcctcagggagtttatgtgtaatagaattcaaaataatagctgtgtataacaattagctcaagccacggatgtgtgaggcatttgggatgtatctgaattaattctcactaaaattcagcaaagggctttatagccctcccggccctttcattaagggtggaatgagggttg

SEQ ID NO: 4229 - DNA, 247 bp, Homo sapiens
ccttactaccagacaaccttagccaaaccatttacccaaataaagtataggcgatagaaattgaaacctggcgcaatagatatagtaccgcaaggaaagatgaaaaattataaccaggcataatatagcaaggactaacccctataccttctgcataatgaatttaactagaaataactttgcaaggagagccaaagcttagaccccgaaacagacgagctacttagacagctaaagagcacaccct

SEQ ID NO: 4230 - DNA, 110 bp, Homo sapiens
cttaactaacattctgaactagttagtgcagctcttcattgtgttgtgtgggttggtctcataactagggtgagtttttctcctctgctgagggaacagtaccgaggttc

SEQ ID NO: 4231 - DNA, 205 bp, Homo sapiens
caaaaatatttagctgcagagaacaaaggggaaggattaggtcatccaggtggccaacaagtattacaaaccacacttgcactgaaagcaaaagcaaaaatcagatgggggaaggaaagtttgcccataatgtgggcttctactaacctcttcccttcaccattacctcatttctctaccacaaagggcgggaagagacagcagg

SEQ ID NO: 4232 - DNA, 210 bp, Homo sapiens
attaatatagccactccaactctcctatggtactgtttttatggcatttttccccatccctttactttcaacctatttttatctttaaatctaatgtgtctattgtaggtagcatatagttagatcttgcttttattagtcagtcaatctctgacttttgcatagcatttagagtgttcatatttaatgtagttattgatattggtcaat

SEQ ID NO: 4233 - DNA, 110 bp, Homo sapiens
gtgggcatcagcaatctgtgggctctgctcatcagggttttctgtcgagagctggaagctagcaaactactgttatttctagtcttccataaaggacaactttttttcct

SEQ ID NO: 4234 - DNA, 112 bp, Homo sapiens
ctcgtgccgaatttcggcacgagcccagattgaggtggttccttctgcctctgccctgatcatcaagccctcaagggaccaccaggggccaggagaggagaccaggaaacac

SEQ ID NO: 4235 - DNA, 149 bp, Homo sapiens
tttgaacatcaacagaagagctggagaaagtttgcaaccccatcatcaccaagctgtaccagagtgcaggaggcatgccagaggaatgcctgggggattttctcgtggtggagctcctccctctgtgtggtgcttcctccaaggcccac

SEQ ID NO: 4236 - DNA, 167 bp, Homo sapiens
ggctggagtttgagaaggtctacttcccatacctgcttatcagcaagaagcgctacgggggcctgctcttcttcttccggcccgacggccacgaccgcatggacttcaagggccttgaggccgtgcgcagggacaacttcccccttcgtggccaacctgtgtgcact

SEQ ID NO: 4237 - DNA, 158 bp, Homo sapiens
ccaagaaggagatcaaagacatcctcatccagtatgaccggaccctgctggtagctgaccctcgtcgctgcgagtccaaaaagtttggaggccctggtgcccgcgctcgctaccagaaatcctaccgataaggccatcggtgactcaaaactcacttg

SEQ ID NO: 4238 - DNA, 150 bp, Homo sapiens
caaagttgtcgctattgtgcttcatccgttcagctgaacaggaggatggatacagccgcgagtaaaaaaacggatttcctcttcctagcttaaaatctgatttacactgttttgttttttaagaaccaaaagtgccatagtttaggattt

SEQ ID NO: 4239 - DNA, 183 bp, Homo sapiens
ggcctcttcccttggggagggggccacctgtagtatttgccttgatttggtggggtacagtggatgtgaatactgtaaatagcttgtgctcagactcctctgcgtggagagggtgggtgcaggaggcagaccctcccccaaagcccccttgggagatcttcctctctctatttaactgtaact

SEQ ID NO: 4240 - DNA, 120 bp, Homo sapiens
cctggggtgtattaactttgtgtatatagtgtaaatatccccactgtactgttaggagggcaacaattcttaggtattggcttttttgcaaagagttctacaacctttcaatgaaacaat

SEQ ID NO: 4241 - DNA, 180 bp, Homo sapiens
gccgatcccaggtgcgtgtgtctctgtctctcctagcccctctctcacacatcacattcccatggtgggcctcaaggaaaggccccggaagcgccaagcttggagataacagccttttgcccgtcggcccttcgtcggcccttgggtaccatgttggccacaacttctgttggcccctgt

SEQ ID NO: 4242 - DNA, 148 bp, Homo sapiens
gcaaaatgacccaccaatgggaagcagctggcttcactgctcaggtgattattctgaaccatccaggccaaataagcgcggctatgccctgtatttggttgccacaaggcttacattgcatgcaaggtttctgagcttaagggaaagg

SEQ ID NO: 4243 - DNA, 140 bp, Homo sapiens
caaaggagaaaaacagtgaaaaagccaatttcacttgttcgttcaattccagcttgttgctaatattagttacccttgtttttaattgacagagagttggcttggaatctgtagcttaggggaggggccacaattttagg

SEQ ID NO: 4244 - DNA, 175 bp, Homo sapiens
ggcataaaatccactgtctgccagcctcccttccctcccacctttttgggtacattggtgtaaaaaatgtaaaacaaaaaaattttatgaactaactgtggtgtgtgaaagagaggaggaaaactggaaatcttattccgtgtgtgtttgggagttgcttggggttgggggtcgt

SEQ ID NO: 4245 - DNA, 255 bp, Homo sapiens
gtggaggagatgttaaagtaacccatcttgcaggacgacattgaagattggtcttctgttgatctaagatgattattttgtaaaagactttctagtgtacaagacaccattgtgtccaactgtatatagctgccaattaggtttctttgtttttactttgtgctctgctatctgtgttatgactcaatgtgggagtttgtttatacacaatttatttgtatcaattcaagtaaaacccaaataaatgctttcccc

SEQ ID NO: 4246 - DNA, 188 bp, Homo sapiens
ctcgtgccgaattcggcacgagcctaaacctgtattttagtgttgtgaactccagtggtttcaagtcactaaagtttcttaagtcttagtgttttcttaagcagttttcccttgtggctccctggcgtgttctctcctgacttttgttccctgcccttagtgttatttcccccctttctatccccaaa

SEQ ID NO: 4247 - DNA, 124 bp, Homo sapiens
cccccttcccccttttttgtcccccaacttgagatgtatgaaggcttttggtctccctgggggtgggtgggggcagccagggcttacctgtacatttactttagaccaattggaattaaagttc

SEQ ID NO: 4248 - DNA, 150 bp, Homo sapiens
gttttctttacagagaatgatccttttaaggcttgtaaggccctctggtttggacaaaaaccctcagttagagacaaagccgggagggattatttagctgaaagctatgatgatatatataaaaccagctctctatcccaatacgcacct

SEQ ID NO: 4249 - DNA, 150 bp, Homo sapiens
ggagtagttaccataagaacctgttagctagcagtgattatgaaggcactgttattttatgggatggattcacaggacagaggtcaaaggtctataaggggccatgagaaggggttttggagttttgactttaatttgatggttcccaaa

SEQ ID NO: 4250 - DNA, 180 bp, Homo sapiens
gttgcatagactagtcctatggaaaaaaccaagcttcgttagaatgtctgccttactggtttccccagggaaggaaaaatacacttccacccttttttctaagttttcgtctttagttttgatttttggaaagatgttaagcatttatttttaggtaaaaataaaaactaatttcatact

SEQ ID NO: 4251 - DNA, 210 bp, Homo sapiens
caaatgtcaacgttcattatcaactaaagaagtggtttcagaatggcatccacaatttacaaacctgttgttttaagcagggcatttaccctaagggaaatgtcttctttgagaaaaaatttgggaattgtcaaaccaaaaacaattgaaaatcttgcccaaaaatcttgtgtccctttccccggatgtcttctgggtatctcgggccct

SEQ ID NO: 4252 - DNA, 207 bp, Homo sapiens
cgaggccaggtctccagctggggtggacgtgcccaccagctgccgaaggccaaggacggcaaggtcccggtgggacggtaaacaaaggcagggaaaatgaaaattggttcgggtgtttacgggcgagggacaaagggagggcgcggttccgcccctttcttaaaaaaccttaagggcttggttggggcttccgcaaaaaagcgcggg

SEQ ID NO: 4253 - DNA, 175 bp, Homo sapiens
ggacagtcagttttagggttgcctgtatccagtaactcagggcctgtttccccgtgggtctctgggctgtcagctttcctttctccatgtgtttgatttctcctccaggctggtagcaagttcttgatcttatacccaacaaaaagcaacatccagaaataaaggtctctaggcc

SEQ ID NO: 4254 - DNA, 150 bp, Homo sapiens
gttatctatacacagtgtaagatttaacaaactgaaatgatccacctcatatgtgagtccgtccaaaagatgttactgctctgggtgggccagtgttctatatcggttatactaactttcatttaaagtatttattctaaaatgcccctg

SEQ ID NO: 4255 - DNA, 325 bp, Homo sapiens
cgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtgcctctgcaagggccgagaggtgtacccgcatttcggcaaggccccaggaaccccgcacagccacaacaaaccctatgtgcgctctaaggggcggagttcgagcgtgccaaaagccgacgggca

SEQ ID NO: 4256 - DNA, 368 bp, Homo sapiens
gaaataataagccaccctgggtgtaaacttgattttctttattgagatgtatcatgtattgaatgagtgaaccagaaaattagaagatggtcaaaaaaagtccaagttaccaattttttaaaatttataggcaaagtatcaaattgtcttcttaatatgataaactgtgctttatcattctgaaaactcaggatacagcttattcatagcattgtgggtctctccagtaagacagatgctaaaagttttgtgcactctttgtgtgtgtaatgcacattagttaaaacacatagttttggagagagttaaaactagctctagagtaaggatgagaaactcgagtgtttttaatataaagataaaagcct

SEQ ID NO: 4257 - DNA, 333 bp, Homo sapiens
aagagactggatgctgcttatcgttccatgaacgggaaaggccccgtttacttacttttcagtgtcaacggcagtggacacttctgttggcgtggcagaaatgaaatctgctgtggactacaacacatgtgcaggtgtgtggtcccacggacaaatggaagggtcgttttgatgtcaggtggagtttttgtgaaggacgttcccaatagccaactgcgacacattcgtctagagaacaacgagaatataaccagtgaccaactctagggacactcagggaggtgtctctcgagaaggctaagcaggtgttgaaaattatagccagctacacgc

SEQ ID NO: 4258 - DNA, 250 bp, Homo sapiens
ccgaccctgccgatgtggccatccagctgaccttcctgcgcctgatgtccaccgaggcctcccagaacatcacctaccactgcaagaacagcgtggcctacatggaccagcagacttgcaacctcaagaaggcccttctcctccagggctccaacgagatcgagatccgcgccgagggcaacagacgcttcacctacagcgtcactgtcgatggctgcacgagtcacaccggagccttgggcaagacagt

SEQ ID NO: 4259 - DNA, 210 bp, Homo sapiens
tggagatgaagagcaggagaatgaagtcttttctctcttaatgtttaatcagcattaacgcacctttaagtgccattggatttagagcagtgttgttattaaagcaaactaaattgtcttgaagtgtagaaagcacttttagaaaaagaagcaaggttaggcttagagaacaagacagattaaggtacttctcttagcttgaaaagatct

SEQ ID NO: 4260 - DNA, 137 bp, Homo sapiens
tcagtctgcattttcgatcatgggctacatgccgagtgctggggcacagagatgacacaagatcgggttccttcacttctttcatgccacaagggtttattgagcaacctgttgttgccaaggcctcacaagattcc

SEQ ID NO: 4261 - DNA, 140 bp, Homo sapiens
gcaaaatacagtgccttcaaaatgattctctgtgtgaattgcatgcactttcatgtaaccatagagtgtaacctgtatgtgcatgaccatgtgtctggagtgtgttaaggtataggatacagcaggagggggccttggcc

SEQ ID NO: 4262 - DNA, 170 bp, Homo sapiens
cggcacgagcccagatgcgcctgcttcctctgcgccagaagaaggcccacctgatggagatccaggtgaacggaggcactgtggccgagaagctggacttggccccgcgagaagcttgagcagcaagtaactgttaaccaagtgttttggcaagatgaggtgatccgagt

SEQ ID NO: 4263 - DNA, 188 bp, Homo sapiens
taaacattcatattgttttcaaacttggaattcatagacactctggctctaggttccttaagggggaaaacaaaagatgactttatttcacattcaagaaaatcagttcagttccaaagctgtgggtccttccagccacttctagggacactggggaaccttgttaaacgttgacatcagttctctcc

SEQ ID NO: 4264 - DNA, 370 bp, Homo sapiens
ccaacatccagtattttatcttgactgtcctaaccttaccttagatgctaacagaagggtcctgctgaaataacactgggtgctatattgatgggtaaatgtgtacatcctattccttcctctttatcttacaattttttgtcttccccttaggcaaggaggtaacttaccatttcggctacttttaaggaattacttttgtgaaaaccctttaggaaccccgtgttgtgtttcaatgtggggtaattgggcccaagggtggggggccattttttttgggtcttctaggagggaaaaccatcttgtgtcaccatttttgatattaagaggttatggggacatcaacggcatcgaaaagggctacttctta

SEQ ID NO: 4265 - DNA, 104 bp, Homo sapiens
cggcacgagagtacttctagagcggccgcgggcccatcgattttccacccgggtggggtaccaggtaagtttacccaatttcgccctatagttagtcctatttc

SEQ ID NO: 4266 - DNA, 282 bp, Homo sapiens
gtcagacaggaggcggcatgacttgaaacagagtgcagtgccctctgactgggctgatgtgtttatttgggtctactgaaaaataacacagatgattcaaatgtttgagctgtataagaccaaaagtgtttggcctcacctcagtcagaggcatctgtggggcttgagcatggtactcaagtgaaggagttctcaggatagggggcaacagtgtccagtgtaggctgagaatagacccaggatttccaggcccagctaggagaaagttggcaggaaagcggg

SEQ ID NO: 4267 - DNA, 355 bp, Homo sapiens
gcaagatggccgggtgaaaaaagttgagaagccagatactaaagagaaggaaacccgaaggccaaggaaggttgatgctggtggcagggtgaaaaagggtaacctcaaagctaaaaggcccaggagggggaggccccattgcagccgcaaccctgtccttgtcagaggaattggcaggtatccccgatctcccatgtattccagagaggccatgtacacgaggaagtactcagccgctaaatccaggttgaaaagaaaaagagggagaggttctcgcacctttaacaaaccagttggtggtgacagaacggcggtccccgggtggttaacctgcgcaaatgcctagatattatcc

SEQ ID NO: 4268 - DNA, 350 bp, Homo sapiens
ggccgcgttcgcaccaaacccgtgaagaaggcggcccgggtcatcatagaaaagtactacacgcgcctggccaacgacttccacacgacaagcgcgtttccgaggagatcgccattatccccagcaaaaagctccgcaacaagatagcaggttacgtcacgcatctaatgaggcgaattcagagagccccagtaagaggtatctccatcacgctgcaggaggaggagagagagaggagagacaattatgtccctgaggtctcagccttgggttcaggagattatggaggtagatcctcacactaaggatatgctgacgcttttggcctccgccagtctctcacccttcag

SEQ ID NO: 4269 - DNA, 301 bp, Homo sapiens
tcacagattatctttggggccttttcattagaaagctgtttgtttgtccccctgttggtacatttgggttacctcattttgccgtttcagattgtgaaagctcacagggggtgtttttggaatcatttgctggagtcattttctcaaatcatattccattgtatcagttaacatatagttttaaatgtatgtatttataaatatctgtaaccaaatcatttgaggccttgataatatttttaacacgtttgtacattttttatgagagttactagtaatgctttactaaggtgtgcaatga

SEQ ID NO: 4270 - DNA, 351 bp, Homo sapiens
gactgaggaagacccggaaacttagggggccacgtgagccacggccacggccgcataggcaagcaccggaagcaccccggcggccgcggtaatgctggtggtttgcatcaccaccggttcaacttcggacaattaccacccaggttactttgggaaagttggtatgaagcattaccacttaaagaggaccagagcttctcccaactgtcacctagacaaattgtggactttggtcagtgaacagacacgggtgaattctgctaaaaacaggactggggctgctcctatcattgatgtggtgcgatcgggtctactacaaagttctggaaagggaaagctcccaaagcagcc

SEQ ID NO: 4271 - DNA, 353 bp, Homo sapiens
gtcgagccaagactcgcggctacgagcacgtcgacatccagaacttctcctccagctggagttattggatggccttctttgccctggtgcaaacttttttcccttaggccttcggcttatggcaagtttagcccttaagacccgcgggcaagaccttggaggtgccttttaatttccgggagcccatgcggactcccgaagctcctggatacagaggacatggtgcgtcttcgagagcctcactggaggtgcgtatacacgtacatccaggaattctaccgctgtctggtccagaaggggcctggtaaaaaccaaaaagctcctacccccttctcggggccccgasgtatcct

SEQ ID NO: 4272 - DNA, 156 bp, Homo sapiens
taaggactgtatttatttattaatttaagacagaatcttgccctgttgcccaggctggagtccaatggcgtgatctcaagctcacttcaaacccccgctttcctggggtcaaagtgattttttcccccccaagctactccgaaggctgaggaaggg

SEQ ID NO: 4273 - DNA, 260 bp, Homo sapiens
gtgaaatgtattatcaccagcagacactgccgggcctccctcccgggggcactgcctgaaggcgagtgttggcatagcattagctgcttcctccccttctggcacccactgtggcctggcatcgcatcgtggtgtgtcaattccacaaaatcgtgtgttcgtggaaccagtcctagccgcgtgttacagtcttgcattctgtttgtctcgtgggggggaggtgacagttcttcggaaatgtgtcttgtctccaatttggr

SEQ ID NO: 4274 - DNA, 137 bp, Homo sapiens
ctggagcataatgaagtggaaccgtgagcgcaggcgcctacaaatcgaggacttcgaggctcgcatcgggctggttgccactgtttacaggcagaaaccgaccgaaggaccctgccagatgtttcggggggaaccgg

SEQ ID NO: 4275 - DNA, 335 bp, Homo sapiens
ggatgacgtcatgcttctggacaccttggaccaggtctttgtcttggttggaaaggattctcaagaaggaggaaaagacagaagccttgacttctgctaagcggtacatcgagacggaccagccaatcgggatcggcggacgccatcaccgtggtgaagcaaggctttgagcctccctcctttgtgggctggtttccttggctgggataatgattactggtctgtgaccccttggacaggccatgctaagctgctccctaggaggggcaggccacccatataccgatcagtgcttttgactgttctccataaagaggctagagcagaagagcagc

SEQ ID NO: 4276 - DNA, 114 bp, Homo sapiens
gcttgccacaattcccggggacaattgattccagacatcttggccgccccccaaaggtatgcttttcacctttcgaaaggagagctgttgttctgccggacccccgaggaaaac

SEQ ID NO: 4277 - DNA, 115 bp, Homo sapiens
ggcaaacatggaaaccctggtgaaacttgtccttctcgtcctttggggtctcctggtttctgtttgcccaagaggttctcagttgcccacaaggcattttgttgcgcataaggga

SEQ ID NO: 4278 - DNA, 200 bp, Homo sapiens
tgtgagtccaactcttctaaaggaacctctcttggcaacccagcagggaaaggaaggcaaggaggaaccaaacaatctacttgttccttcttcccagtttttagcaaagatgaaaggacttcccttcagttgccatatagaaactctttaatttttcaccaaggcagagaccctctcattttcataacaaattgtatacc

SEQ ID NO: 4279 - DNA, 108 bp, Homo sapiens
agagcagctacgaaacaagccttctgaccttggcacgaaactacaagattcccggatcatgaacactcttagcgttctccttggggtcgatcttggcagtattgatga

SEQ ID NO: 4280 - DNA, 135 bp, Homo sapiens
ttttgctgagatggctgccagtcttaagcgtccagactcaggtgcacttggctttcttcggagggcttgcccttctgtggtcccccggcccttctgtgagagagatgtgtgtttccacagccagatatgggagat

SEQ ID NO: 4281 - DNA, 150 bp, Homo sapiens
gctgttcatacggcagttattcttggattccgtcgtaacttaaagggtaattttcacaatgtgccgagtgcctttattgattcctcaaattaaggagggggggtgttcctttaggttcctgcaggaggggacccacttttaggtgcacac

SEQ ID NO: 4282 - DNA, 110 bp, Homo sapiens
gctacttcctttgtcaccactgctgaacgtgaaattgtccgtgacattaaagaggaggctgttctattgttcgcccttgaatttgaggattaggttgcccacacttgctc

SEQ ID NO: 4283 - DNA, 110 bp, Homo sapiens
attcagttctgtagagttagaataccgtttgttgttggagatgtgagttgagtattagaatggtacaatagagtgttgaatgcaattgtgggtgcaattgtgataaatag

SEQ ID NO: 4284 - DNA, 151 bp, Homo sapiens
ctcgtgcgaattcggcacgagagcagacagcatgagccacggagcccagcaagccttgaggagaaccattggaatctactctaaagccacttgcttcggcccttgcttgtaatgcttcggataaggtcatcgagcccattcagtgcccgct

SEQ ID NO: 4285 - DNA, 133 bp, Homo sapiens
gcaactagcaaaaatctgcataatgcaacaacacagttttcacacttcaaattttacatgaggggttcttcacggttcttcttggacccagtcttgcaaaattagaggggaaggccctatgggagatttattt

SEQ ID NO: 4286 - DNA, 145 bp, Homo sapiens
ctctccagatggatccctctgtgcttctggaggcaaggattgccaggccatgttatgggatcttaacgaaggcaaacacactttacaaggtatgatgtgtgtgggacatcatcaacggcctgtgtcttcagaccctataccccgt

SEQ ID NO: 4287 - DNA, 160 bp, Homo sapiens
ttttttgtattttctccataattattgtgatgttatcaacatcaagtaaaatgctcaatttcatcaattgcttctgttcaagttttcttgaacacaggcttcaattttccttccaaaatgctgcatgccacacttgaggggaacggggcagaagggattt

SEQ ID NO: 4288 - DNA, 157 bp, Homo sapiens
aaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactctt

SEQ ID NO: 4289 - DNA, 220 bp, Homo sapiens
gtcacctcaaggtgcagcccttttgcacttaagtggatctcctggcatgagttggctgagtgagtccttggtccagcccagagccacagcctttgacctcttggagcagccagaacttttgtgaccccatgttcaggggccagctgcccagttttggtaaggagcatttcttggacctgacagatagaagcttttagcatggtcacttttaggagggcct

SEQ ID NO: 4290 - DNA, 270 bp, Homo sapiens
tggaagtgacatcgtctttaaccctgcgtggcaatccctgacgcaccgccgtgatgcccagggaagacagggcgacctggaagtccacctactttccttaaggatcatccaacttatttggatgattatccgaaatgtttcattgtgggagcagacattgtggggctccaagcagatgcagcagatccgcatgtcccttcgcgggaaggtctgtggtgctgatgggcaagcacaccatgatgcgcaggccatccgagggcacctggaaaa

SEQ ID NO: 4291 - DNA, 163 bp, Homo sapiens
ctcgtgccggcttaatgaacatttttaaaaataattaccaaggcctcccttctacttgtgagttttgaaattgttctttttattttcaggggtaccgtttaatttaattatatgatttgtctgcactcagtttattccctacttaaatcttaagccccatggt

SEQ ID NO: 4292 - DNA, 215 bp, Homo sapiens
ttttcttatgaccacattgtacaaatgaatctgtgttaaaaagactattttaaatgtatttcctgcttttgtaagcattaaagatttataagaaaattattcaaactattttttataaaatgaaagttatgatttttaaacttattgattccccttgcccctaccccctctttttggaagatattttgattccttataaacttttaccccaagct

SEQ ID NO: 4293 - DNA, 305 bp, Homo sapiens
gcgccggctatgccctgtattggattgccacacggctcacattgcatgcaagtttgctgagctgaaggaaaagattgatcgccgttctggtaaaaagctggaagatggccctaaattcttgaagtcttgtgatgctgccattgttgatatggttcctggcaagcccatgtgtgttgagagcttctcagactatccacctcttgggtcgctttgctgttcgtgatatgagacagacagattgcggtgggtgtcatcaaagcagtggacacagaaggctgcttgagctctgcaaggtcaccaagtct

SEQ ID NO: 4294 - DNA, 233 bp, Homo sapiens
ctttaccagaaaaaacatggtattaaactctataaacctctcattctccctgtgactcaggccccaatcttcatctccttcttcattgctttgagagagatggccaaccttcctgtgcccagcctgcagacaggtggcctcttgtgggtccaggatctcacggtatccgatcccatctacatattaccactggcagtcactctctacaatgtggggctgttcttgagctatgg

SEQ ID NO: 4295 - DNA, 180 bp, Homo sapiens
tcgcttcgaagcgaaaagtcctaatagtagaagaaccctccataaacctggagtgactatatggatggcccccaccctaccacacattcgaaggacccgtatacataaaatctatgacaaaaaagggagggatcggacccccaaagcttgtttcaagccaaccccattggcttcatgact

SEQ ID NO: 4296 - DNA, 190 bp, Homo sapiens
gagaggctgagggactcactggagggcaccaaggcagcccacagccagggaaggttgggagggggggcggaaacccatgcctcccaactgagcactgggaatgtcaacccaataagtattggccagatcaagcgcctcgtggtcagagcagagccaccaagtgccactgtcccgagacctgcacaaacct

SEQ ID NO: 4297 - DNA, 198 bp, Homo sapiens
cgggtgacgtccaggagagggagcgccctggctgcccctcggccgccgactggacgcgcgggccttgccagcgagcaccctcatcgggctgtcgctgacagcatacctcaaaaggccctagctaataaacctgtaagcccagcatttgagagaaggtagggtgtgtatatataaaaggttgtgtacaactccacgagg

SEQ ID NO: 4298 - DNA, 117 bp, Homo sapiens
cttaggtgcacagctgttcaatatacacagagaacagaaatattcctactgtctttggaaacccttggtgtacctcttagttggcaggaataaacatcaacacaggttcaaggactt

SEQ ID NO: 4299 - DNA, 89 bp, Homo sapiens
agtacttctagagcggccgcgggcccatcgattttccacccgggttgggtaccaaggtaaggtttacccaattttggcctatagttagg

SEQ ID NO: 4300 - DNA, 139 bp, Homo sapiens
ttgggagtcttccaaaccaccttccctcatctttcatcaatcattgtacagtttgtttacacaacgtgccattttggtttgtgcctcctaatatttattggccttattaaataaacccagccccaggctttgcaaccct

SEQ ID NO: 4301 - DNA, 160 bp, Homo sapiens
tctagggccaccaggctgaggactcgcccaggacaagagacttgtctctcagacccctggggccaacaatgtaaggccaacaacttcaaggccgttggaatttcccccaacatttggggagcaaagcttatttcccaaaatgtcttttatacccttttga

SEQ ID NO: 4302 - DNA, 95 bp, Homo sapiens
aggagctggggtggsccctgagctccaacggccataacagctctgacttccacggtgagggccaaccttttgggtgcaaccccaagttgggtgtg

SEQ ID NO: 4303 - DNA, 136 bp, Homo sapiens
ccacctgtaatcctagctactcaggaggctgaggcagaagtgcttgaatccaggaggcagaggttgcagttagccagcagattgttgccaatggacttcagcccttgggcaaccaagcagcaaaaacttcctctca

SEQ ID NO: 4304 - DNA, 206 bp, Homo sapiens
gagtaaaaccttttatgacaggggctgcagaacaaatcaagcacatccttgctaatttcaaaaactaccagttctttaattggtgaaaacatgaatccagatggcatgggtgtctctattggactaccgtgaggatgggtgtgaccccatatatgacttttctctaagggatgggttagagatagggaaaatgcttaacacactgt

SEQ ID NO: 4305 - DNA, 172 bp, Homo sapiens
gatgcccaggatttgactcgggccttagaactttgcatagcagctgctactagctctttgagataatacattccgaggggctcagttctgccttatctaaatcaccagagaccaaacaaggactaatccaatacctcttggattttatttaatgtcataatgttgtcagaat

SEQ ID NO: 4306 - DNA, 325 bp, Homo sapiens
caaacagaagctttattcgagaacaggtgaatcagttgaatttgtgtgtaaacggggatatcgtctttcatcacggttctcacacattgcgaacaacatgttgggatgggaactggagtatccaacttgtgcaaaaagatagaatcaatcataaagtgcacacctttattcagaactttagtattaaatcagttctcaatttcattttttatgtattgttttactcctctttattcatacgtaaaattttggagttaatttgtgagaatgtaattataagctgagaccgcgtggctctcttcttaaaagcaccatattaaatcct

SEQ ID NO: 4307 - DNA, 334 bp, Homo sapiens
tgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaacactgtatgatggttgtgcgtccagaaaaggctattaaaagactgtcattgagatcaatacaccaaaaattgatcaagtacctattgttgatgtcatgatcaatgacttttgtgatcagaatcagaagttcggatttgaggttgggctctttgttttctttgctaagattaagaca

SEQ ID NO: 4308 - DNA, 283 bp, Homo sapiens
ggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctgatgttcccctgcaggagcaggttcttgggagccgtgaggcaggaggacaattaggtcctgaatctcctgcaaaaatggtctgcctggaggccctaggccaacagaatctcagtaaacacgctgtcacccctgg

SEQ ID NO: 4309 - DNA, 312 bp, Homo sapiens
aacacttatgtgattgagccattgcataaaattactattaaagcctcatcttgattttatagggattggctattcatcatggctggagacttcctgaatataccctttcccaggagggaggacctctctcataagagagaatatactacaatttgcaggctagagtcatttatggagactggacaagggggcatcaaaaaagcaagccaaaaggaatgctgctgagaaatttcctgcccaatttagtgatatttctccgagaccccatatctctaacacatgtagtaggcatactctagggtgtactctgca

SEQ ID NO: 4310 - DNA, 246 bp, Homo sapiens
ttgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaagggttgtgccacatagacaatatgttactaaatcagcactttaaaatca

SEQ ID NO: 4311 - DNA, 265 bp, Homo sapiens
gacacccacccacccagtgttatattctgcctcgccggagtgggtgttcccgggggcacttgccgaccagccccttgcgtccccaggtttgcagctcttccctgggccactaaccatcctgggcccgggcttgcctgtctgacctccgtgcctagtcgtggctctccatcttgtctcctccccgtgttcccaatgtcttcagtgggggggccccctcttgggtgccctcctctgccatcacctgaagagccccacggccaaacac

SEQ ID NO: 4312 - DNA, 160 bp, Homo sapiens
agtgtaaaaataagtatttacatagaaagacagactgaatggatgcacggtgaatgcatgaatgattgaacgacagacaagatttgcattgaccgatgaggagggcattttagagagggatgagggtcattgatccttgggtgcagatcttcaaaagaat

SEQ ID NO: 4313 - DNA, 235 bp, Homo sapiens
gcaggatcaaggtgaaaaggagaaccccatgcgggaacttcgcatccgcaaactctgtctcaacatctgtgttggggagagtggagacagactgacgcgagcagccaaggtgtttggagcagctcacaagggcagacccctgtgtttttccaaagctagatacactgtcagatcctttggcattccgagaaatgaaaagattgcttttcacttgcacagattcgagggggccaag

SEQ ID NO: 4314 - DNA, 195 bp, Homo sapiens
ctcgtgccgaattcggcacgagtatgtgtgcttctgtttatgttgtcatcactcattccttcccctgtcctatttgggagggctctaaatggatcttctaacttataaatgtcaaatatatttttggtattagagtgtgcctatgatgagagaaatcttaaatgtatattttatgtatgctgacacattttatta

SEQ ID NO: 4315 - DNA, 102 bp, Homo sapiens
ccgtccctggatgctgtccggagcgatccggcagccagcttcttggaccatcaggggcggggaccctcctggcgcttccggagaagcattgcttagcacttg

SEQ ID NO: 4316 - DNA, 205 bp, Homo sapiens
gagccgcaggcccgtaggaggccattggcgcccagccggaatggcatggtcttgaagccccacttccacaaggacttgcagcggcccgttggccaagttgtttcaaccagccggcccggaagatccgcagacgtaaggcccggcaagccaaggccggccgcaattgtttcgggcccgggttgggtcccattccggcccattgctc

SEQ ID NO: 4317 - DNA, 250 bp, Homo sapiens
cacgctgcagtacgcactggcctgtgtcaagcaggtgcaggccaaccaggaatactaccagcagttgagcctggaggagggcgagccttgctccatggacatgtccacctattaccctggaggagcttggagcacaattacgtgtttagtacaacctttagaaccaggtcagcggcggcctggccttttaatcccgacggaaccctattccttttcccaaaatctttgaatttctctttgtctccccctc

SEQ ID NO: 4318 - DNA, 228 bp, Homo sapiens
gaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagcgttaggagcgggctgctgagagctaaacccagcaattttctatgattttttcagatatagagaataaacttatggtcagcc

SEQ ID NO: 4319 - DNA, 315 bp, Homo sapiens
ctcgtgccgaattcggcacgagcaaagcagcagctgtattgccgcagttctagcttcaccctcacgatgtttcccctggtcaaaagcccactaaaatcgtctcccagttcgaagcattcagccaacaatggcaaggcagagccacccgaaacgtacaactgattttcatgacaaatacggtaatgctgtattagctagtggagccactctctgtattgttacatagacatatgtagcacacaagtcgggatagaatggagcccgtcccctgttggcagagttaccccaaagggatggaggagtcagtaatcatcc

SEQ ID NO: 4320 - DNA, 262 bp, Homo sapiens
gaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactatttttatatattgatgcccacttgtt

SEQ ID NO: 4321 - DNA, 286 bp, Homo sapiens
tcttgacgaggctgcggtgtctgctgctattctccgagcttcgcaatgccgcctaaggaccgacaagaagaagaaggacgcttgaaagtcggccaagaaagacaaagacccagttaacaaatcccgggggcaaggccaaaaagaagaagttggtccaaaggcaaagttcgggacaagctcaataacttagtgcttgtttgacaaagctacccatgataaactctgttaggaggttcccactcattaaacttattaccccagctcttggctctcagagactttagag

SEQ ID NO: 4322 - DNA, 272 bp, Homo sapiens
ccactcttaatcagtggtggaagaacggtctcagaactgtttgtttcaattggccatttaagtttagtagtaaaagacttgttaatgataacaatgcatcgtaaaaccttcaggaggaaaggaggaatgttttgttgacccattttggtttccttttttgcgtgtcgcagttttaaggtattagtttttaaaatcagtacttttttaatggagacacactttgacccaaatttgtcacacagttttgagagccctttaaaagtgtatgtgag

SEQ ID NO: 4323 - DNA, 346 bp, Homo sapiens
ttttcaaagaggggaaatatgaaagagcaattgaatgctatactcgagggatagcagcagatggtgctaatgcccttcttccagctaacagagctatggcctatctgaagagttcagaaatatgaagaagctgaaaaagactgcacacaagccacttttattagatggctcatattctcaagctcttgacacaagaggactccaagaacacattttgggagagctaaatgaggcaaaacacgatttttgaaactgcttttacttctcgagcctcgagataagcaagcagtactcactctccacaattaaaaaggagttattttaggaaggccactagggatgagga

SEQ ID NO: 4324 - DNA, 203 bp, Homo sapiens
gaaggtgccctgtgtcttccttaattcctggcacaatatgagagctgcaccagcgccggccgcagtgacggaaagatgtggtgtgcgaccacagccaactacggttgacgacgcaagtagggcttcttgccttgaaccaagggtacaagcctgttcctggtggcagccacgagtgtttggccaagcattgggtctgagcgact

SEQ ID NO: 4325 - DNA, 108 bp, Homo sapiens
caacagtggaagccagtagagtgctatcttgaatgttgatgaaggacaataactgcctacctaggattctaaacccagtgaaatatatgtcagattgagggctaatta

SEQ ID NO: 4326 - DNA, 190 bp, Homo sapiens
gcgttctctagcacacctgccttgttggtactgctcggcgtggaatgcctctcgggctctgacagtgtcattgacactgttgctgatctccttggatttacctggtccatttggatcaagttctttcacctattcacatgagcagatatcaccttaaaaccttaaaggttggcttaacacttctcgccct

SEQ ID NO: 4327 - DNA, 212 bp, Homo sapiens
cggaagacctcttatgctcagcaccaacaggtccgccaaatccggaagaagatgatggaaatcatgacccgagaggtgcagacaaatgacttgaaagaggtggtcaataaattgattccagacagcattggaaaagacatagaaaaggcttgccaatctatttatcctctccatgatgtcttcgttagagaggtaaaaatgctgaagagccc

SEQ ID NO: 4328 - DNA, 195 bp, Homo sapiens
acgagggatggcccctccgggaaaactgtggcgtgatggccgcggggctctccagaacatcatccctgcctctactggcgctgccaaggctgtgggcaaggtcatcctgagctgaacgggaggttaactggcatggccttccgtgtccccactgccaccgtgtcagtggtggacctaacctcccgtctagaaaaa

SEQ ID NO: 4329 - DNA, 212 bp, Homo sapiens
aagaagcactaacatagctgcagctgccagtgagccacactcctgagacactctctatattgcctgcactcctgtaacaaccataatttttccatttcattgtatggtgtttggccattgttggcctgtggattcccttagagtgtaagtctgtttgttttcaattgtctgaccttcagcaggagatgtgatacaacttgggcactaaggga

SEQ ID NO: 4330 - DNA, 213 bp, Homo sapiens
caacagcttttgccactcgacttttccaacatttttgttattggcaagggcaacaaaccatgggatttctcttccccgaaggaaagggtatccgcctcaccattgctgaggagagagacaaaggactggcggccaaacagagcagtgggtgaaatgggtccctgggtgacatgtcagatctgtgtacgtaattaaatatattgtggcaggaga

SEQ ID NO: 4331 - DNA, 215 bp, Homo sapiens
gtctcacagaaagttctccgctcccagacatgggtccctcggcttcctgcctcgggaggcgcagagcagggcatcgtgggaaggtgaaagagcttccctaaggatgacccgtccaaggccgggtccacctaacagccttcctgggttacagggctggcatgactcacatcgtgcgggaagtcgacaggccgggatccagggtgcacacgaaggag

SEQ ID NO: 4332 - DNA, 135 bp, Homo sapiens
gaagtgccatccaatgccacctgtccatggaggagtggccctgcagcttccacagctgcatgacctgcttcccacccaasggtgtcgttttgttttaaaggtaactgtcctaataacaagcaagccttaaggtcc

SEQ ID NO: 4333 - DNA, 275 bp, Homo sapiens
ggattaagagggtttttcttaaatattagcttttaatgtgtacaattaggaaattttttttaagtgaaggactctctacccttgccgtatctaaggagctgaggtaatacagatccaaggagaatttgtatagcaagaaaaaaccagtcacctacagaaactcttaaaaggataaaaacccaaagttccttattttgaaattgtcaaagacaaagcgggtgttttccttttaacaggtgatcacgtgtcgcgttcatactcaccggtaattaaag

SEQ ID NO: 4334 - DNA, 270 bp, Homo sapiens
cggcacgacttacagacacccttaccccccccactgtacagagaccaagacagaaattgtttgtaattaatggaccttattttttattattgccaatccccttagggtattggattttacaaatctgcctcttcccttgggccctcccttggtttatattttatgagggtaggtcgggcttttctggtcctgggcccagggaaagggggctatcctacccttacttgggaccccctgtgttgtcccaagcgctgtgggcttttaattcca

SEQ ID NO: 4335 - DNA, 140 bp, Homo sapiens
gcgacatggcaaacgtaccaggaagtcgggatcgtcggtaatacgggaccgctattgggccttccttccggaaattggtgaggaaatttgaattcagccagcaggccaaggtccatttccctttcctttggccaaaccag

SEQ ID NO: 4336 - DNA, 197 bp, Homo sapiens
gttgcagtgagccgagatcataccactgcactccagcctaggcaacagagcgagactcggtcaaaagaaaaaaaaaaaggggagctgggcgtgggtactaatgccgtaatcccaggcctttgggaatcccaggcaaggtggcctttagggcaaggagttcggaacctccctgctaacaggtaaaccccctttccctt

SEQ ID NO: 4337 - DNA, 113 bp, Homo sapiens
ctcgtgccgaattcggcacgaggattactaccaaccgtcactatgatgaggactctgccaattgggtccccgggagccccttacggctttaggcattgggccaagcgtcaact

SEQ ID NO: 4338 - DNA, 160 bp, Homo sapiens
caaacggtagttttgtgtgttggctgctccactgtcctctgccagccttcaggagggaaaagcaaggcttacagaaggatgttccttcaggaggaagcagcactaaaagcactctgagtcaagatgagtggggaaccctctcaataaacacattttggat

SEQ ID NO: 4339 - DNA, 290 bp, Homo sapiens
gctgtttcagccaggaaggccaaaatcaagagtgagatgtagaaagttgtaaaatagaaaaagttgaggtttgtgaatcggttgttctttcctcacatttggatgattgtcataaggtttttagcatgttcctccttttcttcaccctccccttttttcttctattaatcaagagaaacttcaaagttaatgggatggtcggatgtcacaggctgagaactcgttcacctccaagcatttcatgaaaaagctgctgcttattattcatacaaactctcaccacgatggtg

SEQ ID NO: 4340 - DNA, 267 bp, Homo sapiens
cgcccagggaaagcggcgttatgacaggaagcagagttgctattgtgggcaaactcaagccgattttccggaaaaaggctaaaactacaaagaagattgtcctaaggcttgagtccgttgagcccaacttcagatctaagaggaatcctggctattaaaagatgcaagcattttgacctgggaggggataagaggagaaaggcccaagtgatccagtcctaggtgtcaacttttattatgaggcaataaaatcttaagtttatgttc

SEQ ID NO: 4341 - DNA, 195 bp, Homo sapiens
cgcggcacctgtacctccggggtggcgctggggttggctcatgaccaagatctatgggggcgtcagagaaacggcgtcatagcccagccaattcagccgagcgtccaagatgttgcccccccggtcctccaagcccttgaagggcttaaaattgtgtggaaaggccaagattgcggcccaaactctcaactctaa

SEQ ID NO: 4342 - DNA, 225 bp, Homo sapiens
tctcaatccagcacagcgaaggcgggacaggattcctctcttcattacagatgaggaaactggggtgtttggatggtggggggcatgcgcattgtccaagcccacacagagccaacattagagcccgggtctaagattctccccccctttacccccttccctgctccaaatattcccacactttcccacttttaggagattgcttcctctttttccaaatggcaa

SEQ ID NO: 4343 - DNA, 100 bp, Homo sapiens
ggaaaccagaggcattgacacagggttcgtagaagattcaagggccagatcttgattgcccaccattggtaatgggaggcaccaaaaaaccaaggcacat

SEQ ID NO: 4344 - DNA, 230 bp, Homo sapiens
gccgccgctaccaccgcgttcgggtgtagaatttggaatccctgcgccgcgttaacaatgaaggcagaggttcgaacgtgcccggctttcctccagcaagctgtcggacgcttgtggaggaaacccacactaacgagttcatcacctggagccagatggccaaagttttctggtctctggatgagcaacgtattgcaaaagacattcttcccaaatatttcaagcacaat

SEQ ID NO: 4345 - DNA, 310 bp, Homo sapiens
ctgagaccaacactacacttgacccttcacggaatccagactcttcctggactggcttgcctcctaccaacctcccaaccctggaacccctaagggccaaccagcagagtggagctgagctgtggacctctcgggcaactctgtgggtgtgggggccctgggtgaatgctgctgcccctgctggcagccaccttgagacctaaccgggcctgtgatatttgctctcctgacctctcactcaatcctcttcctttcctctgtggcttttcctgttattgtcccctaatgataggatattccctgctgccta

SEQ ID NO: 4346 - DNA, 245 bp, Homo sapiens
cttgccgaagacctctgaagtacgctggagctgtgttgtacaggtgctgtgagacctaccctattcagaattaaacctcactgcaaatttcctccatcacgagctaacaacactaatatacgtatttagcacctctcaggctttgccattggagacccatttctgtagggctaaggaacatttagacgtggtacttacttcaatttgacttgcgaaggtatcttagaacacccgctttggcttct

SEQ ID NO: 4347 - DNA, 208 bp, Homo sapiens
gcccttcgagcaccacgcaagaagatccatcgcagagtgctcaagaagaacccacttgacaaactttgagaatcatgttgaagctaaacccatatgcaaagtccatgccgccggaccaccattcttcgccaggccaggattccaaggctccgggtgggttagggcagcttcttcagagggcgcactcaaggccaaattgagttgagag

SEQ ID NO: 4348 - DNA, 200 bp, Homo sapiens
cgcccggctgagccgacattgccggcgtcttggcgattcggcccgacgagctccgctttcgctacagcatggtggcctactggagacaggctggactcagctacatcccatactcccagatctgtgcaaaagcagtgagaatgcacttgggccagaattcagagcaaatcctgaggagacttctggcagcaacgtaaaaa

SEQ ID NO: 4349 - DNA, 125 bp, Homo sapiens
tatctctacactgcaaattttgggtctcaatttttactgtgcctttgtttttactagtgtctgctgttgcaaaaagaggacaacattctctgcctgagttttaatttttgtccacaattaatttt

SEQ ID NO: 4350 - DNA, 208 bp, Homo sapiens
ggacacctctcctcctgattcccttggcaccttgtctttctgtctgtttacctgtctccctgcctgcccatcttgcatcttttgcagcccactctgacttccctcttgggggctgagagccaaccttgcctgcccccttctttcttgccttaagagtgttccctttagggttgggatagggggttcacgcgcttaaaccccgagcatt

SEQ ID NO: 4351 - DNA, 327 bp, Homo sapiens
gctcgtgccgaattcggcacgagggagttcagggaatcatcgtcgtgaacacagaaggcattcccatcaagagcaccatggacaaccttaccaccacccagtatgccagcctcatgcacagcttcatcctgaaggcacggagcaccgtgcgttacatcgacccccagaacgatctcacctttcttcgaattcgctccaagaaaaatgaaattattgggtgcaccacatatagactatttcctagtgtgagtcagagtccaaccgcatatgcgactctctttgcgccccgtgtcatatcccaaattaatgtccccacagagtgtgatt

SEQ ID NO: 4352 - DNA, 203 bp, Homo sapiens
ggtcactcagatgtgcaggtgttaatcttctctaaaagcctggtgatacagctcttgctttctgagcacactacggatcttggaaatactttgaaaatgtgtatacttagaatacttttgctgctaaggagaactttctctccatatgtcagagatagctgagaccaagtgatgtgtaggttttcagagaagcacagtgtgtg

SEQ ID NO: 4353 - DNA, 339 bp, Homo sapiens
catcaataagcttcatctctgggagggaaccttttttaatatatgagagctgtgataaaaaatgtttcagatgttttagtcaattgtgaaattttttcttaaggcaaattttctctttctatcagagttgtatatatactaagcgcccaagagacacattccctgctagagatgcactatattgagactctcgcgcacatgagactatactctgtcgtgcacatccacctctcatcatgtgagaactgctagtgtaaatataccccgatgctgctaacatcactacacagagtgtctctactactggcagcagactcatcatcttcataatatgatgca

SEQ ID NO: 4354 - DNA, 340 bp, Homo sapiens
tggagagctctgtagatgtctattagggccccttgtgtgcagagctgagttcaatttcctggatattcctgttaacttttctgtctcggtgatctctgtcaatgtgtgacagtgtgggttgtttaaagtgctctcccatatatatatgtgtgtgggggtctatagtgatctctgtagagcactctagagactctctctatgtgatctctggggctcccctatatgggggcgcatatatataggggagagagagcatcatcgttgtagagagcctccctaccaccatgatgatgatctcctccgttgtctctagatgattgttggtggaatgaaggctgta

SEQ ID NO: 4355 - DNA, 160 bp, Homo sapiens
ggttttccccatgctgttctcatgatagttaggtgagttctcacgagatcttattgttttacaagttacggttttccccgcttccttcttcccgcatgtgtaaggaggtcggttctttccctctcacactcttcacacaaccatattgtaaggttccctt

SEQ ID NO: 4356 - DNA, 135 bp, Homo sapiens
gtcatgacttggagccaacggggaagtgttcctcatcaacatcaagacactcaatgaggtggattccagcgcatgttaattgcggtgacttgcgctcaagagcgcgtggcactctagagcagggggctctgcata

SEQ ID NO: 4357 - DNA, 91 bp, Homo sapiens
gggatccctcatctgttcctccgggaccctggtgctgcctctaactgacaattcccttggggcttcctgtaacctctttgagagaggcctt

SEQ ID NO: 4358 - DNA, 190 bp, Homo sapiens
cagttctccatgcagaattgagacctagatgatcatctgcaatgaagsagttggatttgtgcttccttcaaatgtaaaatttaatttttggtattttgcatctctttttgtgaggtaaatttcacaatatttcagagatatgtagggcacacagagagtcacagagagagatctcacactacatgagaag

SEQ ID NO: 4359 - DNA, 230 bp, Homo sapiens
tttagacccgtgtattctagaaggggaagatacattttagatctgtctctgaaccttgatagaaaagtacaacttggccaagtgtggtggctcacgctgtaatcccagcacttttggaggctgaggcaggtggatcacttgaggccacagagttccagactagactcggccaacatagtgaaaccccatatctattaaaattacacacattagactcggcatgatagagg

SEQ ID NO: 4360 - DNA, 260 bp, Homo sapiens
aataccgttgatgtgaattattttaaaaggcaaaaccgtgctctttattttaaaaaacactgataatcacactgcggtaggtcattcttttgccacatcctatagaccactgggtttggcaaactcaggcagaagttgagacctttctagacatcattgtcagccttgctacttgaaggtacaccccatagggtcggaggtgctttcccattcccacggttgtccctaggtttaccctcactgctgggggtagcgttact

SEQ ID NO: 4361 - DNA, 310 bp, Homo sapiens
ctcgtgccgaattcggcacgagcttggttgggaggaccagagcctgtctcagggaatttgcctgcttgggtgatgcagggaggaaggtctagtgcagggaagagggggcctggctcagctgttcaccagcactttttgaccacagtctcgctactgcgggcccctgccctagaggtttagagcgatagacctccctctccctcgggggacatatctgggacacaggctctctcgaaatcgtctctcctgtcccagacacaggtttgagtctcagacgtctcgatctactgtagacgacgaagacgacata

SEQ ID NO: 4362 - DNA, 195 bp, Homo sapiens
ggagaaactggcaaggagaagctcccgcggtactacaagaacatcggtcttggcttcaagacaaccaaggaggctattgagggcacactcaatgacaagagaatgcccccttcactgtgtaatgtgtgtccatcgaggggcgcggtctctctctgcgcgtgtgtgcccagatataagagatcacagagagcccat

SEQ ID NO: 4363 - DNA, 235 bp, Homo sapiens
aagaaatccaggctcctcttccaagagattcaagtgctttccagactccaaagggtatcttagatgcaatctcttctctcttaggcccttgccaatttgttcctggttccgcccttctctctagaccatagttgaggacccacccttggagtctctcgagagactctccttcgtttcatatcttaaaacacatacacagatatcctctttcacatatacccttagacctatagag

SEQ ID NO: 4364 - DNA, 245 bp, Homo sapiens
catggctcaggctgcccaaggcttttctgtcacctcttttgttctctcacactgaccagtctttggcttaagctgacttaggagggtttttctgaattgtctaggatcctgcaattattttccttagctcccgccttgctcccattcacatttacacatgtgtaaaggttggggggtgagtgcccctctgagcgctttccgtttgtaatataagcacaggacacttacctctgctctaacgcata

SEQ ID NO: 4365 - DNA, 240 bp, Homo sapiens
ggcggaggtgcaggtcctggtgcttgatgtcgaggccatctcctgggccgccttgcgccaattcgttggctaaacaggtactgcttggcccggaaggttgttggtcgtacgctgttaaggcatcaacatttcttggcaatttctacagaaaccgttgaagtacccggcttttcctccttaagcgcgttgaacaccccacccttccccgaggcccctcctttccgggcccagaccaatctc

SEQ ID NO: 4366 - DNA, 280 bp, Homo sapiens
ctcgtgccgaattcggcacgagatgcctgatctgtacttctacagagattccgaagagattgaaaaagaagagcaggcttcttctgagaaggcagttaccaaggaggaatttcagggtgaatggacttctccccctccgtagttcacttctactcagagctctaggttgcagactcgtctctaaggtgtacagatgtccctctgtgtctcatatagcaattccctactgtaggagtcgtgcgctcagactctcacagagagtcgtcttcagatctcactg

SEQ ID NO: 4367 - DNA, 280 bp, Homo sapiens
gtgaaatcacttcatatatcatgtgctgtaaaataagaactagctgaagagacaaccaaagaagcattaaggcaggttgatgctgatgggacactaaaatatttttacactcaacctgagcgcgttattcttgacactcttaacagagattttttcaattgtgtttcagagactcttagtatatgcacatgtactctagagggggagttcacatctataaatgtcatatacccccctatatatatgtgatattttcatatgcacttctcttgccacatgc

SEQ ID NO: 4368 - DNA, 202 bp, Homo sapiens
gtttaagtgtctaacaaacttaaagctactgtagtacctaaaaagtcagtgttgtacatagcataaaaactctgcagagaagtatttccaataaggaaatagcattgaaatgttaaatacaatttctgaaagtgtatggttttttctctatcatctcgggatacacttgctctatattttataaatatatatttctcactgg

SEQ ID NO: 4369 - DNA, 127 bp, Homo sapiens
cctttgatttttataatgggtgggactgtatccctgcctcaccccaggtctccgtctgccccgccaggtaccccacagagaccaatgacattttgccacttgaacaataaataaagttttttgggaa

SEQ ID NO: 4370 - DNA, 315 bp, Homo sapiens
ggcgtcaaaggtgaagcaggacatgcctccgccggggggctatgggcccatcgactacaaacggaacttgccgcgtcgaggactttcgggctacagcatgctggccatagggattggaaccctgatctacgggcactggagcataatgaagtggaaccgtgagcccaggcgcctacaaatcgaggacttcgaggctcgcatcgcgctgttgccactgttacaggcagaaaccgaccggaggacctctcagatgcttcgggagaacctcgaggaggagggcatcatcatgaaggacgtgccccctcgtaaggtggg

SEQ ID NO: 4371 - DNA, 138 bp, Homo sapiens
gtctagcaaagggggaggcacttaaaaactttgttttggatgtgctgtgagaggagctgcattgccagcgcagaaccagaggatgggagtaaagggcaaggtactagcttggctgggtaaaccctttagggagccttg

SEQ ID NO: 4372 - DNA, 140 bp, Homo sapiens
ccttactactaataattattacaatttgactaccacaactcaacggctacatagaaaaattcaacccttacgggttcggctttgaccctatattccccggccgggttcctttcttcataaaaatctttcttagagaggta

SEQ ID NO: 4373 - DNA, 145 bp, Homo sapiens
cggcacgagtattggtactgttcctgttggccgagtggagactggtgttctaaaacccggtatggtggtcaactttgcttccgtaaacggtacaacggaagtaaaatctgtggaaatgcaccatgaagctttgagtttaagctct

SEQ ID NO: 4374 - DNA, 323 bp, Homo sapiens
gcctgcgagaatcgaggcactcgctggcgtacccatgtatcgaaatgagttcacggcctggtaccggcggatgtcggtggtctacgggatcggcaccttgtctttgttgggctcactcctttactatagccggacaattgcgaagtcgtcagtagagcacaaaggatgggctcaccaagtgaagtacccagtgaactctctctaacgcccaaaaggtttttattgtgggagacaaatgtcacaaatatagaggagtttgttccacatacagagaagatcctcacttctttgagatcatagactcgtggcccccgtacagcagc

SEQ ID NO: 4375 - DNA, 324 bp, Homo sapiens
gtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgccctttgggcaaggttgggacaaagccatcttggcagtcaggggcaaggactcttgtgaggagagttagcccaagtataggctctccccccatgccatcacatccctcatacttttgtatactttgaagcacctcccctccagaaggg

SEQ ID NO: 4376 - DNA, 135 bp, Homo sapiens
catgtgccgaaattggcacgagagcttttttcaccctgagggcgacctagcctgggcaagggcagcagcggaggcctaggagccaagcccctagacgaagcaatagaagcctcttttccagccatctatgtatct

SEQ ID NO: 4377 - DNA, 200 bp, Homo sapiens
tccagatcattcctacaaagtcaactgggagaataataagtctgccggagtgttgagtgctcccacaattaccaaggatgcttcctgggtggggtgttgagttgggacccttgtcaaggtgggccaagcctagtagagacccagtccactcaggtccattacacataggtggggctagggacagcgccctttggttacac

SEQ ID NO: 4378 - DNA, 314 bp, Homo sapiens
ctcgtgccgaattcggcagaggggccctcgggtgtgagctgcgcgaccgctctgagggttcgtggccaaccgttccttcgcggtccctgccgccaacgtccaaggttcaaggtttgtaggaaagattggtggttcggaacaagcgccatcgccgccggtttattgcggggcccttttcattggggtactaaatctacttcggcccgaaaaaggcggagtgaccccaacttcaggacaggcttcgagaaccgagaaagaaacagagctcccaaggagagcctgggctctcaagtactcacttaagatgctgagct

SEQ ID NO: 4379 - DNA, 330 bp, Homo sapiens
ctgccacatacaccacaaaaaccaaacatccccccaatgaccttagccccattgctccattcactcccaggtgaggattcaggcaaacgtccacaaaggtcacaggcagcgtacatacggttctgttataccccatatattaccccttcatgtctaaggaggacattttctttagagatttcattttagtgtatcttaaaaaaaatcttgtgtaaccttgcctccatcttttccttgggtgaggacaccaggattgaccttttgtgtctatgatgtgctgtcacagctctctgatagcctagtacatctggcacaggttactgtatctga

SEQ ID NO: 4380 - DNA, 175 bp, Homo sapiens
ctcgtgccgaattcggcacgaggaacgatgaggcagttacataataatagttaatggaaggtgtgctacagacattatcttgggtttctccctaactttgcccttcactggttgcttaattgtgaaccagccaaaggctttattgtcttggcttaattgtgtgaggtaacctacg

SEQ ID NO: 4381 - DNA, 343 bp, Homo sapiens
gaagacaatacccatctgatgatattttggagagtctgatcaaccaactcaagtaagcaagatgcaggaggatgaatttgatcagggtaaccaaggacaaggaggtaactccaattgcaggaattggagggggaaaatccatcggaccgtcaattaggcaattcaggaacctgattggcagagtcaagagggtaaacctggcctgagagtctatcagcacccacagagagacaagagaagagactgtttctgaggctctctcatggacctctcgatgatggtatcccacgccagaaatcatggagttgatgatgatgcgatgatgatgcgatgatgcgcacta

SEQ ID NO: 4382 - DNA, 160 bp, Homo sapiens
gttgtggagacggccttgagtctcggtccgagtgtccgtgagtgtgagccaccttgggcaaggtccctgcgccagggccccgcccgcccctccatcttgggcccggggtgactgggtccccggccttttgtccccggggccttaaccttccccttgcctg

SEQ ID NO: 4383 - DNA, 189 bp, Homo sapiens
tgggaagggagttgcttgtcacacggattcaggaactgctctccctcagctgggcttggggtctccaggggacctgagctacatgcaggttgttgagctggaaaggaaggtcctggactgtggcccagattagggctggggcagctcccgagagattgattgagtgctgttccctatgggaccttataa

SEQ ID NO: 4384 - DNA, 150 bp, Homo sapiens
gagaaatggaacacaaggagttacctatcactttcacttataatttcaaaagatgactacaaccatgtccatgctcaggattcaaacaggttttccatatcaccttttgggttggtaaggtgattttaccagtttttgtttttaaattgg

SEQ ID NO: 4385 - DNA, 244 bp, Homo sapiens
ctcgtgcgaattcggcacgagcaaggccctacatagaacatacagttgagtggggagtaaacaaaaagataaacatgcgtgttaattggctgttcgaggaggatatcggattaaaaagcctaaacagggaacaccttcatcacagtgtttgatgttggacacatagatggtgatggcacaggtttaggacacattattttcataggctaaatctataacccagagtaaacatcaatgctcagag

SEQ ID NO: 4386 - DNA, 260 bp, Homo sapiens
ggaaggcccaagttggagaatgatgtggagagtgtgccaagacactgcttttggcattttattccttctgtttgctggatgtcaattgacccttttcattttctcttacttgtgttttcagatattgttaatcctgccagtctttctcttcaagccagggtgcatctcagaaacctcctcacacagcactctaggcagccactatcaatcaattgaggtgacactctgcattaatctatttgccattaaaaaaaaaaaaa

SEQ ID NO: 4387 - DNA, 195 bp, Homo sapiens
cagccaccaacttaaaaaggactggacaatacttttaccactttcccttctcagaattcaggcctgtcctcgggaatgctacagggtacagcccatttgagctcctgtatggatactcctttttgttagggcccagtctcattccggacactagaccaacttaggactgtgcccccctcaaaaaaaaaaaaaaaa

SEQ ID NO: 4388 - DNA, 225 bp, Homo sapiens
ctgagacccaccttgctcataaacaaaatgcccatgttggtcctctgccctggacctgtgacattctggactatttctgtgtttatttgtggccgagtgtacaaccatataatagatcacctcttcagctaaaacagcgctcgtgccgaattcggcgacctgcggttcctcccccttcccatgctgccaacttcttaaccgcaatagtgactctgtgcttgactg

SEQ ID NO: 4389 - DNA, 265 bp, Homo sapiens
ggagacttcaggctgaactgaggcagagatatgtctctgagcctctgcacaaaaccagggaccagaaagcattgctcacccatgaaactataagctaaaacattactccaaattggtccaggactgacaaaacacacaagatcctagcagaggcaaatgtaaaacttcttcagaggtgatacctcttaaactaggaaaccagctcttggggaagctactaccccactgaagatgagcttacaataaatattatattccatccaac

SEQ ID NO: 4390 - DNA, 245 bp, Homo sapiens
aaaaataatatatacttgaccttagagtcgtaagcatacatattatactacataccatgggtcaggatgaaccacctgagtagtgaaagttgagaggaggacttagacctagggcactctaatacatggagatagagggatgagagagtctagcacaaaagagccaggctcagtcagcaaggaaagaagagaaccgggaagcatttccagaagacaagggaggaagatttttttaggaggaagga

SEQ ID NO: 4391 - DNA, 168 bp, Homo sapiens
gtcttagaggtgggatgcagatcttcgtgaagaccctgactggtaagaccatcactctcgaagtggagccgagtgacaccattgagaatgtcaaggcaaagatccaagacaaggaaggcatcccttcctgaccagcagaggttgattcttttcctggaaacaactggg

SEQ ID NO: 4392 - DNA, 260 bp, Homo sapiens
tttctttatgcctggctttgcccctctcaccagccgtggaagccagcagtatcgagctctcacagtgccggaactaacccagcaggtcttcgatgccaagaacatgatggctgcctgtgaccccgccacggccgatacctcaccgtggctgctgtcttccgcgggggggatgtccatgaaggaggtcgatgagcagatgcttaacgtgcagaacaagaacagcagctactttgtggagtggatccccacaatgtcaagac

SEQ ID NO: 4393 - DNA, 310 bp, Homo sapiens
gtcgagctggcggaaccggagaagtggaggttcttgagcccgaggaggatttcgagcagtttcttctcccggtcatcaacgagatgcgcgaggacatcgcgtcgctgaagcgggagcacggggcgggcgtacctgcggaacccgagcaagctgtgggagatggagcaatatgctcattcagatcaaaacgcagggtgagggctcggaggagagcgccctcaaccacctccagaacccgggcgacgcgccgaggccgcacgcaagatgtacgacgagccgacgagagacacgagatacgagatggcagatt

SEQ ID NO: 4394 - DNA, 322 bp, Homo sapiens
ctagctcaggccaagagggtgtgacatagtggcatggataattttgtttgggtttgtattatgtttggatccacatcacccagtggtcagcatggagggcttgatatggagagaccaaccagactgtgctgtgtgggtgacgagatagacacaaagaccttagatgcctcttcatgttactttgctgagaggaggagtagagatatgacacagcagttgaaggggcgggagtggagtcaacgaacattattattttattttttcgtgataagcagtactcgaataaaatggtgcagtttggagaagattattattctacaga

SEQ ID NO: 4395 - DNA, 204 bp, Homo sapiens
accagcaggactgcccatcttcaggaaacgggaaaactggtagatgtatgaaccttctcacaaatttatttgagttagtcatgaaaaggactaacatcctaaaacaatgaatacaggcaaattctccatggggggagaactataccagcagagcttatgtttgttataagagtgcaaaagatatattgaggggcaggagagggt

SEQ ID NO: 4396 - DNA, 120 bp, Homo sapiens
tgtgtgtgagcgctcatctggatgagtgaaagctgcgtttgccgcatatgagagaccatgattcaatcacacatgagatgatgacttcatcagctgtatggcaatagaagctcatagtct

SEQ ID NO: 4397 - DNA, 127 bp, Homo sapiens
caccgttgtcgtggcaggtacgactgtggccacgtgcagaggaggtaccgcctggggcacagtggctggcgccctccagaccatgacctccgttctggctgccacaggtcctccgatgctggccttt

SEQ ID NO: 4398 - DNA, 135 bp, Homo sapiens
cccatctggctctgaggcaccgccaaggcaaggaatcacaggatgcgcatcattgcctttgtgggaaggcccagtggaggccacttagagggatctggtgaaactggctaaacgcctcaggagggggaaggtaaa

SEQ ID NO: 4399 - DNA, 103 bp, Homo sapiens
ctcttatagcattgcattgtatgattcacatattgtttcattaggtacctagggagcacctgattttgctaggcagtgctccccttataccaccacaggccct

SEQ ID NO: 4400 - DNA, 109 bp, Homo sapiens
caggggctgcagaccaaatcaagcacatccttcttattttcaaaaactaccagttctttatgggtgaaacatgaatccagatggcatggttgctctatgggactaccgt

SEQ ID NO: 4401 - DNA, 115 bp, Homo sapiens
gaaatgctcttctggaatgaaggacctaacagtcaaattaagtttgaataggagagaacctcctgcacgtcacagacaccggtgtaggatgaccacagagagttggttaaaacct

SEQ ID NO: 4402 - DNA, 182 bp, Homo sapiens
gtaaaaccttttatgacaggggctgcagaacaaatcaagcacatccttgctaatttcaaaaactaccagttctttattggtgaaaacatgaatccagatggcatggttgctctattggactaccgtgagatgggtgtgaccccatatatgattttctttaaggatggtttagaaatggaaaa

SEQ ID NO: 4403 - DNA, 109 bp, Homo sapiens
tggacgcgggcagagagggtagcctgttggcatgggcagggaacagtgcaggccgtggggcttcctgaggtacagccaccggcaggatgtgttttctttccattgtttt

SEQ ID NO: 4404 - DNA, 190 bp, Homo sapiens
aatttacagagtacttactctgtgttaaaagtaagttaataatgtattgtaatctttcatccaaaatattttttgcaagttatattagtgaaggtgggttcaattcagattgtcttgcaacttcagttttatttttgccaaggcaaaaaactcttaatctgtgtgtatattgagaatcccttaaaatccc

SEQ ID NO: 4405 - DNA, 119 bp, Homo sapiens
atggtgagagacaggggcccagtttcattctttagcatgtggggatttatttcctgggttccctattctgttcccttggtttatgtgtctgtttttagcccatattatgttttggtaac

SEQ ID NO: 4406 - DNA, 305 bp, Homo sapiens
gtcctttcagtggtagactcggggagaactttgtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatggacttttttagacagatcttcatgacctgttccacccaagttcatcatcatctcttttacaccaaaaggtctgcag

SEQ ID NO: 4407 - DNA, 343 bp, Homo sapiens
gccgcccctactgggaagtgaggagcccctctgcctggccaccaccaagtctgggaggtgtacccaacagctcattgagaacgggccatgatgacaatggcggttttgtggaatagaaaggggggaaaggtggggaaaagattgagaaatcggatggttgccgtgtctgtgtagaaagaagtagatatgggagacttttcattttgttctgtactaagaaaaattcttctgccttgggatctgttgatctgtgaccttaccccaaacctgtgctctctgaacatgtctgtgtcactcagggtaaatggattagggcggtcagatgtctttgttaacagatgct

SEQ ID NO: 4408 - DNA, 346 bp, Homo sapiens
gaacttcttcccttgacagtttatcttagcactgaaacatcaaatatattgtatctgctttatctaatactcagaaacaaagaacctacgtgaccaatatcaaatattatattttagttctgactcctaaagtcttgctgtcctatcctcaatgctgttaaaaacttctgaggttccagttttgttatgtggtgactccattggctcctgtcttcgtcagtctgcttcttcttgggtagcttgggaattctgtgctatggtgatatgtctggatacaattgtagtcagcctacacagccagacatgtggcttaagtaattttatcgtcttatttttactctaggca

SEQ ID NO: 4409 - DNA, 356 bp, Homo sapiens
ctgtcgatcccaggccagagacaaggcagacaaaggttcatttgtaaagaagctccttccagcacctcctctcttctccttttgcccaaactcacccagtgagtgtgagcatttaagaagcatcctctgccaagaccaaaaggaaagaagaaaaagggccacaagccaaaatgaaactgatggtacttgttttcaccattgggctaactttgctgctaggagttcaagccatgcctgcaaatcgcctctcttgctacagaagatactaaaagatcacaactgtcacaccttccggagagtagctgacctgacacagattgatgtcaatgtccaggatcatttctgggatggaaggg

SEQ ID NO: 4410 - DNA, 204 bp, Homo sapiens
cacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggataaaatttggaaatggagatgaaaaaaaaaaaaaaaaa

SEQ ID NO: 4411 - DNA, 315 bp, Homo sapiens
caaactccaacaaaaatcgctctctggtttgcagtcatttatttattgtccgctgcaagctgcccccgagacaccgcgcagggaaggcgtgcccctgggaattctccgcgcctcgacctccgacgacagacgcctcgtccaatcatggtgacctgcctttgctcgcagttctggaggatgctgctatcgaccttccgtgactcacgtgacctagtacaccaatgataagggaatattttaaaaccagctatattatatatattatatatatatagctatttatttcacctctctgtatattgcagtttcatgacc

SEQ ID NO: 4412 - DNA, 139 bp, Homo sapiens
cccagccctgcctaggaaccgtacatcccatctgctctctggccaacggcttcacaccttcccctgctgcatgtgggggccgatgggcaggggacctcggtggaaataaaatgtatctatcaaaaaaaaaaaaaaaaaa

SEQ ID NO: 4413 - DNA, 525 bp, Homo sapiens
atggcccccgacgaacactttctcgtatccagcagcaatggaactgtattaaatactactatgatagacactgcagctagagatacagctagagtcctgattgccagtgccctgactctgctggttggaattatacagttgatatttggtggcttgcagattggattcatagtgaggtacttggcagatcctttggttggtggcttcacaacagctgctgccttccaagtgctggtctcacagctaaagattgtcctcaatgtttcaccaaaactacaatgagtctctctattatctatacgctggttgagatttttcaaatattgtgatacaatcttgctgattcactgctggattgctcaccattgtcgctgtatggcagttaaggattaaatgatcggttaggcacaaaatccagtcccattccatagagtatgtgacggtaatgctactgcattcattgggccacccggaaaaatacaatgctgcattgtaatcatccaagggtgaggtggggtccttagg

SEQ ID NO: 4414 - DNA, 455 bp, Homo sapiens
gaaaatcataaccaacatggctgcagtagacttcttagtggtatccagcaccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggtttttgtgatgtatgaaacttgtgttttttatatataaatgagtatagttagtgttgtggtaatgcctgttttcatctgtaaatagttaagtatgtacacgaggcactaccttctgatttattgcaatgttcagtcctagtttttacttttattcttaaagcaattcaggtttgctttcaatttatgtacctagtctagttagcctcagatgttccagaagtcaattatgatt

SEQ ID NO: 4415 - DNA, 355 bp, Homo sapiens
aggattgaagtggctggaaagagtgatgcctggggaaggagatggagttatgagggtactgtggctggtactttctgtactaaacatttcctttttctattttaccactaattttgttttaaactgtgagccgtccaagtcagaagaagacagcaaaaaaagcaacttttccaacatacaatttacttttaataaagtatgaatatttcattttgagaccattcctggaattgccacataattcattaaaacatttttttagcaaaaaaaaaaagggtcttctagagcgccggcccatcgatttccaccggtgggtccaggtaagtttccaattcccctatagtagtcgtattac

SEQ ID NO: 4416 - DNA, 415 bp, Homo sapiens
  misc_feature 11: n = A,T,C or G
gcctgacaggnccccacgcccagccagcccaggacccagcctcccagccaggtccccctccccaccccgccgcagagactggccgtccctgccagcctcgacgtttgtgacaactggcttcggccggagccccctggccaggaagcccgagtgcagagctggaaggaggaggagaagaaacctcaccttcagggcaaaccagggagacccttgtccccggccaatgtccctgctctgcctggcgagacggtgacctccccagtcaggctgcaccccgactacctttcccggagagatacagaggcagctgcaggacatcgagaggcggctggacgccttggagctcccggccgtggagctggagaagcgacttcgggccggccaaggaaattacgttaggatagcctaatggtgg

SEQ ID NO: 4417 - DNA, 435 bp, Homo sapiens
taagctcctagtccagacgccatgggtcatttcacagaggaggacaaggctactatcacaagcctgtcgggcaaggtgaatgtggaagatgctggaggagaaaccctgggaaggctcctggttgtctacccatggacccagaggttctttgacagctttcgcaacctgtcctctgcctctgccatcatgggcaaccccaaagtcaaggcacatggcaagacggtgctgacttccttggagatgccataaagcacctgatgatctcaagggcactttgccagctgagtgaactgcactgtgacaagctgcatgtggatcctgagacttcaagctcctggaaatgtgctggtgacgttttggcaatccatttcggcaaagaattcaccctgaggtgaaggttcctggcagagatggtaactggggtggccagtccct

SEQ ID NO: 4418 - DNA, 385 bp, Homo sapiens
tttaagtccccaacccttacagacaccactgccaccaccaccaaccacgaccaccaccaccaccaccactcaccaccatcatcacctccggaaagtgtagtcctgccctaacccaagtcacccccgacagtaaattttaccttcatgttgagaaagcttcctggtgcttaatcaggagctggagttcaatgagtcctagacagttagaggggcctgagcttcagctcaatggaagcctgctgtgtgccacaagacggaaaagtggagaagctgcagtgggagacaaagcctcggtccccacccatccacacacacctacactaacacacgggcacatgggcgcaccgaactaccattcaggcagtcagtgggcagaggaagttag

SEQ ID NO: 4419 - DNA, 355 bp, Homo sapiens
taggggagtctggacttgtagctggaggtaagactgctttaaaaaaaaaaaattcttcaaaacctggtcacttgccgactggtataaaactttcaagctacatattagcccaccctcagtgtttcatacctcattccaccccaccccaactcccaaaaagcatcatcagatagtttttaatttaataactctgtagtcataactagaatctgagtccttaagaatagactcttttttctctttgtacctccagtacttaagagactgtacaagattaaaacagtgttcagagaaataagtttgaggcatagtgcttttaaagttgaactggcaaatgagtcaatctaaatgtgtg

SEQ ID NO: 4420 - DNA, 122 bp, Homo sapiens
gacttcagtacagattatatttatttacacttcaatttgtcatcagtgaatttttttataaaggttggagccaggccccagtgtttgtatttgaggccaggcttcactcttaaggtgcctac

SEQ ID NO: 4421 - DNA, 131 bp, Homo sapiens
gaacatgaatccagacgctggatctgtcagtgtggcctcatctctgtctagagctgtctcactggatctagagctcaatcgccctctgatcgccgatcacctctgagaccaacctcgctcataaacaaaat

SEQ ID NO: 4422 - DNA, 118 bp, Homo sapiens
gcaagatggcagaagtagagcagaggaggaagcggaccttccgcaagttaacctaccgcggcgtggacctcgaccagctgctggacatgtcctacgagcagctgatgcagctgtacag

SEQ ID NO: 4423 - DNA, 105 bp, Homo sapiens
  misc_feature 95: n = A,T,C or G
acctacttcggagactagttatatttaaacaagatgatacagccttccaaacaactcctcttgcctggagactagatacctctgtagcctaccanatagccacac

SEQ ID NO: 4424 - DNA, 214 bp, Homo sapiens
catccttgacttttgtggcttggggaggggtagtgttccacagcttttccttcccacccccagcctaagatgcctcgctctttcaattctctaattctaaatgcttttaaagagataaattgtttagatgtaggcattttaattttttaaaaattacctctaccagacctaagcactttgttaattttggggggaaagattagatatggggaaw

SEQ ID NO: 4425 - DNA, 174 bp, Homo sapiens
gctccaggcttttagcagagccaaatagagtagattgaagtgtaatagaaagtggagtggtatcgttgtctcctccattgatgattgtcataggttttagcatgtcctcctttcttcacctcccttttttctcctataatcagagaactccaagttaatggaatggtcggatct

SEQ ID NO: 4426 - DNA, 144 bp, Homo sapiens
gaaaacttctcttgccattctctctcttttaactaagctgaatccttccatttcttctgcacatctacttgctaaaattgtgggcaaaagagaaaaagaaggaattaatcagagcattgtacaaaacaggatacataaacacct

SEQ ID NO: 4427 - DNA, 246 bp, Homo sapiens
cggcacgagccaatgtctccaacttcactttgctcctagcacgattatattcacctgggacatgctgctatgctgggactcatgtatgtctactggactcagctcaccatgttccagacctcgaggtacctggccatctggggcagtgtgacgtttctggctggcaatcggatgctggccagcaggcagtaaggagaccagcacattaggttccagaggaaggatggaaattctaaaaactgaatk

SEQ ID NO: 4428 - DNA, 291 bp, Homo sapiens
ggtgtgcagggagaacagggtgccaccgcctgcctggtgtccagggccctccgggtagagcaccgacagatcagcacattaagcaggtttgcatgagagtcatacaggaccattttgctgagatggctgccagtcttaagcgtccagactcaggtgccactgggcttcctgggaggcctggccctcctggtcccccggccctcctggagagaatggtttccagccagatgggaattcgtggccttccggcattaaggggcccctggtgctcttggtttaggggactaaagt

SEQ ID NO: 4429 - DNA, 106 bp, Homo sapiens
gcagctatttttgcatcctctctctgtctgctcagttctggcatctctccctcctgtgtttccaggtttctctatatactttggcctgtttggtctctctgtggta

SEQ ID NO: 4430 - DNA, 106 bp, Homo sapiens
acagagtcagagagagagacagagttagagagttgagacagagtacagacagagagagacagattcaagagagacagagagagccagagagagagagagacagatt

SEQ ID NO: 4431 - DNA, 101 bp, Homo sapiens
atgttagtgagccacagcctgtttgtccttgcagttgtctcacggctctctagcgtcctctcctctctttggcctcagtggcttggatttcctatccaaag

SEQ ID NO: 4432 - DNA, 103 bp, Homo sapiens
gagacataccaacactgacaaactagaggggacatgagtacatctcaagggtcactgtgtcttaactcacttcgatcagaaattaaggccctttctctgagga

SEQ ID NO: 4433 - DNA, 158 bp, Homo sapiens
tcgtcaatttcggcataattgaactaactggggactctctgtgctagtaaccacggtctctgatcaatatcactctcctacttacagggctcaacatactagtcacagcctatactcctctacatatttacacaacacaatggggctcactcaccccc

SEQ ID NO: 4434 - DNA, 128 bp, Homo sapiens
gctccttggaaaacgagggtcctcctcgagctgcaggtgcagaggggaagacaagggtgaaaaaggtgctaaggggggaagcaaggtcgagaagggtcctcctggaaaaacccgccccagtcggtcct

SEQ ID NO: 4435 - DNA, 153 bp, Homo sapiens
cggcacgagcgttggcagggagaagcagcgtcctagagcaggcctgcagttgtctgcagggccaaggccagggagcagggtctcctttggagggacctggcaagcccctcacgtcgccaggtttttcttagcaggggagggtcacaccacacc

SEQ ID NO: 4436 - DNA, 320 bp, Homo sapiens
gagagaactagtctcgagtttttttgtattatttttagacataggggtttcgccacgttgcccaggcttggtcttggaatttcctgaggtcaagcctgtctgcccatcttcagcaacttttgggagggccacggccaggccggattcatgaggtcaaggagatcaagaaccatcctcgctaacacggtgaaaccccatcttctacttaaaaatacaaaaaatcagccaggcgtggtggttggtgcctgtaatccagctactcgggaggctaaggcaggagatggcgtgacccgcagcggagttgcagtaagcgagatcgt

SEQ ID NO: 4437 - DNA, 275 bp, Homo sapiens
cggaggctccagacatcacctaccactgcagaacagcattgcctatctggacgagcagctggcaacctcaagagggccctgctcatccagggctccaatgacgtggagatccgggcagaggcaatagcaggttcacgtacactgccctgaggatggcttcacgaacataccggtaggtgggcagactgtatcggtaccggtcacagagacctcacgcctcccatcattgacattcaccatgacatagaggcccagcaggattcgtgtgacatagg

SEQ ID NO: 4438 - DNA, 210 bp, Homo sapiens
cttagaccaagggaggacttcccagcatcagagatgacacggatcgccaggctgattggagaaggaacaagatgagttacgggaaggaggaggagcttcagaagagcttaaacatactgactgccttacagaagaagggggccgagaaagaggagctgtaaaaggcttatctctaattttcaggggcttgctgggggtagggagggagag

SEQ ID NO: 4439 - DNA, 240 bp, Homo sapiens
agcatgcgatcgatacagagcatctgcactgggattgtccgccccgcctggcagggaggcctcgggggctaatggagctgagggtatagtcggccttggaccctcgcttttttcctttcctgtactatgaagataactgccttatctccccctcaggactgttttggggattaaataggacgtttaaattaccaacgctctttgaaataaacatttcaaaattaaaaaaaaaaaaaaaaa

SEQ ID NO: 4440 - DNA, 307 bp, Homo sapiens
gagcggggaagctggggccaggcttggtcacggggtgctgtgacttaccaactgtgggagggtcgccactcccctttttgagtctcagtgcctcactataaataggaatggtagcctcccccctttataagtttatcccaaagaaacatgagataataataaaggcagctgggtgtggtggctcacgcccgtaatcccagcactttgggagggtaaggcgggtggatcatgaggtcaagagatcgagaccattctggccaacatggtgaagccccatctctactaaaatacaaaattagccgggcgt

SEQ ID NO: 4441 - DNA, 283 bp, Homo sapiens
ctccgcatcccgtcagctggaaaaggcctgtgccagtcaggcttctccaagggagggtgacatgctggcttttgtgcccaagctcaccagccctgcgccacctcactgcagtagtgcaccatctcactgcagtagcacgccctcctgggccgtctggctgtcgctaatggaggtgacggcactcccatgtgctgactccccccatccctgccacgctgtgccctgcctggctagtcctgcctgaataaagtaatgcctccgcttcaaaaaaaaaaaaaaaaaa

SEQ ID NO: 4442 - DNA, 240 bp, Homo sapiens
cccaaacgagggcacttttaagaaatgttacaggctaaaggtagttaaccatttgaggtgaaaacacggatcctacgaagaacaaagaccaccaaaaaggcaaaaatatgtggaaaaatataaaaaatgttttctggttaacaaaatgttaatttctaacattttaaaacaaaaatgattgtttataacatgtatacattgcatatgtgatacagcacagaggacaggggggttgcatgg

SEQ ID NO: 4443 - DNA, 172 bp, Homo sapiens
  misc_feature 114, 115: n = A,T,C or G
cctgcctcggaagcgcagagcaggcatcgtgggaaggtgaggagcttccctaaggatgacccgtccaagccggtccacctcacagccttcctgggatacaaggctggcatgganncacatcgtgcgggaggtcgacaggccgggaatccaaggtgaacaaggaggaggtggt

SEQ ID NO: 4444 - DNA, 346 bp, Homo sapiens
gtggcgcgacggagagcacgcatgaggctcggcacgctacgggagtacaaggtagtgggtcgttgcctgcccaccccaatgccacacgccgccctttacctcttgcgattctttgcgcttatcatgtcgtcgccagtcccgcttctggttctttgtatctcattaaggagtggagagtcttcaggggaggattgtctactgtgggcagtgttgagagtccccttgccgtgaagaactcgggtctgctcgtatgactccgagcgcaccacacatgtaccggatacggactgacacgagcgtgtaccagtgtaccggaatggtgccggaccggccagccattcattag

SEQ ID NO: 4445 - DNA, 382 bp, Homo sapiens
gagtgtgagcttgtgcttgtgaaagctaaccatgctaaccaccagggcaaagcagcacagtgtgattagaacagagcgggatcaggattttcacagaggacaggtcagctgaggggcctgcacacacagggtgtggaggagccacagatgggcgcgagagcctgccttttgcctggccagctcaccccacctgggcctcactgctccaggaggcttccagttaccgagctaagtggctcttgcagtcccgtgacaccttgagctgtactcggtggatgttatgctatccgtgctagccgttgtgctggctggtgtagatgtagtccatggagaaacactttgttccgttttccagccggtctctaaattgttaatgaagaca

SEQ ID NO: 4446 - DNA, 243 bp, Homo sapiens
ctcgtcaattcgccaaagaattgtagttcttattcccacgcgaaaacagagtgttagctgcggtggcagacgtctgtccgggagtttctctggagcccagatcgacgagccgttaggcctatgtaaatggtataatggggaatatagagtcgtcgagttgtcttcgcgtctctagctagtcattaggggagaaggaaaactaggatagaaaagaccttccacctacctgggcaaccatatcat

SEQ ID NO: 4447 - DNA, 280 bp, Homo sapiens
ctcgtccattttcggccaggggggccaaggccagactccacgattgggaggaccaggtccgctgcgacatccgccagttcctgtccctgaggccagaggagaagtcctcctgccaggtggcccgctgactgcacttgcatttgggggttgtcgggtagagcttggggttgtcagaggctagggcagtacttaggaccttggcaaaacctgccacagggtgttgggacgaggaggctccaaattgcagattaaaaatgctcactttgaaaaaaaaaaaaaa

SEQ ID NO: 4448 - DNA, 454 bp, Homo sapiens
gaatgaaaatttatgaaaaagatgaagaaaagcaaagggctttgctgggctatgctgataaccagtgtaagctggagctacagggcgtcaagggtggggtggaccatgcagcagctttttggaggaattgccttctcttgccccccagcaaagagttgccagacttagaagactcgatgaaaagggagagcagacgatctgactccctcgtgagcctggacacccaggcaagcacagtacagatgtcatctgcgacctacgacataaattgcttgtcgggatgagcattcgagacttctagatgatcagaggaagcaattgttggatatgcatgcagatgataaagtacgagtggttgcaacacataaccaagctcagttacggagcatatcagcagcctttttatcctccacactttagcctaggttattccaataagtctttttattttccc

SEQ ID NO: 4449 - DNA, 430 bp, Homo sapiens
ggtcgcacgcgtgagacttctccgccgcagacgccgccgcgattgcgctacgtcgcctccctacctgctggctgcctagggggcaacttcctcccccagcggcaagggacatcaagaagatcttggacagcgtgggtatcgaggcggacgacgacccggctcaacaaggttatcagtgagctgaattggaaaaacatttgagacgtcattgccagggtattggcaagcttgcagtgtacctcctggtggggctgtagcgtctctgctgcccaggctctgcagcccctgctgctgggttctgcccctgctgcagcagaggagagaaagatgagagaggaggagtctgagagtagatgatgacatgggatttggcctttttgattaaattcctgctccctgcaataaggcttttacaaataaaaaaaaaaaa

SEQ ID NO: 4450 - DNA, 401 bp, Homo sapiens
cacaagtccctgtatctgaagtctagcatctcaaggctgatctgggaagtgtgctagtatgctccctagtggataacttaatcttttaatacagttccgtcattccatcttgttttcagaagagagggtggctacagccaggcataacatatccactgtgtgcatagagggtctctcacgttgatgctcgcattcatcagctttctctaaggctttgctcaggtcaacctaaaatgatgttaggcaacaggtcccagtcagttcctctatttcaccatttgctcaaagccatatggcccgataggggtactgctgactaaggttgtatccaataaggggcgggggtcctttgggggccgggccctggtttcccccggtgggtccaggaaggtcccttgccc

SEQ ID NO: 4451 - DNA, 360 bp, Homo sapiens
cttttgtataattctcattaaattattcaagactttaagaggaaagacatgccatgctaattctttttaaaaaaggaaactgccgaataacttctgtagttgtttaattagtttaggggaaaaaaaaaccttcaaaagcgtatattcaaactttgattctagttgcctttcgtctaagtcatgggaagccacgtgagtattctttgccatctccaggagtggatggttagaggagggaataggaatccccatcagctgagggagcttaacttggctgtaagatgtggtcttggtccagcaacacgtggaacatgttccttgtcctgaaaccttggaattgacaagaattgaggaagacct

SEQ ID NO: 4452 - DNA, 318 bp, Homo sapiens
tcggccgagagactccttttccagcttaggtatcacactaaatctccaggggcacattgaaatcctgagtgatgtgcagctgatcaagactggagacaaagtgggagccagcgagcacgctgctgaacatgctcaacatctccccttctcctttggctggtcatccagcaggtgttcgacaatggcagcatctacaaccctaaagtgctttatatcacaggggaaactctgcattctcgcttcctggagggtgtccgcaattttgccagtttctgtctgcgagttggcttcccaacttttgctacagtaccccttttt

SEQ ID NO: 4453 - DNA, 356 bp, Homo sapiens
catagttatgtaaaagagattgcttcatgagctaatggttcatatatgcaaaagggtaagatgaaagctttactttgtacaaatgtaaatagataaagtaacataatacattaatacttcttaaaatgtgctatttgcaaacttacttaatatcagtgaacacagtcggctaaagctgtgttccatatattgttatagacagctaaacccttcaactatgcaatgaatgttcgggcttttcacaaaagccgcctaactcaaaggagcctttcaaatccatttacagcatacttaaggtcatatttacctgaacaggcgcttacgtgatatgactctgttttcctgcttgttttttt

SEQ ID NO: 4454 - DNA, 245 bp, Homo sapiens
ttctctttcctttccttggagggaagacagcagagtcatcagttaaaaaaaaaaaaggaaacccaaacacctcccttgaacaaatttatactcctgttcccagggtcttgagactttagggkkgctatacccatgagtcttataggggggcacttttccaataaacaaaaacaacttttttggttacctcagttgcagagatatattcatttggaaggtgttctcagattattttttcaggtata

SEQ ID NO: 4455 - DNA, 141 bp, Homo sapiens
ccagccacagtggtgacctcccgaggactccaactaggccaaaccagtacagctactatccagcccagtcaacaagcccagattgtcactcggtcagtattgcagcggcacagctctgctgctgctgctttactaatgcaa

SEQ ID NO: 4456 - DNA, 260 bp, Homo sapiens
ccactctgttcattgtaggtactttagcatcatccctgggtctctacccactagatgctattagtatgcctccatctccagttatggtagccaaaactgtctccacacatgggccaaacatacccttgggaaccaaaatcaaccccttggcttcggaactattggctctaaggggtaccaaatggggatgtgtctgaatcaggctatctgggattggccggggtctcaaaacccttggggacacagttaatgggccaggg

SEQ ID NO: 4457 - DNA, 270 bp, Homo sapiens
tgtaattcagaattcataccaatcagtgttgacactcacacattgcaaaagtggtcgcaatattcagtgcttaacacttttctagcgttggtacatcttagaaatgagttctcaagttgattttatcctcgcaagcatgttgttataaggattgtgtggtgtgtctatcattacacttgtgttctgtatctcgagaacagtgttctctacacattcatatgtgttatatgagagagatgctctaatgcacactcgtcacatatatatata

SEQ ID NO: 4458 - DNA, 350 bp, Homo sapiens
gtactttccaatctcagtcactctaggactctgcactgaatggctgacctgacctgatgtccattcattccaccctctcacagttcggacttttcttccctctctttctaagagacctgaacttggcagacttcaaaataaaatctctgtgtgtctatatatatatatgtctctccgtaagagccctcgggtcacaggcagagacacggaactctctcgtgtgtgtcacatgtcccctgagtgactctccccagagcacgacagaggatgtctcttcacgtgcgcgcagcagcagctctgtgtgtctacacactagtgctactactgctgtatacaactctgtagttatt

SEQ ID NO: 4459 - DNA, 195 bp, Homo sapiens
ggaccctgcagccgcagagatgttgatgcctaagaaggacccgattgccatttatgaaccttccttttaaggagggagttattggtgccaaggaggatgttcaccatgcctaggaacccgagcttgcagagcaaggattttcccaaccctcaagtgtctgtaaggccattgcgtgtctctaagtgcccagagctc

SEQ ID NO: 4460 - DNA, 280 bp, Homo sapiens
cttgctttcagttttctgtggtctcttttacatcctgcttcaagattcggagtgttggaggaagctaaggaaggtcttggtgcagtaggttagcaagacctcttgcttcccagcccaaggttggttggggcggacaacctttttttgtgcaatccaatcttatacacactctgcgcatatctctctgagagacacacacgcatatgagaagagtctctggaggctctcttgtagagcctatccctctcgcagagatactctcccagatgtaacgtgatcc

SEQ ID NO: 4461 - DNA, 341 bp, Homo sapiens
tggcggtgcagctttgaccgtgccatcgagatggagcgtggcatcttcggaggaggcttcgcaggttcctttggtggagctggaggccattctcttggggtggccaggaaggcctcccagatatttgtgagaaatctgccattcgatttcacatggaggatgctaaaggacacattcacgagtccgccacgtgctgtacgccgacatcaagatggagattgggaagtcacgggtgtgtgtggttagttcgagtcgccacagtgccgagagagcctccggatgatgattgcatgagcttagtgcgagagattacgttcgattgatagaacgctaagcagtgc

SEQ ID NO: 4462 - DNA, 285 bp, Homo sapiens
gccgcccaagatgccgaaaggaaagaaggccaagggaaagaaggttggcttccgccccagctgtcgtgaagaagcaagaagctaaggaaagttgttgaattccctggtttgaggaaaaggccttaggatttttgcatttggacaagacatatccgacccaaaagagaacctctcaccgctttgtgtaaataggccccgctatatatacagtttcagagcgcaaagagaccaacttctatatacgcgctctgagagcctcctcccgcgttatacacattacaccga

SEQ ID NO: 4463 - DNA, 285 bp, Homo sapiens
cagccaaagctgttgcggtgaccctgcagtcacactgaccccacctgaaattcttgggcagtcctcttttccgcagctgcaggagaggaggaagactattaaaagacaatactgatgacatgtttcgtagataggggtttgcagctgccactcgagctcgtagctcgcgttaatgaccctactcgatgtgctctcggggacatgttagagggacacaggcgcgagctcctcggcacgagttyacaggtctgagacacatagagatagggcacatctcttagaaga

SEQ ID NO: 4464 - DNA, 105 bp, Homo sapiens
gagggatttagtctccattaattgtcaatgtctcttgaccccaatcattatacttggttcttctttttgtccttaggtcattattattattacctttactttaat

SEQ ID NO: 4465 - DNA, 185 bp, Homo sapiens
ccactatgaaggttacggttcttcccctttttttcaattttgttggctttagaaggaaggcactattcaaaagcttcacaacctctaaggttccggagcttgcctttttccaagggagggtaatatattatatcctccaaccctttttagggttgggccattactttaaaattggtttgggatta

SEQ ID NO: 4466 - DNA, 280 bp, Homo sapiens
atggcggcaggatggatgtggataccccgagcggcacaacagccgcgcgggcaagaagcgctttgaagtgaaaaagttggattcagatagcccctcttggcccttgggatattgttggtttatatacttttccatacttcagagacccaatatatagggtattttgcatataattcaaagtataccagacgctcccgtatattacgagagagctacactcgcgcatggagagtctatacccatgcttcacactcaccactacatctcgtcgctgtcatca

SEQ ID NO: 4467 - DNA, 291 bp, Homo sapiens
atcgacctccccaccccatccaacatcttccgcatgatgaaacttcggctcactccttggcggcctgcctgatccttccaaatcaaccacaaggacctatttcctaggccaatgcactatcttaaccagacggccttaaggccggcctttttaatcaaattggccacaatcactttgagacggtaaaattattggctgtaatcaatcccggtatccttacaggcaaattgggccctctaatatatctcttatatcgtcctctttcctacacatcggcgcgagctctattat

SEQ ID NO: 4468 - DNA, 150 bp, Homo sapiens
ctcgtgccgcaaaatacgattttgataaatagacaggtgtatctattcttgattaacgattcactctaataaaaattttgactcttttgtatccatccttaaaattcagtctgattccacttactcaggagacaatattacatgggatat

SEQ ID NO: 4469 - DNA, 176 bp, Homo sapiens
gtcaaatgccccctgagtgacttcccccagcccaggccagaagaccttccttcaggtgccgggcgcaggaacttttgttgttgttctacacaattggggctatttttgtgtcaaacaactcttgtatttttttaaaacatcaattgatatttaaaaatgagaaagagtatttggag

SEQ ID NO: 4470 - DNA, 278 bp, Homo sapiens
ggattcagagggaccagtgcatccaattatacaattatacccagaaggtcctgtgtaggggactgcgattgacatcaccctagtctgcagcaccaaggactgaatgagctcaatcctcttataatttaggctggactgtaacagccactggcagcaacagcttacgtggtgcagccaaagtgcaaccatgccagcagcggccatgttccccagggtgggggtccagttagtaagccacggcaccaaagaggcgagcattccttttgccaaaaaggatt

SEQ ID NO: 4471 - DNA, 348 bp, Homo sapiens
ctcggacaacttgcacaagcgccgcaaaccggggcagagaagcctaccacaagaagcggaagtattgagttgggcgccagcttccaacaccaagattggccccgccgcattcacacagtccgtgtgcggggaggtaacaagaaataccgtgccctgaggttggacgttgggaattctcctgggcatagagtgttgtcttgtaaacaaggatcatcgatgttgtctacaatgcatctaataacgagctggttcgtaccaagaccctggtgagaattgcatcgtgctcatcgccagcacaccgtaccgccagtggtacgagtccactattcgctgcccctggccgcaaga

SEQ ID NO: 4472 - DNA, 356 bp, Homo sapiens
ggaaatggaaccgtctgaactatcctgcccgccatcatcctagtcctcatcgccctcccatccctacgcatcctttacataacagacgaggtcaacgatcccttccttaccatcaaatcaattggccaccaatggtactgaacctacgaatacaccgactacggcggactaatcttcaactcctacatacttcccccattattcctagaaccaggcgacctcgactcttgacgtgtacaatcgagtagtactccgattgagccccattcgtatataattacatcacagacgtcttgcactcatgagctgtcccacattaggcttaaaacagatgcattccggacgtctaacaacca

SEQ ID NO: 4473 - DNA, 348 bp, Homo sapiens
tttagtcaggaaggacgttggtgttgaggttagcatacgtatcaaggacagtaactaccatggctcccgaagttttgccaaaacctcggatgcttggctttctggcaaggccgtttgcgaattcatatggctgtagattcgtgcttatccttcgggtttgcagctttgtattaagttcgtgtggctgatcaaagaagaggcatacgagatttcacagaactacgattgtcaagaaagattttgaggagtgaggaaggcttggtacttccagagttaaagaatctcggatataagatttctcaggttgatcactagagtttgcactacttgtgtctgactatgcacatg

SEQ ID NO: 4474 - DNA, 304 bp, Homo sapiens
taggaataaacctataacatttacaaaaagagcaaaactaagtgatagaaaatatttcacacatgttcttatagatcatgtatcacttgcaagttttaggagttcatatcctatatcatttcaaattaagtacataataaagtaaaattttgaaatgaacactttaggtatttttgccagatttagatggtttttaattaaacttttctctccctttttttttcactaaagcatgtttatcccctaatccattaaggggcatgaaaaaaggataatgtatttgaaattataaaaaaaaaaaaaa

SEQ ID NO: 4475 - DNA, 245 bp, Homo sapiens
aaaagaccaaacttccaggcctgcttttttcttaaagtactttaaaaggaaatttgtttgtattttttatttacattttatatttttgtacatattgttagggtcagccatttttaatgatctcggatgcaccaaaccagccttcggagcgttctctgtcccacctctgactttacttgtggtgtgaccatgttcatatatctcaaagagaaaaaaaacctgtaaaaaagcaaaatgacacagga

SEQ ID NO: 4476 - DNA, 250 bp, Homo sapiens
gagaccaaggccgccccgctctggtctcagaccagttgtgctgctcttgctctggctcagctggtgtggggcgcaggcgggaaacgagacctctagcatctggctgaaggctctgccaagctcctcttcagggctgcagtctgcctgcctgcatataccgacttggccagacactgctgctaaattccagggactctttctcccctcctctgctctccagccaatccttgaggatttaataactggaagg

SEQ ID NO: 4477 - DNA, 191 bp, Homo sapiens
ctgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattagaggtttaaataaagagttttaatttttaaaaggg

SEQ ID NO: 4478 - DNA, 106 bp, Homo sapiens
aaaatgctgtttgtattttgtggtctaataaggagttcgggatagcctgttgtatttgcctcatgcgagcccctgaagctgccttggggagaagatgctgaattgt

SEQ ID NO: 4479 - DNA, 238 bp, Homo sapiens
ctcgtgccgaattcggcacgagccgcggcgggagaggaacgcgcascagccttgggaagcccaggcccggcagccatggcggtggtaggaggaatgaaatgtgtgaagttcttgctctacgtgcctcctgctggccttttgcggcctgtgcagtgggactgattgccgtgggtgtcggggcacagcttgtcctgagtcagaccataatccaggggggctacccttgctctctgttgcc

SEQ ID NO: 4480 - DNA, 237 bp, Homo sapiens
ttgaatcccggcgcttccaggttgtggactcccgagccactggcaggttccgcggcaccgagcccgagccccgagacggcatttaacctggccacataccaggtaccgtgaacatacccttcacagactttctgagccaggaggggcttgagaagagcccttaggagatccgccatctgttccaggagaagaaagttgactgtctaagacacttgttgccacgtgttgctctcgcgt

SEQ ID NO: 4481 - DNA, 101 bp, Homo sapiens
ccgaaacaggctactctcctcggccccctccatcgggctgaggaagcacagcagcatcttcaaacatgtacaaaatcgattggctttaaacacccttcaca

SEQ ID NO: 4482 - DNA, 239 bp, Homo sapiens
gcgatttgctggtgtagacatccgtgtccgtgtaaagggtggtggtcacgtggcccagatttatgctatccgtcagtccatctccaaagccctggtggcctattaccagaaatatgttgatgaggcttccaagaaggagatcaaagacatcctcatccagtatgacccgaccctgcttgtagctgaccctcgtcgctgcgagtccaaaaagtttgaggccctggtgtccccggctcgct

SEQ ID NO: 4483 - DNA, 237 bp, Homo sapiens
catcgtgctcatcgacagcacaccgtaccgacagtggtacgagttccactatgcgctgcccctgggccgcaagaagggagccaagctgactcctgaggaagaagagattttaaacaaaaaacgatctaaaaaaattcagaaggaatatgatgaaagggaaaaggatgccaaaatcagcagtctcctggaggagcagttccagcagggcaagcttcttgcgtgcatcggttcaaggcc

SEQ ID NO: 4484 - DNA, 270 bp, Homo sapiens
ctagtggatccaaagaattcggcacgagccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgttttatcagggccaacagccagggacctgtatgggttccaaaaggtcccaggtgtcctcttccgtgcagtcgggaaaaagcccc

SEQ ID NO: 4485 - DNA, 236 bp, Homo sapiens
ttatgcaaagaaaaatgaacccaaacatagacttgcaagacatggcctgtatgagaagaaaaagacctcaagaaagcaacgaaaggaacgcaagaacagaatgaagaaagtcaaggggactgcaaaggccaatgttgggtgctggcaaaaagtgagctggagattggatcacagccgaggagtaaaggtgctgcaatatgttagctgtggccactgtggattttttgcaagacact

SEQ ID NO: 4486 - DNA, 343 bp, Homo sapiens
agagtactggctccttttataatttgttaccagctttacttttgtgataaaatattgatgttgtattttacactcttaagtcttaaccacagtcagaattatcttaatgtagattataattctggtctttcaggaaaaaaaaacaaaaatctgatatttatttcaaaacgtattgaggcacacaatattaatattgtgccatatgacaacaaagtctttcctaaatactccatctgtttagtactgtattgtggaatatttgagtctattccatacttgaaacatggaggatttagagatgcctgacaatattatttaagtagtatgtgaccgagctataatt

SEQ ID NO: 4487 - DNA, 360 bp, Homo sapiens
tagttctgaacgttagatatttttcttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaatccacctgttaaatttttctggacaatgccagcattttggattttcttaaacaagtaaatttcttattgatggcactaaatggtgtttgtagcattttcatcatacagtagattccatccattcactatacttttctact

SEQ ID NO: 4488 - DNA, 285 bp, Homo sapiens
tgtcccaactgatgatatccacatgaaggcaagttgatctggagaatgtatggcttcattttatccgggagttcattgcaccagttacactgaaggtctttgcaggctattatacgagggatttgcactactgaattttgtagtaaaatactcccctgaacgacagcgttctcttcgtcctcatcatgatgcttctacatttaccataaacattgcacttaataacgtgggagaggctttcagggaggtggtgcaattctaaggacaattgctctattgagtcac

SEQ ID NO: 4489 - DNA, 114 bp, Homo sapiens
gatgggtggggtggggagggaatcacttggtgctatagaaattgagatgcccccccaggccagcaaatgttcctttttgttcaaagtctatttttatttccttgatatttttct

SEQ ID NO: 4490 - DNA, 365 bp, Homo sapiens
caacacactaaccatataccaatgatggcgcgatgtaacacgagaaagcacataccaaggccaccacacaccacctgtccaaaaaggccttcgatacgggataatcctatttattacctcagaaatttttttcttcgcaggatttttctgagcctttaccactccagcctagcccctagccccccaattaggagggcactggccccaacaggcatcaccccgctaaatccctagaagtccactcctaaacacatccgtattactcgcatcaggagtatcaatcacctgagctcaccatagtctaatagaaaacaaccgaaaccaaataattcaggcactgcttattacaattttactgggtccta

SEQ ID NO: 4491 - DNA, 255 bp, Homo sapiens
ctcgtctattccggccagggtttgccttcctcttttttcttgtcattgctggtcaagattactaatatttgggaaggctttaaagacgcatgttatggtgctaatgtactttcacttttaaactctagatcagaattgttgacttgcattcaggacataaatgcacaacatctgtacatgtctccatcagaagattcattggcatgcacagggggattctctccttcatccgtaagggcaacaataaaaccaaat

SEQ ID NO: 4492 - DNA, 215 bp, Homo sapiens
gacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgcca

SEQ ID NO: 4493 - DNA, 262 bp, Homo sapiens
gtcagaagacaacatttgaaattaatcccagacacccgctgatcagagacatgcttcgacgaattaaggcagatgaagatgataaaacagttttggatcttgctgtggttttgtttgccacagcaacgttcggtcagggtatcttttaccagacaatcaagcatatggagatagaatagaaagaatgcttcgcctcagtttgaacattgaccctcatgccaaggtggaagaagagcttaagaagacctgagagacagcagag

SEQ ID NO: 4494 - DNA, 259 bp, Homo sapiens
tttagatgtagattctctggtcattgagcatatccaagtgaacaaagcacctaagatgcgccgccggacctacagagctcatggtcggattaacccatacatgagctctccctggccacattgagatgatccttacggaaaaggaacagattgttcctaaaccagaaggaggaggttgcccagaggaaaagatatcccagaggaactgaggaacaaaaacttatggcacgggagtaaattcagcattaaattaaatgta

SEQ ID NO: 4495 - DNA, 250 bp, Homo sapiens
aaaattttatgagagaatggcttactacacctccaggatgcagttccccatggagatggcggcacttccgggacgaccagggcctgcagggaaggatggtgcttccggcaggccaggtgcttcagggtcactgggctgcctggtcagattggcatgacaaggacggcaggcttgcaggattaaaaggttggctggtgacaaatggaaaaagggacatggtgttggcatgcaagaaaatggtgtggccgcc

SEQ ID NO: 4496 - DNA, 360 bp, Homo sapiens
acatctagtgggcaacacagggaggaatatgattagttctgtttttcccccagcagcatcattctgttcttctgcctgagggcatttgcccctctttcttatctggagacattgtttcttagctactttcattctatcttctctcttatacttagtgcctaggtagttggctccgattaattttgctgtatgacctttatgcttccaaaagtgacagattattgactgttaaaatattagtgaatatatacacttggtatacatccagcaggtaatattaattcttgaggaaattacacattttagagccagtaccatcatcttctatgtagtatctagaaccgtgtctcattaaaaaaa

SEQ ID NO: 4497 - DNA, 360 bp, Homo sapiens
cgggttgtgcctggaggtggaggggaagatggtcagtaggacagaaggtaacattgatgactcgctcattggtggaaatgcctcccctgaaggccccgaggcgaaaggtaccgcaagcacagtaatcactggtgtcgatattgtcatgaaccatcacctgccaggaaacaagtttcacaaaagaagcctacaagaggtacatcaaagattacatgaaatcaatcaaagggaaacttgaggacagagccagaaagcgtaaaccttttatgacaggcctcgcagacaaataagcacatcttctaatttcaaaactccagttctttatgggtgaaacatgactcagatcgcatggtgctcttt

SEQ ID NO: 4498 - DNA, 290 bp, Homo sapiens
gaaaccctatgtgtgtaagcagtgtgggaaaaccttcagatatggttcagcccttaaagcccatcagagaattcataggagcataaaagtgtaagaccgtaaagagtatgagcgcgccattcatcatcagacagcccacactggtgagacatgatggaatgttagtcttataggtatggctttagaattgagagagttcaaaatgcagatcttgccacattagaaagcattcaatgtcagtcctgttttaatggatatctcactattcaatggtaaattaaaaaaaaaaa

SEQ ID NO: 4499 - DNA, 120 bp, Homo sapiens
gacaacccgtggcacatgtggaaattggccatgccctggccttggccagttgccccatgatgcctgccgcttgaatatgacttggtgcttatggtggaccccatcccccctaaatcgacc

SEQ ID NO: 4500 - DNA, 206 bp, Homo sapiens
gctcttggcacgttgtatagatccgatgtacgtccttaccttacgcatggttactgggataataggtgccatcttcttcttcttaggcctaggataagcttcgggcagcttttagcgaccgattcggagctcaattgcgatgcgcaaccccattacctaacttgcaacacgcgcaagcgctctgggtttctctgagagatgctgga

SEQ ID NO: 4501 - DNA, 170 bp, Homo sapiens
ttgcgtcttatcaccaataccagtaagttgcgatgcagttctttcagatgctcagatcgccatgcaccgttaccagtctaagccctgccgctgcttaaaagaaccgctttcctcccctaaagctatactttcgagagagagagagagagagagggtctcatagaacgagg

SEQ ID NO: 4502 - DNA, 180 bp, Homo sapiens
tccctctctgcacgtactgtggaaagaacacgcacttagtctctaaagagtttattttaagacgtgtttgtgtttgtgtgtgtttgttctttttattgaatctatttaagtaaaaaaaaaattggttctttaaaaaaaaaaaaaaaaaactcggggggtacttttaggggcccgccatcg

SEQ ID NO: 4503 - DNA, 250 bp, Homo sapiens
cggctggaagcatatctacattgtgcatacaaggaagctttgagattggcattccaggggatgtggatccaggagacagattattccacattacaagaatttgtaggagctctcactccttcagacaaccagtctagaagagagacatakaggvcaagttcacaacctcttcagccaagaccacctagtgatatatatggggtatgttgatgatcccgcaccacttatatgcattgatgagacagagctg

SEQ ID NO: 4504 - DNA, 200 bp, Homo sapiens
ggctgcgcatgacctgatggcccctgtagcgccttgactgctgggcaggctgccctgggactctcagccaccagttgcttatccagatgtgacagagctcgacccagccaggctgcacactcctcgactcggctagcctccactgcctcggaaagtcggccgacggcccaaagctgctgaggggtctgaggctggtgccc

SEQ ID NO: 4505 - DNA, 198 bp, Homo sapiens
tgataacaatgcatcgtaaaaccttcagaaggaaaggagaatgttttgtggaccactttggttttcttttttgcgtgtggcaggtttaagttattagtttttaaatcagtacttttaatggaacaactgaccaaaaatttgtcacagaattttgagacccattaaaaaggttaaattggaaaaaaaaaaaaaaaaaaa

SEQ ID NO: 4506 - DNA, 230 bp, Homo sapiens
cacttacagctcatcaacataaaatgaatactgccagaatactttacaagcccaaagaagaattcttctatcagcattccttttatcccagcacacacctgtcaggaccagcaatagtttcaagacttaagccagcattgggttttgcagcagcagcataacatggcaggcacatcacacatcccctgccagctattcacatggtgatggatacgcttggcattccttat

SEQ ID NO: 4507 - DNA, 260 bp, Homo sapiens
gacagagcaggattctgtctcttaaaaaaaaaaacaaaaaaggaaaacaggaaaatcttcagaagcaaaaaccaaacaatctcaccgtgctcggctgagatcatgtttttgcaggaacatggatggagctggaggctattatccttagcaaagtaatgcaggaccagaaaaccgaggcccaatgttctcacttataagtgggagctaaatgataaggtcttgtgaaccaaagaaggaaacccaaaatactgggtttcctt

SEQ ID NO: 4508 - DNA, 108 bp, Homo sapiens
  misc_feature 84: n = A,T,C or G
ggtgagctttgctgattccgatatagtgcccccagccagtacctaggtgttccccaccttgggcatcatgcaccacaacaaacngcccactgagaatgcaaaggagga

SEQ ID NO: 4509 - DNA, 300 bp, Homo sapiens
cacctgcaggctgaagttttctttgtgtgttctgcttgcagaaaagcttcagacagagcttggtaagtaacccctcttagaactatttctcctcagggccgggtccagtggctcacacctgtaatcccagtactttgggaggccgaggcgggtggatcacgaggtcaggagatcgagaccagcctggctaacacagtgaaaccccgtctcttctaaaaatacaaaaaatgagcccgcgtgcgcatgtcctgtagtccagctacatggaggctgaggcagagaagggcgtcacccgggagc

SEQ ID NO: 4510 - DNA, 90 bp, Homo sapiens
aacccagggctgctttttaaactggtttatttattttattatattcagttttcataaggagccaattccactctgtaaaaaaaaaaaaaa

SEQ ID NO: 4511 - DNA, 384 bp, Homo sapiens
gaacaggtcgtgaaaaaaggtcttggtgaggtgccgccatttcatctgtcctcattctctgcgcctttcgcagagcttccagcagcggtatgttggccagagcatccggagttcacaccctctgtggtccgtagagccactatgaggagggcctggaagaatttgcattttcagtggaaacaagtggtcgttactagctaagatgtgtttgtactttggatctgcatttgctacacccttccttgtagtaggcaccacctcttaaacataggatgttcagttctcatttacagtattagagcatttagaggtacagctttggagtgatcaactagactatatgcatctagtatgttttcataactatacgtaaaaaaaaaaaaa

SEQ ID NO: 4512 - DNA, 241 bp, Homo sapiens
ggccatcaagggttccgcaatgccctgttggattcggcacggttgagaggtagtgccaatgctgtgaggatccgagccccccagattggaggtagcttcgcagtgttggggggcctgttcttcaccattgacttttgccttgtgcggcttcggggcaaggaggatcccttggaactctatcaccaggttggagcatttacccgggcctgtccttgccttccccagttgcccacctgccatt

SEQ ID NO: 4513 - DNA, 190 bp, Homo sapiens
aaaacctttacactatttctagaaagtcagcatgtatttttggctcgaagtttctctagtgttttctgtggaagggaataaaaatttgagtttcagttgtgtacttccatgcttgaaaaattaagtccttccccctcagttataactcaaccttaatggaattcttttgcccttgtctctgttttgggtc

SEQ ID NO: 4514 - DNA, 335 bp, Homo sapiens
gcacgatgctggagttgctcaaccagcttgacggctttgaggccaccaagaacatcaaggttatcatggctactaataggattgatatcctggactcggcactgcttcgcccagggcgcattgacagagaaattgaattcccaccccccaatgaggaggcccggctggacatattgaagattcattctcggaagatgaacctgacccgggggatcaccctgagagaaattcgctgagctcatgaccaggcagcatcaggggctgaagtgaagggcgtgtgcacagacgctcgcatgtatgccctgcgagaacggcgagtccatgtcactcaggag

SEQ ID NO: 4515 - DNA, 112 bp, Homo sapiens
cacaataatagtagggtgactttcaataactgcactgacagcactagacagttcatcaagacagaaatgtcaacaaagaaacaatcggactagaactaatacctccggagca

SEQ ID NO: 4516 - DNA, 292 bp, Homo sapiens
gatggcccagcagtcctggtggagcagcagactgattcagcaatggagccaactggcccaacccaagagcgctacaaggatggggtggtgaccatcggctgtgtgggtttcctaatgtgggaaagtcctcgctgatcaatggcctggtggggcggaaagtcgtagagtgtctccagaccccgggccatacccgatactttcagacctactctctcaccccctctgtgaagctctgtcactcccaggcctcatcatcccatctcttctgcctaggcagttgcaggatctggca

SEQ ID NO: 4517 - DNA, 205 bp, Homo sapiens
atgagacaaggtgcacctttttatcataaccctctttgccctacatgactttttttactgtgtgcatcccgtagtcctcctaattctctgtctcctccttttctcccaccatcactatcatcgtcattctctcagcaggccagtgcattttctgaggactctctagggcacacggttttatttagagccacatcgctcatagtga

SEQ ID NO: 4518 - DNA, 220 bp, Homo sapiens
gctcacttccccatcaacgttgttatccaggagaatgggtctcttgttgaaatccgaaatttcttgggtgaaaaatacatccgcagggttcggatgagaccaggtgttgcttgttcagaatctcaggcccagaaaggatggatttaattccttgagggaaatagacattagagctgtttcaaattacagcggctttgattacagcaggccacaccagtta

SEQ ID NO: 4519 - DNA, 150 bp, Homo sapiens
ctcgtgccgaattcggcacgggatctggtcactaatactgtgagattatttcagcattgagtattggccggcctacacgtgcttttggaagactctctagctgttcattttttggcaaaatctaactttttggaaaggacctaattttgg

SEQ ID NO: 4520 - DNA, 180 bp, Homo sapiens
tgggttggcaggagatggaaacggaggtgccgcccagcatgggggcaggtccccagtccaccctgcccctcccctgtggagaggacggttagttgggggtttgggctagggctccattctggattcgccggttccgggggaggggtggctctgtgccgataactctgtctagtacgtgtg

SEQ ID NO: 4521 - DNA, 230 bp, Homo sapiens
tttctttaccagtttccggcgtacctttgtctcacgggcacctgtgacggcgacttgcgatatcgcggatgaagcaacgcggttaattgccattgcggcggcaccaggcaccgccgtttttgcttgatacggcttagggttttcaacggcctgctcaagaccttttatggccatacatccccctttaagcggcgacggttaacggaaggcggtacgcccgtccaagccag

SEQ ID NO: 4522 - DNA, 140 bp, Homo sapiens
gaacttagagaagcatcagggggtgtgtactcagtattcaaatcagaacacaagattggaccttttggaaaaattggttcaagctttcctattaggccattggaattcaaaggttagcaggagcaagcaattaggcagag

SEQ ID NO: 4523 - DNA, 170 bp, Homo sapiens
ccaggaagaggtcccaacggtttgcctggagctataggtctccaggtgaccaaggccctgaccagctatggaggaaattggccgagacggttaaggcaaggccccccaagggttggaagaattccttgagattccttgacccccgggacctccttgggtttccgggtttt

SEQ ID NO: 4524 - DNA, 172 bp, Homo sapiens
gcaaggccccttagggcagttctgcctcttggggacaccttaggctgagtgatcgccttcccgtggctgagagctgagaaggtcttcccagactgcacaagttgttccggtctgttcttttgattggcccgtttaaggacttaatcttcctttaaggccccttggcacccat

SEQ ID NO: 4525 - DNA, 185 bp, Homo sapiens
tgagcctcactgtaaagccacttccaggtgaaatggctgaatccaacctttggcgtggttgcagcttgacaacccaggcgctgagcccttggcttgggccaagaggggtagaggttacctccattcttcttaacaattacaatttggttacaaggaattgcttaaggcttccaaattcacacatc

SEQ ID NO: 4526 - DNA, 190 bp, Homo sapiens
  misc_feature 6: n = A,T,C or G
ggagtngtgagggacaaggacacggagctttgggatttgctgacgctgtcattgccgtgagatggggattaaccatgacgtgaccacggcgtggggcggggattatttgcgtcttcttaccccaggggactacaatgtgacttccaattccgagggctaccattcagtgtacaagggactgtctgggtca

SEQ ID NO: 4527 - DNA, 160 bp, Homo sapiens
agaagatgcaggccaacaatgccaaggccatgagtgcacgtgccgaggctatcaagggcctcgtaaaggccaaggaggttaaggccaagattccaaagggtgttagccgcaaggtcgatcgacttgtctacaattgcccacacccaaggtttgggaagcg

SEQ ID NO: 4528 - DNA, 130 bp, Homo sapiens
  misc_feature 49: n = A,T,C or G
atcaaggctgccgttcggcctgcagagtcatcatgccatgtagctcgtnggtcgcccgtatcttgggcatgtgtgttgaaatcacttcatatatacaacgttctcgtgaaaatagagagacttagctcga

SEQ ID NO: 4529 - DNA, 216 bp, Homo sapiens
gaagcgagatgacgaaggggaacgtcatcgtttggaaaagcgtcgcaataagacgcacacgttgtgccgccgctgtggctctaaggcctaccaccttaagaagtcgacctgtggcaaatgtggctaccctgccaagcgaagagaaggtataacctggagttccaaggctaaaggtcgaaatcccccccggatctgtcgaattggggaacctaaaaa

SEQ ID NO: 4530 - DNA, 175 bp, Homo sapiens
cttatgtagataggcacaaaattttgcttataattcttaaagcattccacggacctctgaaggtcttctgttggacctctgaggcccttattaaggattccttgagggaataaaaaatgtatttgtctcgtattcagaaagctgtcgtgttgaaatccctattcttctgtctaac

SEQ ID NO: 4531 - DNA, 135 bp, Homo sapiens
cgcagtactgatcattctattttccccctctattgattcccacctccaaatatctcatcaacaacccgacttaatcaacaaccaacaattgacttattcaaactgaaccccaaaaacaaatggataaaccataca

SEQ ID NO: 4532 - DNA, 103 bp, Homo sapiens
cttgctccaacagtcactcttgaagatttttgccaactccatggatggaggacacttcagtagtcatctagatccttttataaggcaagtttgggggtattct

SEQ ID NO: 4533 - DNA, 140 bp, Homo sapiens
cccaaccatactgtgtgacatttgctagggaattgttggtaaaatcactcgagtgagcgcttgtcctgaggcactgcctctccgcgtgaatgtcacttatctgttccggttgaaccgttgcaatgttatacaagacttga

SEQ ID NO: 4534 - DNA, 162 bp, Homo sapiens
tgcctttgtggggggcagaattcacatgggcaaaagcttttgaaaatcataaaagatataaggtcggtgtgggctaaggatgggaaacaagggctgattcttggattcccaaatttctcaactctyccttttttctattttgaaatttcctctcgcgcttta

SEQ ID NO: 4535 - DNA, 207 bp, Homo sapiens
agaacaatgcctccactgacctatgacctatctgacaggagcatcaaccctctgggtgggctttgtccactatggtgaagtgaccaatgactttgtcatgctggaaaggctgttttggtgggaaaccaagaagcgggtgcttatcctcccccaagtttctttgcttggtgcagacggaagcgtgggggctcttgggggaggtttgtm

SEQ ID NO: 4536 - DNA, 202 bp, Homo sapiens
ccagaatggagcactgattggtaatccaccttctttctttagaaactggcgatggaatatgagaggagccctctggaaagaaaaggacaaaacctgttcttttaatgaaagtaaaggatctggctgaaccaggttccacaagggttactttatatcataggcctgaggtttaaaaggctgtgcccacttaagaatgtcatat

SEQ ID NO: 4537 - DNA, 141 bp, Homo sapiens
ggaccatcggcatttctgtggatccgaggaggcggaccaagtccacggagtccctgcaggccaacgtgcagcggctgaaggagtaccgctccaaactcaacgctcttccccaggaagccctcggcccccaagaagggaggc

SEQ ID NO: 4538 - DNA, 130 bp, Homo sapiens
tccactcattcctcggtgctcagcaccctgaggtgaggctccattgtctcatcagagctgcatgtgtatgccggccttccctggtccggtgatttgtgttccccacccctacacagactgcctgagctct

SEQ ID NO: 4539 - DNA, 210 bp, Homo sapiens
tgtttctgagctttcctgtctttccttttttctgagagattcaaagcctccacgactctgtttcccccgtcccttctgaattttatttgcactaagtcatttgcactggttggagttgtggagacggccttgtagtctcagtacgagtgttcgtgagttttagccaccttggcaagtgcctcgtgtcaggggcccggccgccctccatct

SEQ ID NO: 4540 - DNA, 306 bp, Homo sapiens
ccagtctcttgcacaaattaagtacttaatgtgtgttgagctaaattgaataaaggattattagcattagcatattttgtgccttggttgtataagctggttgtttgttttgttacctttgcaaatatttatgattatcacccccccacatactaaattgtttttaaaagttttgcctttccttcagatactatcccaggcaatttgctgtagataatgtgattgcttccactgacataattatcccacactctctgtcccgggtatactttgtccacacgagatttgtagttctctgtagtaaat

SEQ ID NO: 4541 - DNA, 260 bp, Homo sapiens
ctaggtcgcggcgacatggccaaacgtaccaagaaagtcgggatcgtcggtaaatacgggacccgctatggggccttccttccggaaaatggtgaagaaaattgaaatcagccagcacggcaagtacacttgctctttctgttggcaaaaccaagatgaagagacgagctgttgggatcttgcactgttgttcctgcatgaagacagtggcttgcggtgcctctgacgtacaatatcactttcgctgtcacgggtaaagt

SEQ ID NO: 4542 - DNA, 235 bp, Homo sapiens
ctttgtagagagagtaaaaaattttaacacccatagtaggcctaaaagcagccaccaattaagagagcgttcaagctcaaccacccacctacctaaaaaattcccaaaccattataacctgaacctcctcaacacccatttggacccaattctatcaaccctatgagaggacctattgtgagtataagtaacatgaaaacattctcctccgcataagcctgcgtacagattaaac

SEQ ID NO: 4543 - DNA, 158 bp, Homo sapiens
ccgacccccctgcagtacatgcgggccgaccaggcagccggtggcctgagacagcatgacggcgaggttgatgccacactcaagttcctcaacaacccaggttgaaggagcattccgcagccccgagggttccgcaaggaacccttcttggaacctca

SEQ ID NO: 4544 - DNA, 203 bp, Homo sapiens
ggcggacattcagactgagcgtgcctaccaaaagcagccgaccatctttcaaaacaagaagagggtcctgctgggagaaacttgcaaggagaagctcccccggtactacaagaacaatcggtcttggcttcaagacacccaaggaggctatttagggcacctacattgtacaagagaatgtcccctctcactggtgaatgtgt

SEQ ID NO: 4545 - DNA, 280 bp, Homo sapiens
aagaaggacgctggaaagtcggccaagaaagacaaagacccagtgaacaaatccgggggcaaggccaaaaagaagaagtggtccaaaggcaaagttcgggacaagctcaataacttagtcttgttttacaaagctacctattgataaactctgtaaggaagttcccaactataaacttataaccccagctgtggtctctgagagactgtaagagttcgaggctccctggccacgggcagacctctcaggagctccttagtaaaggacttatcaaactcgt

SEQ ID NO: 4546 - DNA, 210 bp, Homo sapiens
tttggatttaacaaatttgtatttgaaacacattctatgtctgataattcttaatggcacttttactaatttatttggggatcttgggtacattcttaatttgtgtttattcttcacgcttgacttgcaagtggggtattcccctgccacaagtgtcaaacagtgatattcttcctgtgttgtgactgtgagcagatttttccagatact

SEQ ID NO: 4547 - DNA, 140 bp, Homo sapiens
gcggcggttgcggccttttcagcaattgccaagactaaggcgctgagaactctcgcgggaagaagaaggaggagccctctctaaacaacctgacgacccctaaggggtgagccctttccagccctcgcggtctgccaaaa

SEQ ID NO: 4548 - DNA, 141 bp, Homo sapiens
ccagtgcctcctcctgtgggcctggcctcagggctatggacagactcctgtcccatcccagagacccctcgtgatcgttccctggcacgtgggccgtggcccggcttggtcggcttaaggacttcggatggaagctctccg

SEQ ID NO: 4549 - DNA, 161 bp, Homo sapiens
tggtagcagcaaaagtaaagggtgagaaactggataagaagctgaaaaaaatggagcaaaacaagacagcagccactaggtaccgccagaagaagagggcggagcagggaggctcttactggtgagattcaaagagctggaaaagaaggaacgagggctct

SEQ ID NO: 4550 - DNA, 111 bp, Homo sapiens
ctcgtgccgaattcggcacgagaaacatcaattttctgttcattacttactgttttgtctttagggtgtacaacctattgaggcctttggcaaaagcttcgagggattgtt

SEQ ID NO: 4551 - DNA, 120 bp, Homo sapiens
ccacagaagaaaccatttagtgtaatataattccatttacttacatttcaaaccaaaaaaattaaatagcatattgtttttggatacacaaattagtaggtttttaaaaggattattaaa

SEQ ID NO: 4552 - DNA, 135 bp, Homo sapiens
tggaatcggggtgaatggcgtcctccagcctcaggagtatacaagggcttacacctcagtagtactacaccaacagcacttgtacataacaagtgtcctacaacggcagggtccagactttgtttaccaaccctt

SEQ ID NO: 4553 - DNA, 172 bp, Homo sapiens
gttacatactagttgctagttagaatgatcagaatacattttttaggagcggtcatttttattaagttagttttagtagagataaggaaggaagtattttctttattaaccctgacccctttatttgaagagggagttatgggtaattgaaaggagtgtagaaagatttgga

SEQ ID NO: 4554 - DNA, 255 bp, Homo sapiens
caaaggcatatcttctatatctgaagagtatccttccttcaggctttaatagactgagtcagatgggtctgatattaatcaaaattgtctcttctgaggacccctgataagcattgacttgccgtcccctaagggaatccgagcggctacaaagcggtttctttacttctcacttcaattaattctcgtcgctctcgctttgggagagcgtactcttttttatcccctacacacaacccccacatatatgtattt

SEQ ID NO: 4555 - DNA, 175 bp, Homo sapiens
cgaggcgcctggcacagcttccctcttggcctttcatgatgaggtgcctcacaaaccttcctgacagatggggcccccccggggggggggcgttaactgaggatttccaaggcctacgggcagaggtggagaccatctccacggatctggagcttttggacagagagctgtccca

SEQ ID NO: 4556 - DNA, 300 bp, Homo sapiens
gcggctcggactgagcaggactttccttatcccagttgattgtgcagagtacactgcctgtcgcttggtcttctattcaccatggcttcttcctgatatccaggtgaaagagctggagaggcgtgcctcaggccaggcttttgagctgattctcagccctcggtacacaggactctgttcccagatttcccccttcccctccaaagaagaggatctctcccgggaggaaaatacagaggaaataagacgctacagaggagagacgcaggccccatgacgctgaggtctaaggcagctcgc

SEQ ID NO: 4557 - DNA, 400 bp, Homo sapiens
gttaggtagctttagggcaatattgccatggttttactcatgtgcaggttttgaaaatgtacactatgtattatttttaaaattgttttattattttggaaattattgtgttattccatgccaggcctctgcacagaggcctgagagcacaggttgttactctctgtgtacacctagggacacacatgtgtgctcttttggagcccctttttctccccgggctcctaatagaataacgcgcttatggggtatgtgaaatatctctagtggcgtttagagagcccagtaggtaatgtactgcagcatgatgagagttcctgataaatcatgtataacacctgattttggagcaccacacatatggcaggtcgcagtaatgcagccccacagaaactcccct

SEQ ID NO: 4558 - DNA, 135 bp, Homo sapiens
ctgtgtgtgcgtgtgagaatgatcacatgtggcgtcatgctttgtacagagcctcagaacactgggggcttgttcagtgaggggtccctcttggggacacacacacaggggggccgcccagggcgcacacctagg

SEQ ID NO: 4559 - DNA, 131 bp, Homo sapiens
tggcactggcattgtccctgtgcctaacaaccagcgtttgaggggctcggctttctgccctacagaggtctctgccggctcttttcttgctcaaccattggtggaggaaaacagttcaacacacacattgc

SEQ ID NO: 4560 - DNA, 121 bp, Homo sapiens
gaaaatggttcgctattcacttgacccggagaaccccacggaatcatgcaaatcaagaggttccaatcttcgtgttcactttaaggacattcgtgaaacttctcaagccatcaagggtatg

SEQ ID NO: 4561 - DNA, 210 bp, Homo sapiens
caacagcgacacccactcctccacctttgacggtggggctggcattgcctcaacgaccactttgtcaaggttattttcttggattacaacggattttgctacaacaaacaaggtggggggagctcattggccacatatgctctccaggagttaagagccctctgggacacacacaccccagacacagaggcacacacaggggagagagag

SEQ ID NO: 4562 - DNA, 150 bp, Homo sapiens
ataggcgcaagctgataagacaatgctcactgactatgactatctgacaagagcatcaaccctctgggtggctttgtccaatatggtgaagtgaccaatgactttgtcatgctgaaaggctgttttggggggaacccagaagggggggct

SEQ ID NO: 4563 - DNA, 175 bp, Homo sapiens
aaatttttggatggtatctatgtctctgaaaaaggaactgttcagcaggctgatgaataagatctaagagttacctggctacagaaagaagatgccagatgacacttaagacctacttgtgatatttaaatgatgcaataaaagagcctatttgatttggagccttcttcttaaa

SEQ ID NO: 4564 - DNA, 231 bp, Homo sapiens
ctcgtgccgcagaatctctggacggagctgctggcagcttctgcgagaagagagagatgtggaaggcaccttctagaagagagcgtgcctcaggttacttgaacttgaacggagactgtagacttccggactttcccctaggacttggggccctgtaggctgctgttggaggacttggtagagacattggaggggagggaagggcttttctccacacaaagggcagagagt

SEQ ID NO: 4565 - DNA, 190 bp, Homo sapiens
gagacgtcgggagcacagtcgggagagggacagggagagagagagagagagggagccgggaccagggggggaccgagatccggtatagggaaagggcccgagaaccgaggccagggaaagggatcgcagggaccaccaagcgccacaccagaagccggagtcggagcacacctgtccgggaccggggtgg

SEQ ID NO: 4566 - DNA, 110 bp, Homo sapiens
gcccaactggccatcagagtcaccaaccccaatgccaggctgcgcagtgaagaaaatgagtaggcagctcatgtgcacgttttctgtttaaataaatgtaaaaacttcca

SEQ ID NO: 4567 - DNA, 205 bp, Homo sapiens
ctgactttgacacacatggccaccttggcacaaaagccttgtggtatagagaaacaaatttgttttttatgtcctcttctccctttgccatctttcagcataggacttaactcccttaaggccagacatctgttgagacctgaccctagtcattggttaccgtgtgtcaaggcaatctggactttcagtgatgccactgagatgg

SEQ ID NO: 4568 - DNA, 207 bp, Homo sapiens
ctcgtgccgaattcggcacgagcccagatgcagtctacacagaactccagcccacctctccaaccccaacctggcctgctgatgaaacaccacaaccccagacccagacccagcaactggagggaccggatgggcctctagtgacagatccagagacacacaaggagcaccaaagcagctcatcccactgatgcaaccacggccgct

SEQ ID NO: 4569 - DNA, 248 bp, Homo sapiens
ggaactatcttaaggcacatgtgcaatggaatgaataaagaagtggcatatgtccatgggaatactgtaaaacagtgagcatgaatgaactagaagtccgtgtaataacgcagctgaatttaacaaaccttgctgattgaaagactccagacacaaaagccaacatgctgtatgattcctcctatataaattataaagacgggcaaaccttgtatacgtggtttaaaattgagggtggcagttagcct

SEQ ID NO: 4570 - DNA, 233 bp, Homo sapiens
cagaaaatcaatcactttctctttgcttttagaggatagccttgaggctagattatctttcctttgtaagattatttgatcagaatattttgtaatgaaaggatctagaaagcaacttggaagtgtaaagagtcaccttcattttctgtaactcaatcaggactggtggtccatggccctgctgattagatcatgccattcagtggagtcccaaatgaaggtttcatcttccg

SEQ ID NO: 4571 - DNA, 211 bp, Homo sapiens
ctgatgtcggtgcaggagctgaaggtgagtggagtgctgccaagaatatgcccgacttcccatgacaagacagaactttgtaacaaacagtaccaatttattttggccgtggggtttttgcttttttttcagttgatgactttgtgaacaattccaggtatttgaggcctctgttggccttaaatgtctgctcagtggagggagagcccag

SEQ ID NO: 4572 - DNA, 150 bp, Homo sapiens
gaaacattcagtagaacattttattgcctagttgacaacattgcttgaatgctggtgggtcctattcctttgacactacacaattttctaatatgtgttaatgctatgtgacaaaacggcctgatttctagtgccaaaggttcaacttaa

SEQ ID NO: 4573 - DNA, 145 bp, Homo sapiens
cgcatggcttccctgttccccagccccttgctccctctgttgattccggcccctgtcttcagggctcactgtgcaacttcttctgttcactgcttcttcttggggcctgttcattcccagggggtgtccccggatgcaggagggg

SEQ ID NO: 4574 - DNA, 120 bp, Homo sapiens
cctacgcacacgagaacatgcctcttggcaaagggtcttcctcattcctcttcaggagagagaggaagaagagcacacaaaggagggaacggcttgtatcacgagagcccaatttccatc

SEQ ID NO: 4575 - DNA, 110 bp, Homo sapiens
caagattacatgaatcaatcaagggaacttgaaggacagagacagaagagtaaacctttatgacaagggcttcaagaccaattaaggacacatccttcttattttacaaa

SEQ ID NO: 4576 - DNA, 153 bp, Homo sapiens
gtcaagccggatgcctaagtagaccaaatcttgttattgaagtgttctgagctgtatcttgatgtttaggaaagtattcggtacaacttgtaggatctacttttttgaacttttcaatccctgtgaggtgacaaattctctcatatgactagg

SEQ ID NO: 4577 - DNA, 120 bp, Homo sapiens
cttgatttcatttcaattgtcattagttggtattaaccagcaggagaggttgatgagccattttttcaaattgaaataccttttaatttccattataattttttttattttaggagttca

SEQ ID NO: 4578 - DNA, 135 bp, Homo sapiens
ctcgtgccgaattcggcacgagggcggtgtggtcgcagcaggcgcaccaagccctcgaaatgcaggaccggcggccgccgagttcgttgtacctgtacggtgccgggggaaatgttcccgttaggcaattggaat

SEQ ID NO: 4579 - DNA, 230 bp, Homo sapiens
attttatttacaaaatatatactgaatactatacatctggccccatcaccatgggaacaactccaaagcctgcctggggatttgtgcccaagcccagcccaggagggctagagaaagcaaaggtgtctaccagccgccgccattccagaagggaagcctctttccatgagtgtctgtcggtgggcggtgagctcaacacccacaaagggcagaaggctctgggcagtgag

SEQ ID NO: 4580 - DNA, 175 bp, Homo sapiens
cccggtggaggaggtccgcagggagcttctgaagccagacacgtgtttatgaggcgagagagtcactggggaagtcctgcgctccgagggcttcaggagcgtgtccttgtgctccaggtggcttcggaagatctccttggccagcttggccaccaggtgctttctgtagagatcg

SEQ ID NO: 4581 - DNA, 220 bp, Homo sapiens
  misc_feature 53: n = A,T,C or G
cacctccaggtgccccaccgccagctccgcatgtgaacccagctttctttccnccaccaactaacagtggcatgcctacatcagatagccgaggtccaccaccaacagatccatatgggcgaccttcaccatattgataggggtgactatggcccccctggaagggaaatagatactgtaagaacgcgcatatgagtgtaagctctaatttgaagagatc

SEQ ID NO: 4582 - DNA, 120 bp, Homo sapiens
  misc_feature 87: n = A,T,C or G
ctcgtgcgaattcggcacgagttacgaacgcacttacagtcgcatcataatcctctctcaaggacttcaaactctacttccacttanaagctttttgatgacttctatgcgaaggcttgc

SEQ ID NO: 4583 - DNA, 150 bp, Homo sapiens
gtttcctgactttatccaagagcagtgcaatcgtttggtatttcaacttcaaggagagctagggaggagaggaagaaggcttcaaaagagcttgaaggagacagagagccttagagacacagagagagactctcgaaccccacactttaa

SEQ ID NO: 4584 - DNA, 120 bp, Homo sapiens
gtcccctgctatgcctcaggtgaaccacataattcttggggttccgttcctacttgctagggatttctgaacaagttcaatggggccgcacacagtcttggcccacttccgcgatttaaa

SEQ ID NO: 4585 - DNA, 120 bp, Homo sapiens
ggaccccagcttttcttgccaagctcagcagttcactttctagagcatctgtcccactgggacacaaccacctaatttgtcaattgaaccctccctgggcctttcttaaattgggattaa

SEQ ID NO: 4586 - DNA, 205 bp, Homo sapiens
gagaattttaatgtttttcatttatcattgtaaaaccaagggcaattttataactttttttgtacgtgagctgttacatgtaggggcaatcttgtctttaagtaggggataaattactcctaaaacaaaaaaggattctctggtagtgtttcccttcaagtcaagcgtctctgtgtgtttaaataaactctctctgtgttaaaat

SEQ ID NO: 4587 - DNA, 120 bp, Homo sapiens
ggtaatgcatgacaaataaaggattagggttttccctctaatgaaattgtaaggcataagggattttagggtttcttcagagcaaaaattagggtatgcctttaggcgtgatttttgggt

SEQ ID NO: 4588 - DNA, 288 bp, Homo sapiens
ccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccaaatttgacgtgcaactcaaagagcctcggaaaaatggcagaataatct

SEQ ID NO: 4589 - DNA, 220 bp, Homo sapiens
aattataaccaagcataatatagcaaggactaacccctataccttctgcataatgaattaactagaaataactttgcaaggagagccaaagctaagacccccgaaaccagacgagctacctaagaacagctaaaagagcacacccctctatgtagcaaaatagtgggagagatttataggtagagggcgacaaacctaccgagcctggtgatagctctgt

SEQ ID NO: 4590 - DNA, 200 bp, Homo sapiens
gtttcaacagcatctctgctgttgacaatggctctctggccaacacgcctcatctgagggagcttcacttggacaacaacaagcttaccagagtacctggtgggctggcagagcattaagtacatccaggttgtctaccttcataacaacaatatctctgtagttggatcaagtgacttctgcccacctggacacaacac

SEQ ID NO: 4591 - DNA, 183 bp, Homo sapiens
gcagaacccaccaaccagaacgtgggtttgcctgaggctgtaactgagagaaagattctggggctgtgttatgaaaatatagacattctcacataaggccaggtcatcaccatttcctcctttacccttcaggtgcagtttcttttcacattaggctttttggtcaaaccttttggggcacgg

SEQ ID NO: 4592 - DNA, 110 bp, Homo sapiens
acagtgtgtttaataaattgtaattattttgtgtacagatctatactgttatctgtgtccatttccaaaacttgcacgtgtccttgaattccatctgactctaatttaat

SEQ ID NO: 4593 - DNA, 123 bp, Homo sapiens
cacagcgccatctctccctgagaataaagccgatagccaccctcctccggctccgagcctgcttctgccacacctcgctctcagttctctccacatttccatagagaccctgtggtttttgtt

SEQ ID NO: 4594 - DNA, 110 bp, Homo sapiens
ctttaatccttccactatcattcccattttgttacatttctgttatggggactttatgttgaaatattgtataaagcatttgtagcaatttaaaaataaaatatttaaaa

SEQ ID NO: 4595 - DNA, 213 bp, Homo sapiens
gcattgtgcaatacagtttcattaactccttcccccgctcccccaaaaatttgaattttttttttcaacactcttacaccttttatggaaaatgtcaacctttgttaaggaaaccaaaataaaaattgaaaaataaaaccataaacatttggcaccacttgtgggttttgaatatacttccacagagggggaggttaaaacccacaacttcca

SEQ ID NO: 4596 - DNA, 190 bp, Homo sapiens
ggaaacgccacctggtggtccctttaactgaagctttgccccctgcccgaaaggaaggtgattttgcccccacttgttggtgtatattgttgaccagaccccgggagcggcccatgtagaaagagagagacctctatctttcatgcttgcaagtgtaaatatgttacagaacatgcacttgccctaataa

SEQ ID NO: 4597 - DNA, 110 bp, Homo sapiens
ctcaggggctctagggactgccaggctgtctcagccacggagggcaaaatcaagagtgagatggtagagaggtgttaaaattaggaaaaggtggaagttggtgaattcgg

SEQ ID NO: 4598 - DNA, 165 bp, Homo sapiens
cagtcaaactgactcttggggaaagcaaccctcaagcacgatacccagagcatggtagtccaagggctttggcataccctaccatagggaattgggtctctgccaatcgcagagaggcacactcattctagaggaaaattccagtatgtataggtagtttcccag

SEQ ID NO: 4599 - DNA, 110 bp, Homo sapiens
atttcaactgtcagcatgatttccaggctccatatcttctacataggaaaatatgtcaaagagcaggagcagttgactttaaccttgagaccatcccagcgggagggcca

SEQ ID NO: 4600 - DNA, 120 bp, Homo sapiens
ggaaacaaagcttagcaggagaggagagccagagaagtgcacaaggaagcttacaaggttacaacaagattttgtgaacttcagcccaggcaccagttggttggccaggcccttagcttc

SEQ ID NO: 4601 - DNA, 115 bp, Homo sapiens
cttttttttcccactaagggtattttacttttaaggtagcttcgaatatagcaatacaattttaaaaatttaaaaacttgaattttttggtatcctattttaagggaatattatg

SEQ ID NO: 4602 - DNA, 110 bp, Homo sapiens
cgcgggccttgccagcgagcaccctcatcgggctgtcgctgacagcatacctcaaaagggcctagctaataaacctgtaaggccagcatttgagagaaggtagggtgtgt

SEQ ID NO: 4603 - DNA, 152 bp, Homo sapiens
ggggaattctccgcgcctcgaccttcccgacgacagacgtctcgtccaatcatggtgaccctgccttgctcgcagttcttgaggatgctgctatcgaaccttcgtgacttacggtgacctagttacaacaattataaggggatatttttaaa

SEQ ID NO: 4604 - DNA, 168 bp, Homo sapiens
ccggatcacctgttttgaaaccatcttccaagccatgctgaatgctgtggacccggatgcaagtgtcaggcatgggaagtcattgtccacatcatcgaggaggacaaaatcaacacacacggacaatgaagggccgaattggcttaccctgtttccagaggcccactt

SEQ ID NO: 4605 - DNA, 380 bp, Homo sapiens
tccaaaactacagccttccctgaagtttaagctgtgaccttagattttagaaggacagtggggctgtacctagaatagtggttctcgaagaatgcggcctgcagatcctgggagtcccaagaccctttcagggaggatctgtgaggtcaactgttggcactgtggcatgaatcaaggtggtggcagcaaacttctagtagttttgatatgtccttgatagaacaaatagcaattggttaactattaaatgttgacctagccagcgcagtggctcatgcctgtaatcccagcactttgggaggctgaggcgggcggatcacctaggtcggagttcgaggccagcctgaccacatgagaacccgtctcttttaaaaaaaaaa

SEQ ID NO: 4606 - DNA, 225 bp, Homo sapiens
ctgacagactcgctcaggaccctgaagcccgaggcaacatccttcgagaccggttcaagagcttccagaggaggaatatgatcgagcctcgagagagagccaagttcaaacgcaagtacaaggtgaagcttgtggagaagcgggcgttccgtgagatccagttgtagctgccatcagatgccggagactcgcccttcaataaaaaatctcttctagctgaaaaaa

SEQ ID NO: 4607 - DNA, 330 bp, Homo sapiens
ggcggtagttggtgtgtcctcggtttctcggctgctgggtcggtcccgcccacagctggggcgccctatgtcgagtggcgcccatggcaaaggagggctcagctcgcatgtggaggactctcaccttcttcgtcgcgctccccgggtacgccagtcagcatgctgaatgtgtacccgaagtcgcaccacggagagcacgagagacccgagttcatcgcctaccccatctccgcatcagaccagccgtttccctggggagatggtaccatactctattccataaccctcatgtgaatccacttccactgctacgaggatcgataagggatt

SEQ ID NO: 4608 - DNA, 360 bp, Homo sapiens
gcgctacgtcgtcctacctgctggctgccctagggcaaactcctcccccagcgccaaggacatcaagaagatcttggacagcgtggtatcgaggcggacgacgaccggctcaacaaggttatcagtgagctgaatggaaaaaacattgaagacgtcattgcccagggtattggcaagcttgccagtgtacctcctggtggggctgtagcgctctcttctgccccaggctcttcagcccctcctctgggttctgcccctcctgcagcagaggagaagaaagatagaggaggagagtctaagagtcaaatatgacatggatttggccttttgataaattcctcctccctccaaataagcctt

SEQ ID NO: 4609 - DNA, 205 bp, Homo sapiens
agatgacacacttggttctcagattgctgaccaccacttgtctagtctgcttggtggctagggacagcagaagtagaagaggaaatagatctggctgagtggaagagaggacagaattgggaggggagggaaagtgaagacaaggcagacaaagtggaaagcccctaatgctcttagaagaagtctaaaacccttcgtctttttc

SEQ ID NO: 4610 - DNA, 238 bp, Homo sapiens
ataaaatgttccttttgacaatatacacggattattatttgtactttgttttttccatgtgtttttgctttttatccactggcattttttagcttcttgaagacatatcatgttgtgagataactttcctttcacatctcccatggtcctagcaaaattgctaggcctgtagtagtcaaggtgctcaataaatatttgtttggctggttgtgagccttgctgccaagtcctgactttg

SEQ ID NO: 4611 - DNA, 142 bp, Homo sapiens
gttatgaaaagaccttagagatgagagagaactttcagaagcagttacaaggagataatgtctgcaacatcaatagtgaaaccccaagggcagagggcttccctttcaagaagtggttgataacagcgaatcgtcaacccct

SEQ ID NO: 4612 - DNA, 151 bp, Homo sapiens
gcagaatggctcccgcaaagagggtggcgagaggaaaaagggccgttgtgccatcaacgaagtgtaaccccgagagtacaccatcaacattcacaagcgcatccattggagttgggcttcaagaggcgttcacctcggcactcaaagagat

SEQ ID NO: 4613 - DNA, 101 bp, Homo sapiens
tgtggctcagagcttttacttgaggtgctaaccttggctgctttctccagtatggacaagatttgaagtacagaattttcaggccagcaggcccatacaag

SEQ ID NO: 4614 - DNA, 103 bp, Homo sapiens
ccttttctttcatggttttccttcctatttcttgaaagatcttagtaagccaatgctacagataatctgggattggagatgcattccacccttaacctttttc

SEQ ID NO: 4615 - DNA, 161 bp, Homo sapiens
ctcgccattttgggggaattccaacagttctaccttttgaagattaatgagaagggaagaaagaaagcaacttatgtgtcatctactgtgtactgggaacattaagcaaattttatttaatccttacagcgacattacaatgaagcattattattacattt

SEQ ID NO: 4616 - DNA, 127 bp, Homo sapiens
cccaatctaagcagactttgccttttttcaaaggtagagcgtgaataccagaaggatccagtattcagtcacttaaattaaggtctttgtggcaagaattacctttttgcaacaggcttccttgaat

SEQ ID NO: 4617 - DNA, 130 bp, Homo sapiens
gtgaaaccaattgtgttcatctagatagtaagtaactcctatttttactgttaattttttaaaagagaatttttccctgtggaaactccctgttagtacgtcctcaggggagaaagcctgtagaatatag

SEQ ID NO: 4618 - DNA, 270 bp, Homo sapiens
ctgtcagttctagttctctgttatgctgaactttctctataaccttggagaagtcatctcaatctctatataccacacctttcttatctgtgtaatctcttagttcttttagcttcaaaaggatatgaattggcaactgaagttggtttgtctcaactctcctgagagcctaactgtcaaggatggcatcatgttggaaaacacatcagagctccagcgtgcagtttcagggatgcttttaaaatctacatgggcgtggagactctaaga

SEQ ID NO: 4619 - DNA, 305 bp, Homo sapiens
tggctgtggagctgggcgtgctgctcgtccggcccggccggaaccggctgggtagagtgatgcggaccctctgcttgtgctgtgcttgcgacgcgcggaagccttcttactttcacaatcggagagacggagaaggaaggtctttttttaagagattcccgaccgaaccattgtaaataggaaactatccgacgcaactctatataaagcaacgcgaggggtatccacccgcacaccccgggctctgagcattgttttgagatgatgaggccccagagcacagtatcttctgccccaagcagtat

SEQ ID NO: 4620 - DNA, 235 bp, Homo sapiens
ccgagatgtctcgctccgtggccttagctgtgctcgcgctactctctctttctggcctggaggctatccagcgtactccaaagattcaggtttactcacgtcatccagcagagattggaaagtcaaatttcctgaattgcctatgtgtctgggttcaatccatccgcaattgaggtggcttaactgaggattggaagagagattagaaaagtgtggacgcttacagacttgtctt

SEQ ID NO: 4621 - DNA, 265 bp, Homo sapiens
tccaaacacaattttccacattagcagctccaatcttcttaaataaagctctgtttttcctatatctttatgactgctgagacccacagggaccaatatttgtattcaaattacattcaatggttcccattggtttaaaatgaggtctattaattgggattactatatattatcccaggattgacaatgcccggattgctttcagtatgtgtttaatgtagagatttcctctcatgacactatgtgtatatatctctgttccctg

SEQ ID NO: 4622 - DNA, 107 bp, Homo sapiens
ctctcaacctgtgcgggctgctgcgtcccaggactgagacgcaggccagccccggcccctagccctcagggcttctttcttatccaaataaatgtttcttaatgagg

SEQ ID NO: 4623 - DNA, 265 bp, Homo sapiens
ccacgagtcatgtcaacacagcgtgttgctaacacatcaacacagacactgggtccacgtcctgcagctgcagccgctgcagctacttctgctgttcgcaccgttccacagtatcaatatgctgcaggaggtcggaattcttagcaacctctttatgcacgagcacaaggttcacatgcaacagaccttctgtttcatgtatacagggcaggggcccctgtgctgtgtttccatgtgtggtgtgtccctcctcatgaggcgaaag

SEQ ID NO: 4624 - DNA, 245 bp, Homo sapiens
gggagaggcaggtactcacttggagtgctctaggctggtgcatacttggagcagggctggaagggctaaaggaccgttgccctgcagagggtacttctaccatcttcagcaagggtgaagggttggccaactcactgatgagccaagataggacttaagagtcaagagttgtgtctcacaaagggacactactgtcactctcaccagggcacatagagtcagatctttgtgtgcacattctcgca

SEQ ID NO: 4625 - DNA, 300 bp, Homo sapiens
ttctgacaccctgttcccatcatccctgactgagtactctgacatcacggaaagtgttgaacctgggaccctgaggaattcaccaggagtaaatggctttcatgtatttgtgttgtttgctttttcttacgtgattttatgttcatagagctagaaagtagcatctcatgatggcccaacaatctctgttgccagattaaaggttcctctgagatgaggctgaataattatgaacctcacctcctctgattgttggagttgcacgaactcgggagacgtcctccataagtagagcacaga

SEQ ID NO: 4626 - DNA, 270 bp, Homo sapiens
aaaagaccattgtagtaaataagttcaaggggaacttgggaccagaaaccactgttatgtacaaaaaaaatggcaaattcaataaactcaaatttaaaataatttttaaattaacagttatgataaattttatattttatacaaatagattgcttaggatggttctcaagaattataagagaaatgtactcacagtgcaaaaattttataattactatactctgtgttttgtttggggggctggggaatgtgttttttacatgtagcgca

SEQ ID NO: 4627 - DNA, 240 bp, Homo sapiens
ggaagacaaaggcgctttggctaagctggtggaagctatcaggaccaattacaatgacagatacgatgagatccgccgtcactggggtggcaatgtcctgggtcctaagtctgtgtgctcgtatcgccaagctcgaaaaggcaaaggctaaagagacttgccactaaactctggttaaatgtacactgttgagtgtttctgtacactaaaataaattgagatatatatcacatatttcct

SEQ ID NO: 4628 - DNA, 265 bp, Homo sapiens
cagaggaggatttcctaggtaaagggagagaagcataagatgacaatcttaggcaaggaggcacaacttaagttaaagcttagaggtagaaaatgacctagtacctttataggcagctaccagcattttagtgttactatgagggacagtacaaagcagggagttggcccggcgcggttgctcacgcctcttattccagcacttttggagggcgcgatatggcgggtcacgcggtcagagatctagaccattctctcttcacact

SEQ ID NO: 4629 - DNA, 225 bp, Homo sapiens
cagttgaagaggcaagatagttcccagctttaataaataactgcggccaggcgcagtggctcacgcttgtaatcacagcactttggggaggccgaggcaggtggatcacttgaggtcaggagtttaagactagcctggccaacatggtgaaaacccgtctctactaaaaatccaaaaattagctgggtgtggtggtgactggctctactctggagtctgagacag

SEQ ID NO: 4630 - DNA, 255 bp, Homo sapiens
tgaggccctcacttcatccggcgactagcaccgcgtccgcagcgacagccctacactcgcccgcgccatggcctctgtctccgagctcggcctgcatctactcggcctcattctgcacggacgatgaaggtgacagtcacggggggataaggatcaatgccctcattaaaggcagccggtgtaaatgtttacccttttttggccttggctttatttacaaagaccctgtccaacgaaacattgggagcctacaat

SEQ ID NO: 4631 - DNA, 150 bp, Homo sapiens
gggctatttaaaattttattgactaatgtgcaaacttttttttttggttattgatgtttgttttaattccgctgtggccagataactactgtgtaagatattaattctttgaaattgatgagagtagctcaacctcacttttaggaaagg

SEQ ID NO: 4632 - DNA, 252 bp, Homo sapiens
cccacatgttgtgggagggacccagggggaggtaactgaatcatgggggctggtctttcccgtgctattctcgtgatggtgaagtctcacgagatcttatgggtttatcaagggtttccacttttgtttcttcaatttctcttgccaccagcatgtaagaagggccctttgggcttcctccacagatatctgagggctccctagagcayatgggagactctaatggcacattaaaaccctctttctttccca

SEQ ID NO: 4633 - DNA, 240 bp, Homo sapiens
cggcacgagtaaaaggcagcgcagtcaggatattggtaggtcgggggcggctttggaaacccttaagtttacaagcatgcgcggacttgagtgctcattaggtcgccgggcgtcacgtgcagccctggagccctgaaccccggcgtgcgttgggccgtgggccttcggggaaaggttccctgcactctgggggctctccgtgaaggcgctttacacccgctcttttaaattgggcacatc

SEQ ID NO: 4634 - DNA, 232 bp, Homo sapiens
gaatcagtcacaatgaattttacttgaatattgtatgttgcattccacttcatttgaaaataatgaaaccatgtaccactgtttacatcatctgtagtgatttcatagataatatatttaatatgacagagttatgtttcaactctgtagatgtttaacgtcatagacagattgggcctctgtattcgtgagctctatatctgtgtaattcaaccacgcgttgggggggaaa

SEQ ID NO: 4635 - DNA, 285 bp, Homo sapiens
gtctctctgacctcatattctactctgtcttacttaatctgctgtaatcacaccagctccttcactactgtggaacatggcagtcatattcctgcatcaaggcctttgcacttgcagttccctctgcctgaaccctctgcccctcttcatccttgacctcatttctttatcttcttcatgtcttctcactcagttgtcaatttctcagtgaccttatatgaccacctatttaaaattatattgtgctcgccctagcattctcatgtgtcttcccgtctcttctcc

SEQ ID NO: 4636 - DNA, 286 bp, Homo sapiens
gttcaattccaaacagctgctttatttggagaaataccgacctaagatgcgattacgcttcagagataccaatgggcatttctgtgttcagtaggagggaaatgtaaacgaggcctgacttgattgtgccatttagggggaacctctggtaccctgggaatgtgaatctggataataccctgtctaatcaaggaggtattgggttaggcactcctaacccactttctaatgttggcacagcgcacacaaagagagtctctctatatgtgatatgtgttgagagaga

SEQ ID NO: 4637 - DNA, 396 bp, Homo sapiens
ggcactcagaatggtccagcgtttgacataccgacgtaggctttcctacaatacagcctctaacaaaactaggctgtccgaacccctggtaatagaattgtttacctttataccaggagggttgggaaagcaccaaaatctgcatgtggtgtgtgcccaggcagacttccgaggggttcgtgctgtaagacctaaagtgctaatgagatggtccacacacagagacatgtcagcagggcctatggtggttccatgtgtgctaaatgtgtcgtgacaggatcaggcgtgctttcctcatcgaggcgcagcaaatcgttgtgaaagtgttgaggcacagcacagtgtcagaagctaataaaaaatgaaactttttgagtataaaatgaaaagccgtgt

SEQ ID NO: 4638 - DNA, 230 bp, Homo sapiens
cataaaagaagccgccctagccacgtcccctcgcagttcggcggtcccgcgggtctgtctcttgcttcaacagtgtttggacggaacagatccggggactctcttccagcctccgaccgccctccgatttcctcttccgcttgcaacctccgggaccacttcttggccactctgcttctggaccttccacaccgttttgtgggtagtcctcttccaaccaccagtggccc

SEQ ID NO: 4639 - DNA, 210 bp, Homo sapiens
ctcgcctgccaccggtgcacccagtccgctcacccagcccagtccgtccggtcctcaaccgcctgccggccggcccaccccccaaccggaggccatggacggccatcaaggaggagatgcaggtgctggaggttgacaaggaggacggcattgaccggccgaggaggccggaggccacaaggagcaagcttagggacccttcaaaacttg

SEQ ID NO: 4640 - DNA, 121 bp, Homo sapiens
ctcgtgccgctgagctgaaggaaaagattgatcgccgttctcgtaaaagctggaagatggccctaaattcttgaagtcttgtgatgccgcccattgttgatattggttcctgcaaggccca

SEQ ID NO: 4641 - DNA, 239 bp, Homo sapiens
gaaccatggagggtgtagaagagaagaagaaggaggttctgctgtgccagaaacccttaagaaaaagccgaggaatttcgcagagcttgaggtcaagcgccttagaaaggaggtttgcccaaaagatgcttcgaaggcaagggaggaggcttttctttaaaaggcaagctctctcacaggatatatggacagtatgacacagatctcaaattgcgatgcgcgagtatgcgcaagaaaag

SEQ ID NO: 4642 - DNA, 195 bp, Homo sapiens
ctactttcagggagtagaatcctgggattttttgaaggatactgtaagatggtgattatatctcaggaggggttccgtgggtctgtaccctttctgccacaagcaattatgaagcacatagggttgaggaagccaattaactggttgggtttggttattatttcaattatacacatggttgagtaaatatctcca

SEQ ID NO: 4643 - DNA, 290 bp, Homo sapiens
gggctgaggatttttggtccgcacgctcctgctcctgactcaccgctgttcgctctcgccgaggaaacaagtcggtcaggaagcccgcgcgcaacaaccatggctttttaaggataccggaaaacaaccgtggagccgaggtggcaattcaaccgattcggattacccttacaaggccgaacgtaaaatccttggaaaagtgtgtgtcctgtctagatagaggcgcaaaggaagagtctctcatgtgagagcccagctcgtagtcctacgagactagagagtactacaga

SEQ ID NO: 4644 - DNA, 165 bp, Homo sapiens
gttttgttactgatattgtatgtattcatatgcattgtggatcatgcaccatgaaacttgaaaattgttccaacatctcaatgggccacacagtttgtagctttttgcctgtaaaccgtgtatgtaaccatttgaaccgcgtatactaattacctaactcctttt

SEQ ID NO: 4645 - DNA, 136 bp, Homo sapiens
gcgggtccgctgctggcagcgctggaaactgggtggacggcatgggttggtctcaggatttgttccccggccttgtggagatcgctgtcaagggaagttaaagagcacgttggcacggaccaattcggggacaaat

SEQ ID NO: 4646 - DNA, 180 bp, Homo sapiens
aaagtttgaagtcaaaaaggtgatcgaattgcacagctcatttgcgaacggattttttatccagaaatagaaggaggttcaaggcctttggattgacacccaaagggggttcaaggggggttttggttccacttggaagagattaaaatttattgccaaggccagagaaacaaggaggca

SEQ ID NO: 4647 - DNA, 180 bp, Homo sapiens
gcattcttataagttctaaatttatgtttattataattcatatctggtagagtctcagtgttttcacatttgaaatccacttaaattgcaaatggttccttataattgaatggtgtttcctgggattcctaataaaaaatatggattgcttttttaccaaaccagatttattcacagaga

SEQ ID NO: 4648 - DNA, 145 bp, Homo sapiens
ccaagataacgagtgatgagccactcaccaaggatgacatcctgtgtttttgcggcatgctgagttgattgcaagcaacctttgttggatccaagtgcaaggctgttcctcaagcttggcctcttaaggagcctccttgatgatg

SEQ ID NO: 4649 - DNA, 116 bp, Homo sapiens
aacaagttacaaattgcaatatttgagaaggatgtaattatttatattacagatgtctatcaaggtttttcccattttacaattttaacctcatatattctcgatagggtggggaa

SEQ ID NO: 4650 - DNA, 120 bp, Homo sapiens
ctttgctgagatgaacaggggctcgaacgagttggaagacggttgtgggcggtgcatgttcttcatcggtttcaccgcgctcgttatcatgtggcaggagcactatgtgtacgggcccct

SEQ ID NO: 4651 - DNA, 190 bp, Homo sapiens
cagcaggcgcaccaggcctcgaaatgcagaacgacgccggcgagttcgtagacctgtacgtgccgcggaaatgctccgctagcaatcgcatcatcggtgccaaggaacacggattccttccagtgaaccgtggccagaggttacaaaggcacacagcagggtttattggccatttaaacttttttcgcta

SEQ ID NO: 4652 - DNA, 115 bp, Homo sapiens
ctttaaggtgataagacttagaagaggaaggccagactttctaccaatagcaatctcaaatggccaaacacaacctaaaattgcctaagttaggaagcagccccaggtggttcaa

SEQ ID NO: 4653 - DNA, 320 bp, Homo sapiens
cgagaatgagactattctcagcaatcagactgtcgacattccagaaaatgtcgacattactctgtaagggacgcacagttatcgtgaaggggccccagaggaaccctgcggagggacttcaatcacatcaatgtagagctcagccttcttggaaagaaaaaaaagaggctccggcttgacaaatggtggggtaacagaaaggacctcgctaccgctcggactatttgtagtcatgtacagaacatgatcaagggtgttacactgggcttccgttacaagttgaggtctgtgtatgctcacttcccactcaacgtgttatc

SEQ ID NO: 4654 - DNA, 320 bp, Homo sapiens
ggcgaaacgggagggagtgacccctgcgcccctcagtcccccctacgacgtcgcctccatagtctgcggagaagcggagactgcgcgcctcgcctcaaaagccgaaacgccgcgcactcggagccggcacgctcggccgggtatgtggttttttgcactgaatgtaacctagactcatctcacgggcttttgttgccccaggtactgtcaaaggcagtatttttgtgtttctgcagagttttgaccaaaatctgttccatgcaaaccaatgagggagagtatcggagaaagcagttccagatggacagaggatttgtatg

SEQ ID NO: 4655 - DNA, 191 bp, Homo sapiens
ccgagcaggaattcggtgtggacatagggccggtctgttcttgtaaaacctgaacccagaaacaacacaatccgttgacaacccaaaggacccaagtactttccaattcagtactctaggactctgaactgaatggctgacctgacctgactgtcaattaatccaaccttttaaagttggactcttttctc

SEQ ID NO: 4656 - DNA, 246 bp, Homo sapiens
caacatttcaagtgctttagagccatgcatgattagtggttaccctattgaatagggtagaagtaggatctttttcatcatcacagaaagttctatttgggcagtgctcttcttggtcatcatagggcttcagagcacttttcaaagctcatgcatgttcatcatgttggtgtcgtattttgggctggggtttttggttccccttggggtatagagaccagacccagatttgtgctcaatttcaat

SEQ ID NO: 4657 - DNA, 130 bp, Homo sapiens
gtgcctgcaatcccggctgctcaggaggtcgaggtgggagaatcacttggactcaggaagcagaggttgcagttagctgagatcgtgccactgcactccagcctgggtgacaagagcaagactctgtttc

SEQ ID NO: 4658 - DNA, 271 bp, Homo sapiens
ccggctaattttgtatttttagtagagacggggttttgccatgttgccaagcttgtctcgaactcttgacttcagatgatccatctgccttggcctcccacagtgctgggattacaggcgtgagcaaccaatgtcccggctctttctcacctttacaactttcttcttatcctcacatctgtttttcacaccttcatacctgtctctctcatgttcacacttgtctttcccatgtgcatagctgtctctctaaccattttggtgtgaaggg

SEQ ID NO: 4659 - DNA, 285 bp, Homo sapiens
agaaagagggaggtaaagacagagctttgaaaggagtttttcgagtgggagtattggcaaaaggattacttctcccaggagatagaaatgtcaaccttgtttttcttgttctcagagaaaccttcaaagacattatttaagccgtatttcagaaaacctaccccaaacagctttcttttattagcccctagagggattacataaaattgtcttttttttaagcggcaatatatttttaatttagtgtgtggcccacaaattcaagcactatctcactctcaatct

SEQ ID NO: 4660 - DNA, 305 bp, Homo sapiens
tagatgctttgctgacttgttcagctctgtaaaaacacagaaatcagacccattttgtaaagcggaaaatcatgttacatggaacatgtcctgtatatatcacatacatggtaatggagtcttaatgataagtgcaagataataatttaatgatgggattagtctgatcgcttaatatgcacaatcctggaagtgaattacttgcatcagatatagtgatatttattattctgtacagagagggaaatacatataaaacatatgcttacattacatgcacgcggggtttcatgctccctaatctc

SEQ ID NO: 4661 - DNA, 235 bp, Homo sapiens
ctcaagagaacaaccagatctttgggctcctggggtgtgtgccatgcaatttagacgaagtgctttgaaaatatgccattcagtctctgactaggaaaataagtctgacctgataggtccgatgtcatcagctcttcaacatgagacaaaagagggggttttatgttttgagtcattagagtgatataataatttctctgagcttgacatctgtgatgttgatattaggatggtg

SEQ ID NO: 4662 - DNA, 304 bp, Homo sapiens
tcaggctggcacccccccactgccccagcctgcgctataccacgttcccctgatgcttgccttgtgccgggccccagaacccagggtcatggggttcacagcgcgggagtagcgtctcaatgttgtgagttctggggatgaggttcggggtatgattacagcttggaaatggctgattgccattatggctcctccttgccagaggtaaacgggtctggtcccagaacaggaggaggacatgatgatgactggagtaacgatgaagagctctcgagaaggacaggacttagagcaagatacttgg

SEQ ID NO: 4663 - DNA, 182 bp, Homo sapiens
cacctaatgcccacaaggtactctgtggatatccccttggacaaaactgtcgtcaataaggatgtcttcagagatcctgctcttaaacgcaggcccgacgggaggccaaggtcaagtttgaagagagatacaagacaggcaagagacacagtggttctttcagagaacttgcggttttagat

SEQ ID NO: 4664 - DNA, 133 bp, Homo sapiens
gcgagttcgaggaggaggctgaggaggaggtggcctagagccttcagtcactggggaaagcagggaagcagtgtgaactctttattcaattccaacctgttccgtggcctgttccaatgtgtgcaattgctgt

SEQ ID NO: 4665 - DNA, 240 bp, Homo sapiens
cggaaaatagcctttgccatcactgccattaagggtgtgggccgaagatatgctcatgtggtgttgaggaaagcagacaatgacctcaccaagagggcgggagaactcacttaggatgaggtggaacgtgtgatcaccattatgcagaattcacgccagtacaagatcccagacttgttcttttaacaaacagaaggatgtaaaggatgggaaatacagacacagtgcctcgccaataag

SEQ ID NO: 4666 - DNA, 155 bp, Homo sapiens
aggttagccttgcctatcctacatcttgcagaaatccgtcttccccccaaatggcatgcagatagaatccttctttacttttactttcattttagatctcccctttgttattatttagctagtcccttttgtcaatttaatggagatttggaaat

SEQ ID NO: 4667 - DNA, 153 bp, Homo sapiens
gcccaaccccctgctgccagtcagggcgcacaaaccccaggagagaaggcggaagcagcagcgactctaaaggcagccccaagctggctaaagcggttcctggtatggaaacctaggcccgcgcagtacccgggcccaaccgccctagattca

SEQ ID NO: 4668 - DNA, 285 bp, Homo sapiens
caaatggtgactgggcgtggtggctcatgcttgaaatcccagcactttgggaggccaaggcgggcggatcaccttaggttcggagtttgagaccagcctggacaacatggtgaaaccctttctctattaaatacaaaattagcttggcgttgtggtgcatcctgtaatcccagctactcaagaggctgaggcaggagaattgcttgaccgtgggaggcagaggttgcagtgtgccaagatcacaccactgcactccagcctgggagacagagtaagactctttct

SEQ ID NO: 4669 - DNA, 155 bp, Homo sapiens
atttagagcattcccaggccccgagggcttccgcaagaacccttcttggaacttcagagaacctaaacttttccaaccttaggtggaggatttgagattttctctgatttacacccaaacacaggctctcacacctttgacgcgcatttaaaggg

SEQ ID NO: 4670 - DNA, 322 bp, Homo sapiens
cataaacttaactctgcaatccagctaggcatgggagggcacaagggaaacatgggacccaaaggggacttcagccagagcacaaaggttctagggtacttcgagcaaatggggttgaggggtgctctctctgagctacagaaggaatgatctttgtgtgttaagataaaacacacagtccaaactctattcgagttgtccacagtcagcaatggtgatcttctttctggtcttgccatttctggagccccaagcgctccatggcctccacaatattcatgccttctttcactttgccaaacaccacatgttttccatccaa

SEQ ID NO: 4671 - DNA, 346 bp, Homo sapiens
caggaggcccagcggcccaattcttggtagaaaaagcaaagcaggaacagcggcagaaaattgtgcaggccgagggttaggcccaagcttccaagatgctttgagaagcacttagcaagagacccttgctacatcaaactctcgcaagattcgagcagacccagaaatatctccaagacgatcgccacatcacagaatcgtatctatctcacagctgacaaccttgtgctgaacccacagggtgaaagtttcaccacgggggagtgacaacctcatcaggggtaagaaattgagccttgtcaccacgagctcccccccccgaggaaggtggttcttcttctccagc

SEQ ID NO: 4672 - DNA, 114 bp, Homo sapiens
catgcttgggtttcctacttcagctacttcgtctccttccctgtctctcagcagttcccccaccaaacctttgctgcagacttcacacaactttcacacaactctctctctctc

SEQ ID NO: 4673 - DNA, 212 bp, Homo sapiens
aaagaaattcggcacgagcacaaatttgcgcgcctctcctttctgcctgctccccaagctctcggaatacaggccgaacaccaatgggtttcggagaccccgaaaagcccctgccggccctccaggtgctcaacgattacctgtgcggacaagagctacatcgaggggtatgtgtccatcacaagcagatgtgtgcagtatttgaagccgtg

SEQ ID NO: 4674 - DNA, 125 bp, Homo sapiens
ctgcacgaggaaagaggataaagggccaaaagccaaattgaactgagtggtacttagtgtttcaccattggggctaactttggcttgctaaggaggttgcaagccattgcctgcaaattcggcct

SEQ ID NO: 4675 - DNA, 210 bp, Homo sapiens
ctcgtgccgttcaaggtggaagacctgaccttcacctccccgttctgcctgcaagtgaagcggaatgactacgtgcacgccctggtggcctacttcaacatcgagttcaaacgctcccacaagaggaccggcttctccaccagccccgaagtccccgtacacgacactggaaggcagacggtgttctacatggaggacttacctaaccgt

SEQ ID NO: 4676 - DNA, 225 bp, Homo sapiens
atccctcccttaccatcaaattcaatttggccaccaattggtactgaacctacgagtacaccgactacggcggactaatcttcaactcctacatacttccccccattattcctaggacccaggcgacctgcgactcctttgacggttgacaattcgaagtaggtacttccggatttgaaggcccccaattcggtattaataattaccaatcaccaggacggcttg

SEQ ID NO: 4677 - DNA, 185 bp, Homo sapiens
cacggtctgatccggaaatatggcctcaatatgtgccgccagtgtttccgtcagtacgcgaaggatatcggtttcattaaggttggactaaattctcttcccttcagaggggttattccggggcatcttcttaattgaaaaaccattataattctttgtatattaaataaacatttgaaaaaacc

SEQ ID NO: 4678 - DNA, 180 bp, Homo sapiens
ctcgtgcgaattcggcacgaggggaaaggttttattgctatgcgggtaggtaagaacagattttacttacattcatatagttacttcaagtccagttttctgttaaacaattttccttatataatgagcccaaactagtccaagttagcttgaaccttggttttcttggagagtgaatgt

SEQ ID NO: 4679 - DNA, 366 bp, Homo sapiens
ccactatgctctaaccctgctcaggattcctgttgaggagatgctccctagcccagatggcacctcgacaccaggatgggactgcaacctcaggtctccccctacatattaattaccagtcaccaggagcccaccacctcctctaggatgcccctcaggtggggccaggccctgctcaacatctggagacacagtccaccctcagtctgcccacagagaggcttggtcggtctcactccaggagacgggagtgacccagcccggagcctctgacccagatcgtccctctccagctgaaagctagggagtttcccagagtcttctacccagcccctgtctcctgtagggataagaaagttccgtcct

SEQ ID NO: 4680 - DNA, 298 bp, Homo sapiens
gcacgagaagatgttctctccaggttgactctagagattgctgtaataatatctctcattaggcatgtactacctagactagtctcctgcacctgtgacactgccacaaaagaagataaaatgtctgtatgagcaggaagcaggagctagcaggctgctggactactcactagtcactcttgattccagaggctggtgaaaggtaggggttctcctttccattttgatattttttcaatacaaggtaatttctagatggggaatgcatcagtattagcatcttatgaaaaaaaaaaaa

SEQ ID NO: 4681 - DNA, 313 bp, Homo sapiens
gctgtcctctggaggcactacgcaagatgggactgcgccctggggtgaggcacccatttcctcgggcgatctgaggaagctcatcacagatgactttgtgagcaggagtacctggaatacaggaaggatcccaacagcaacccacctcagtattaattctctggggcctcggagccgccattagacagcaagatagggtcctagattatgccagatcagaccgagaccccggaagtgaggcctattcttggaggctttgatatcttcagcactgattgatatgccagacatccagcccaaataggccaaatat

SEQ ID NO: 4682 - DNA, 256 bp, Homo sapiens
gcagtggtcacagcagctgtactggagcaccgcgaaatcggcagggtctcgctcttgtcgtgtctgttcaaaccggcacgcctgatccggaaatatggcctcaatatgtgccgccagtgtttccgtcagtacgcgaggatatcggtttcattaagttggactaaatgctctccctcagaggatatccggggcatctactcatgaaaaccatgataattctttgtatataaataacatttgaaaaaccaaaaaaaaa

SEQ ID NO: 4683 - DNA, 240 bp, Homo sapiens
gccggcttcagctctccgcgcagaagtctcccggagccgacttctgagagtcgagtactcctatgtgaagactaccaagctcgtgttcaaggggaaccaaggcggagaggcgagatggaaagaaagtatcaaggagtgagctgaagccactgcccttgagaaccctctcgaggagtctgggctcatgaggatgccagaataagtcgcagtaaggagaaaaggacaaagataaaaaaaaaa

SEQ ID NO: 4684 - DNA, 139 bp, Homo sapiens
gtctcagttacttgggaggctgaggcaagagaattgtctgaacttgggagataaaggctccagtaagccaagattttgccactgtacaccaacctgagcaatacagtaagactcggtctcaaaaaagacaaaaaaaaaa

SEQ ID NO: 4685 - DNA, 323 bp, Homo sapiens
gagagtggtagaaaattgttccactaccacaaaagacacacagtgaccacggagcaacccaggcgctggaagactgaataatgaaaccagacccagtgttcaagaggactcacaagccttcaatcctgataatccttatcatcagcaggaaggggaaagcatgacattcgaccctagactggatcacgaggaatctgttgtatagattgtaggcggctaccacccactcccagaggatctgtcacccctggggcttatcacccatggccttatattatcaaggctccgcttcgcctacagagtcatcatgcatttggctgggg

SEQ ID NO: 4686 - DNA, 257 bp, Homo sapiens
actgtcgccttcacacaggtgaacctcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttcccactaaactgggttaaatgtacactgttgagttttctgtacacaaaaataattgaaataatacaaattttc

SEQ ID NO: 4687 - DNA, 278 bp, Homo sapiens
gaatggctgacctgacctgatgtccattcatcccacctctcacagtttggacttttctcccctctctttctaggagacctgacctgggcagactgcaaaataaaatctcggtgttctatttatttatgagtctccctgtaggacctccggtcaaggcagagcaggaaactaactggtgtgagtcaaatgcccctgagtgcttccccagcccaggccagagactccttcaggtcccggtccaggactgtgttttctcaaatggtctatctgttcaacac

SEQ ID NO: 4688 - DNA, 189 bp, Homo sapiens
gcagtcacagttgccagaagtagaggctaatgatatatcctatactgcacccactcttaatcagtggggagaccggtctagaccttttttttcatttgccattagttagtaggaaagcctggtaatatacaatcacgtaaacctagaggaaggagatttttttgccactttggttctttttccgctcca

SEQ ID NO: 4689 - DNA, 239 bp, Homo sapiens
cagatttgaactgttagcacgactgtgtccaaatagcactggtctgagattagagcgtctgcacagaggctggtatgtttgccataagagcaccgcgaaaaacttctaccgagaaggatttcttggaagctgtaaatagggtcataagtctattgccaaattacggtctactcctcggtacatgaaaatcacctgacccctgaaggctttcaagtaaaactttaaatggatccctacct

SEQ ID NO: 4690 - DNA, 235 bp, Homo sapiens
caaggtcggtggccaaaagagtgctgaatttctgctgcacatgctaaaacgcagagagtaatgctgaccttaagggtttagatgtagattctctggtcattgagcatatccagtaaccaagcacctaagatgcgccgccggacctacagagctaatggtcgggttaacccatacatgagctctccctcccacattgaggtggtccatcggaaagggaaccgtttgttcctaaccc

SEQ ID NO: 4691 - DNA, 376 bp, Homo sapiens
atacaatatgtaagctttcttaatattgaagtttctttgttttgagacagcatggtgatttttaaaattctttaattttgttcctgggatattgaaaattcaaattgaggccaaggttatttattggcttatccttaaacaaatagcaaggccagtcttttaagactaaaacagattgtgtctatttgaggcaacaagagttactattgtagggcatttaatgtagcagataaacactagaaatggtttatctaaagtttatcagctaggaggcataattttactgttcttgttgttctaggtagctctaggattagtgtacaaattctcagtagctagtctacagtattgtaatggtgttagctactctcatggt

SEQ ID NO: 4692 - DNA, 205 bp, Homo sapiens
cttaagtccatgatgagatacagcggccagtggtggctcaagcctgtagccacgacttttggagccaaggtgagatcaaggtagagtcaagcagctgcacatcgtaacctaccttctaaatcaaaattctggcatgtcgcatctttatccactcttgggctagcagagattctcacccggcgggagttcagtacaacgagtcatc

SEQ ID NO: 4693 - DNA, 218 bp, Homo sapiens
tcattggttaccagtgtgtcaggcaatctggactttccagtgatgcactgagatggcacctgtcaaaagagcagtggttccatttctagattgtggatcttcagataaattctgccattttcatttcacttcctgaaagtcagggtcggcttgtgaaaagttgttaaacaacatgctaatgtgaatgtcaaccctactctaaacttccctgtcagggc

SEQ ID NO: 4694 - DNA, 235 bp, Homo sapiens
tcgtctccgtcctccgacatcttgtctggacttcgctggcagtctcagtaggagtggagctctgtgcggcgtagtttggtggaaaaacgggccttgcgtcggcctcacccccagtgtttgtgtttcagaatgaagactattctcagcaatcagactgtcgacattccagaaaatgtcgacattactctgaaggggcggacagttatcgtgaagggccccagaggaccctgcggag

SEQ ID NO: 4695 - DNA, 185 bp, Homo sapiens
tgtttgacggacagatccggggactttcttccagcctccgaccgccctccgatttcctctccgcttgcaaccttccgggaccatcttctcggccatctcctgcttctgggacctgccagcaccgcttttgtgggtagctccttcttgccaaccaaccatgagctcccagattcgtcagaattatt

SEQ ID NO: 4696 - DNA, 203 bp, Homo sapiens
ccagactgaaggacatactcccctaacagctgggagtgctgctggctggcatttacttccagcccttatgaggagtttcccctgctgaagagccctgcctgccccagatcataccccttcctgcctgtacccttaccgctccatatggggtcaaagggctggctcctcacccacttggaaacctctgggccatccagctccag

SEQ ID NO: 4697 - DNA, 303 bp, Homo sapiens
gggaatcaaagcaaatgcattcaaaaactgaataacctcaccttcctctacttggaccataatgccctggaatccgtgcctcttaatttaccagaaagtctacgtgtaattcatcttcagttcaacaacatagcttcaattacagatgacacattctgcaaggctaatgacaccagttacatccgggaccgcattgaagagatacgcctggagggcaatccaatcgtcctgggaaagcatccaaacaggtttatttgcttaaaagattaccgtagggtcatacttttaaccctttttggtaca

SEQ ID NO: 4698 - DNA, 207 bp, Homo sapiens
agaagctctggcccctatggcggtggaggccaatactttgcaaaccacgaaccaggtggctatggcggtttccagcagcagcaggtagctatggcaggtggcagaagattttaattagggaacaaagcttagcaggagaggagagccagaaaagtgacaaggaagctacaggttacaacaagatttgtgaactcagccaagcacagt

SEQ ID NO: 4699 - DNA, 147 bp, Homo sapiens
caaggtactatggtcttcagatgcttaggctcgttgggtaggcctacttatccgcgactgaccgcgtccgcagcgcaccctacacttgtccgcgcatgcctttttttcgagctgctcatctctcgccctattctcacgacgataggt

SEQ ID NO: 4700 - DNA, 133 bp, Homo sapiens
cttccatgctaccattaactctggtgtgtttggcattttttacctgcacagggtttattcaattccatttttctggttgaggcctcaaagcaacaccctaaaaattaccttggggtttgagggtaagtaagag

SEQ ID NO: 4701 - DNA, 157 bp, Homo sapiens
agatatgattcatctcttctctcatatgtatacccagagtgggttgctgcatcaaatggtggttctattttaattttttaggaccgccatacttttttcataaggcctgtactaatttcattctcaccacagtcactagggtcccttttctcacaat

SEQ ID NO: 4702 - DNA, 157 bp, Homo sapiens
atgttatcgacagatgcattcattcatccgagcaatgcaataagccaaggcatttctctgtctgacaccaatatatgatagcacacacacatatcacacacacacacacacacccacaggggggggtccttcaggacatgattatgttttaaggaac

SEQ ID NO: 4703 - DNA, 130 bp, Homo sapiens
gtcaccagtgacatactcgttgtctaactggagaggtggacagaggttcggtactccgagactctgcctgagcaaaggaagcgctcctgagttactcattttagcgctggatgctcagcttctttaagat

SEQ ID NO: 4704 - DNA, 244 bp, Homo sapiens
ggcatgtaataccagaattgttactttacaatgttccttagcaaattgaatttgctttgaacttttagttatgcacagactgataataaacctctaaacctgcccagcggaggtgtgtttttttttaaatttaaatacagaaacaactggcaaaaattgaactaagatttactttttttcccatagctgggatataggctgcagctatagttgaacaggcagtctttaaaaacctgctgttaaa

SEQ ID NO: 4705 - DNA, 285 bp, Homo sapiens
gctggagatgatttgacctatagatcattctgacttacacatttgacttagcctagtctgagactctgtgcaactggccgtgattcagtataacctagaccagtcctgtttgcctcatgatatcaggtgggagctgaatgccatgaccaccaacagcaatatcagtcgccccatcgtctcctccatgggtaggaggaagtttctgccacctcccctcctgagcctgctgtcatcttcactgccctgcccatctgtcaccacctgctcctttgacccctggacttg

SEQ ID NO: 4706 - DNA, 257 bp, Homo sapiens
ctgacacctacctgcatcgggtggccagagcaggccggttttgcaccaagggcttggctatcacatttgtgtccgatgagaatgatgccaagatcctcaatgatgtgcaggatcgctttgaggtcaatattagtgagctgcctgatgagatagacatctcctcctacattgaacagcacggtagaagactcgcccattttggattgtgaccgtctgtccttcaggagaggacacagggtggggggtaaggagacact

SEQ ID NO: 4707 - DNA, 306 bp, Homo sapiens
gcagcctgaggtgatctgtgaaaatggttcgctattcacttgacccggagaaccccacgaaatcatgcaaatcaagaggttccaatcttcgtgttcactttaaggacactcgtgaaactgctcaggccatcaagggtatgcatatacgaaaagccacgaagtatctgaaagatgtcactttacagaacagtgtgtaccattccgcggttacaatggtggagttgcaggtgtcgcaggccaagcaatggggctggcacaaggtcggtggccaaaagagtctgaatttttgctgccatgcttaaaacg

SEQ ID NO: 4708 - DNA, 305 bp, Homo sapiens
gtccatctgagtgtccatcgccatcatctgccaggctgctgcatgcacctatgagcttctgggcttatacttgggggttttctctctgcctatagtatttttgttcttatcatacacttgataaagtccttaaattacagtttgaacattcagttaccatctctatgaggccatgctttgatgcatgcttagttattgcacataccgtaccatcatgctgtgccatttggtgttcatgtgtcttacagcacttggcaggtgttatagaatcaagttcatgtctcctttctcagaacttatttgag

SEQ ID NO: 4709 - DNA, 260 bp, Homo sapiens
ctaaacctgatttttgccatggattccttctggccaagaaattaaagcacatgtgatcaatataacaatataatcctaaaccttgacagttggagaaggccaatgcagaacttatgggaaaggaccaattatttataggttcccaacacaggtctaagattttttacctctgcatcagtgcatttctatttatatcaaaaggtgctaaaatgattcaatttgcattttctgatcctgtagtgctctatagagtaccacag

SEQ ID NO: 4710 - DNA, 318 bp, Homo sapiens
ctcaaatggcaacctacagaatgattacatttcatataaaattcttagaaatggcagaattatagtgatggagaactaatctgtgagtgccaagagttggggactggggagagagtgtgactataaaggagcaagaaggagcttttttgagtgatcagacagttgtgtgtcctgattaccatagtggtttcacaaatcaatatgtatgacaaaattccacaggcctgtacactccccacaatgcaaaaacatgagtcatgtaaaactgcaaactccataggtctaggttagttatgtattgtgcagtttgatatgtat

SEQ ID NO: 4711 - DNA, 330 bp, Homo sapiens
gttctacctcctgaagatcgtgaatcttatcagtttctccgtgtccaacacagaccactattgtctctcaactcaaagccttcttaatagttttttgctctcaagccttcttcacattactctcatagagttctttctaaacaggaactctctaaaacccttcaatagctttttaatgccataagttcagtttagacgcattaaaatgattcataccttactgcctcctgttcagacttgtctgttgctctctaggtctgacatgtgatttatcttccattaaacagttcttttattatttctggctcttactcataggattactaggct

SEQ ID NO: 4712 - DNA, 266 bp, Homo sapiens
gttgaagggctatattatccagggataaaattagacatttaaaatggatagctgcatatcctctgacagtcacttttgagattttttttcttaaacttttgttgagagctggctacaatttgagattctattttctgggagttcagagtggcagttattcaagtttactattctaagggcagattgtatatgcattctctgcagtacccccagtttctattattaactaccatctgactttgacttttttttttttaaaaaaaaaa

SEQ ID NO: 4713 - DNA, 282 bp, Homo sapiens
ctcgtccatttgggcgattgggaattctggccttctcatgacctctgctgatcctcctctcctctcctgctgagccttccacctctgacctctcactgttcatgccggaccctgttggatcttcctgggactccgagcaaggcctgcacgagagaaggctgaaaggctgctggggctgccacctcgctattccgcataagcatctgcccccaacccctttgaccttcatctgatggcattttatcaggaacaataaaggtttcctctcaaaaaaaaaaaaaa

SEQ ID NO: 4714 - DNA, 308 bp, Homo sapiens
gagccgccgccatgtctgcgcatctgcaatggatggtcgtgcggaactgctccagtttcctgatcaattccttccgctacaacggactgattcaccgcaaggactgttgggcgtggagcggcagccgacgcaaaaggtgtcgttgtggtaattaagcggagatccgccagccgaagcctgcaactcctatgttcggaccaccatcaacaagaattcttgggccacgttcagcagcatcagcaaatgatccgcagacaagtaccgcccgacctccgcatgcagccatccgaggcccagcgcatcctcga

SEQ ID NO: 4715 - DNA, 361 bp, Homo sapiens
ctgtgcccggcagttaggcagcagcagccgcggacagttagccgccgtgggagggagccatgaagcattacgaggtggagattcttggacgcaaagacaagggagaagctgttttttctttgacaaggtggagccccacgccaccattgcggagatcaagaacctcttcacttagacccatccgcagttgtaccccgcccgccagtcctccgcctggaccccaaggcaagtccttaaggatgaggatgttcttcagaagcttcccttggcaccacgccacactttacttccggcaccttgggcccagatcagctggtgacggtttcctacaaagtacgggggccctttcatcatcctcttt

SEQ ID NO: 4716 - DNA, 210 bp, Homo sapiens
cccaattggaccaatctatcaccctatagaagaactaatgttagtataagtaacatgaaaacattctcctccgcataagcctgcgtcagattaaaacactgaactgacaattaacagccaatatctacaatcaacccaccaggtcattattaccctcactgtcaacccaacacaggcatgctcataagggaaggttaaaaaaaaaaaaaa

SEQ ID NO: 4717 - DNA, 417 bp, Homo sapiens
ctcgtcattttcggcgagggggaattaaacccatgtggaggatgatgcaaataaaaatggtggcaagtggattattcggctgcggaagggcttggcctcccgttgctgggagaatctcattttggccatgctgggggaacagttcatggttggggaggagatcttttgggctttggtgtctttccgctttcaggaagacattatttcaatatggaataagactcccagtcaccaagcaaccacagcccgaatccgggacacattcggcgagttcttaacctacctccaacacattatggatacaaaactacacgcagcatcaaatgcaggaggctggccccaaggctcttttcaaactttgagcgcgttatttcatacctttcttttgatgcacacatgagctgctcatcgagtttt

SEQ ID NO: 4718 - DNA, 275 bp, Homo sapiens
cctgccggccccacaacctgcctgtggttcaggcggctcagcagcgagaactagaggccgtggaacaccggatccgtgaggggcaggcgggcgatggaccagaaggatcatcctgggggctggaccggaaggtgggctgaccagcaagagcacactgggagaggccgggggtggctgctttctacgtcaccaccaacccacaggagctaatgctacagatgaacccttctggaacctaatccgaaagtctgcagcaggagggccttccgggcagg

SEQ ID NO: 4719 - DNA, 251 bp, Homo sapiens
cagggattggcaaactgtggcctgaaggctaaatacagtctgttttttgcatggctgcaaactaagaatargtgtttgcaattttaaatggttgaaaaaaaatcaaaagaagaataacatctcataacacaagaaaattctatgaaattcaaatttgtgtctgtaaatacagtgttgttgagccaaagccgtcctcaatgatgtatcgtctgtggctgcctttgtgctgtaaccccaagatgcatagctgt

SEQ ID NO: 4720 - DNA, 105 bp, Homo sapiens
cttttcttctggtggtctttaggaaattatttcctctttttttgtcctggccgcatttttatgggtatctctcactgtctccactttgaccggcttaagctctag

SEQ ID NO: 4721 - DNA, 108 bp, Homo sapiens
ggcaggatggcagtcaatatcagagagagttgtcgctgaggcatctcaagctgactgatgagtctctcctcggagctggctgaaggatggctactctggagtggaggt

SEQ ID NO: 4722 - DNA, 143 bp, Homo sapiens
ctcgcctttggcggtgacagcgaagaacagatgctgggtcctcctgcacctctctctgggtagctcctctgagttatcctcacccctccacctaccattggtgtttccagctccagcctaagtgctctctcccctctaagctc

SEQ ID NO: 4723 - DNA, 130 bp, Homo sapiens
ccaaactggattagatacccactatgcttagcctaaacctcaccagttaaatcaacaaaacctcctcgccaagaaccactacggagccaacagcttaaaacctaaaaggaacctggccgggtgcttcaat

SEQ ID NO: 4724 - DNA, 133 bp, Homo sapiens
ctggccagccgagccagcccccggcacagcaccacgcactcgagggtgacggcctctccgcgcccaccgaggttggcgacacaccttcaaggcccaggcttttggagaggcaggagtagccacaggaagtaag

SEQ ID NO: 4725 - DNA, 98 bp, Homo sapiens
aaattctctgagtattctgattgtgatgatccagaccaccctgagattttgtcacctgattagtcaatatgaatgattaaaaggatgtgagaccactg

SEQ ID NO: 4726 - DNA, 132 bp, Homo sapiens
cagatgcgcacagagagcgtagacacccatcagctcagagctctgcgctgagacaccctgggtgccagtgtgtggaccgccagaggtggctcagatcacaaagcagctcccccatatgtccctctagcagcc

SEQ ID NO: 4727 - DNA, 122 bp, Homo sapiens
gctcggttgcagcacagagaagtgcaggagcctgagccagcagaggtcgcgcttaaccggcctgtgttttcagctcaagatttccagattccttgccaagcatatttttgccttaatgagag

SEQ ID NO: 4728 - DNA, 150 bp, Homo sapiens
caagttgagacctctgcagctcatgaagaatttagataggaggttggagggtgacactctcactgagactagtgtctacactcgctgcatagtgaccagcacctacggctggacagcaactatggagcagcatcatgaaagcccaggcac

SEQ ID NO: 4729 - DNA, 125 bp, Homo sapiens
agctcgagacgtgcagctggccggcatcaggactatgcaccgtatctccaaaccctgagaccaggaggaccgcgtgaggctggcctccgctccaggaggtatctctaagccacagactgtggtgg

SEQ ID NO: 4730 - DNA, 118 bp, Homo sapiens
aaaaaggcatacatcacatcacaaaaaaggatgccacacaaaaccacatccacggtcataacataaagatgaaaggtggataatccacacggatgaggcccccccccgcaccccgccg

SEQ ID NO: 4731 - DNA, 111 bp, Homo sapiens
caacatttgatattcagtgtaatccaattgcatgcattagcagcgtcaagatgaaataagagtcatatcaataggacaagaaaaagcaatttgacaaaatccaatatccat

SEQ ID NO: 4732 - DNA, 140 bp, Homo sapiens
gctggaggaggcctgcgacatggcgctggagctgaacgcctccaagcaccacatctacgagtatgtgaggtccagaatgtcattcatcgcacccaacctgtccatcattatcggggcatccacggccgccaaggtcatgg

SEQ ID NO: 4733 - DNA, 160 bp, Homo sapiens
tcagtagctgaatggaaaacattgaagacgtattccaggtatggcaagctcagttcctctgtggcttggctcttctgctcagctctcagcctcttggtctccctctcagagaggagagaagatgagagaggaggagcttagagtcagagtagtacatgga

SEQ ID NO: 4734 - DNA, 99 bp, Homo sapiens
tcatactgtacatcagacattgtcaggctctctgtcagctttcatgacatatggtatagaaccatggagttaggcacttcctggatttttttttttagg

SEQ ID NO: 4735 - DNA, 250 bp, Homo sapiens
cagactggagggagagattctgcactatgcgtccagcagcttggggcaaggtgctggagaagtctggcttcgcgtcgactgtccgcaacacagaccagacctacctgctgtgagtacagggggcagcccagcatgttcccaggcttttcctgctgacccaaacccttactggactaagccctccaggagctgaggcgccttaccatgcgtccaggggccccggctccttagcccacccgttctcaaggga

SEQ ID NO: 4736 - DNA, 286 bp, Homo sapiens
ggcagtttgaaattgagcgagatctcaggctgagcaaaatgaaaccttgatgttacgggctaaatcaagagcagcttaatcctgtttacaatgtgagctttttgtgcgtctgtgaaatgttttacagtgtttctcatcatctgtttcccagcaaggtcttttttttttctacattgaagttctgtctatgtatcttaatcacaaatggtttcattcactttacttttaaaaatttgtccttaaatgaataaataaaataaaagttggtcctgtgagaggataatga

SEQ ID NO: 4737 - DNA, 480 bp, Homo sapiens
ggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattaccccgggaccattctgatcatctcactggacgcacaggggcaagagggtg

SEQ ID NO: 4738 - DNA, 393 bp, Homo sapiens
ccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcaccgggtcacccttaatatttattaagtgcctgagacacccggttaccttggccgtgaggacacgtggcctgcacccaggtgttgctgtcaggacaccagccttgtgcccattcttccgacccctacccactttcatttccgtgggttttcttgcactttctcagttcagagttgtacactgtgtacatttggcatttgtgttattattttgcactgttttctgtcgtgtgtgtttgggtggggtcc

SEQ ID NO: 4739 - DNA, 351 bp, Homo sapiens
agcacctctagaaagagttccagcctcccaggggaagcgctaggagaacaccttcctttgaaatgctgaagttccaatgcacttttaaaaaaatccccctagcattccctcatccacatccaccctttttatttgcaggaccagactggagacaggtcctgctgcacctcagcccaccctgaggctcatgtcctgatgccagactccagccaggcatgtagcacagtctatgtgggtctgctgaagctgtcacttcatttcctcctttctccttaacaaggaatgacttacccacggttaccacatatctatttatcagcagatcataagcccagtcttctgagatcttgt

SEQ ID NO: 4740 - DNA, 400 bp, Homo sapiens
ctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctagggtccgtgaagcccaggccaggcagccaaatcttgcctgtgctgggcatacaaccctctgctttcacatctctgagctatatcctcattagtgaaggtggctttgctttatagttggctgggagcacttaattcttccctttcaaaaggtaatgttg

SEQ ID NO: 4741 - DNA, 471 bp, Homo sapiens
  misc_feature 3: n = A,T,C or G
ctncaggtcgacactagtggatccaaagaattcggcacgagctaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttatactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggacgagaggagttgaagctggacacactatgtgactt

SEQ ID NO: 4742 - DNA, 346 bp, Homo sapiens
caaacagagatatcatttgtcagattgcttatgcccgtatagagggggatatgatagtctgcgcaggtattgcacacgaactgccaaaatatggtgtgaaggttggcctgacaaattatgctgcagcatattgtactggcctgctgctggcccgcaggcttctcaataggtttggcatggacaagatctatgaaggccaagttgaggtgacttgtgatgaatacaatgtggaagcattgatggtcagccaggtgccttcacctgctatttggatgcaggccttgccagaactaccacttgcaataaagtttttggtgcccttaagggagctttggattgaggcttt

SEQ ID NO: 4743 - DNA, 294 bp, Homo sapiens
ctcgtgccgaattcggcacgagagtgacctccccaagacccacaggaagctgctgactgatcatttctacaacttacaaaattttcagtatgttctaagttaacatgggaaagttaacttatttcatttcaacttatttttcccctttggattaagtatctggactagctaagaaacttgattggggtggggcatgggatagttttttttttttattatttaatgttagggaaataaaattaaaaggtctcaaaaaatgtgtaatcaattcagtaaaacataggtaggttcctt

SEQ ID NO: 4744 - DNA, 195 bp, Homo sapiens
ctcgtgccgctcgtgccgaattcggcacgagtgaccacctcgtcaagacccacaccagagtctccgtgcagcggactcaggctccagctgtggctacaacatagggtttttatacaagcaaaataaagtgaattaagcgtgaaaaaaaaaaaaaaaaaaacttgtttggtkcccgatttcggaaggccaaaaggg

SEQ ID NO: 4745 - DNA, 230 bp, Homo sapiens
gtgcamtgtgatcaagrattyggcacgagagggaaagggcccagctgtcagggtgcagataatcagagggcacaggcccgggcttgccagagggcagaggcttcacataatcagagggcaggggcccaggtatcaggagctgtaagtctcagctgtcccagggaccacaaggacaagcttccagagccaaggcccggaacacagttaaggaagtgtaggtctcagaccct

SEQ ID NO: 4746 - DNA, 275 bp, Homo sapiens
acgccccgctctagggacttcagcccagccccagcttctctgcccactcatttctaggtcagccgcaattcagcaggtccctcttgggggttccccacaacctctcttttggcccagaggcgcagaggaccacagtgagagtgtccacaggagggccccacagagccctgtctgtgctcctctgctctctctcttcacacctctgggtgtggggcttctccgaccaccatcttcttctctcctcatagtagtcgtcatcatgacgaccagcaaca

SEQ ID NO: 4747 - DNA, 359 bp, Homo sapiens
tcgcctgggctgcctgcctcagaagtggggacccaaagggtgcaaggacgcctggtctgccttgtgggtcctggacggagcccctacctctgcaaagatgacttgagagacaggccgtcctgtctgtcttgcttctccgccgtggtgtctcctgtatatgtctgagagagggacccagtgtatctgtggagaccatgcagatagcgagagaagaggcgagttaagatgcaaaacagaagattttcatgcaggaatcagatgcctcgaatttcctcacgaggcgcggcaagcggtcccccaagtcccgagatgaggtcaatgtggaaaacaggcagaagcttcgggttgatgagctgcgg

SEQ ID NO: 4748 - DNA, 265 bp, Homo sapiens
agacgctcgtcaccaggacccaaggacccaaaattgcatctgatggtctcaaggggtcgtgtgttttgaagtgaagtcttgcctgatttgcagattgatgaggttgcatttggaaattcaaggctgataactgaggatgtctcagggtaaaactctccctgctctactctcccatgggctatgatatcttccccctgtgcacaaatgtgtgttcctatgggacaaaaatatgcggcagacagtgtttaggcgctcacgtttgatg

SEQ ID NO: 4749 - DNA, 230 bp, Homo sapiens
ttaccaaaattggctgtttacagtgcatttagttcctgatatttataaagatgacatttcacagaattacctttaaaattaggtttgaaattcctatatagtttaggacatcgttcacacctggagcacaaattaaatgtgtccatatattttttatgtgtagcgcgctctacacacagtgtacctattgcacagagtatatctgattaattgtgtaatagataggttgt

SEQ ID NO: 4750 - DNA, 180 bp, Homo sapiens
gtcaaggttgcaatgagctctgatcctgccactgcactccagtctcggtgacagcaacctgagaccctgtctcaaggagaaaaaaaaaaaggccttgcaacggtggcttaatcccttcattccaaccatttgggaaggcttgaggtggacccgtcacattgggcccccgggagtttagag

SEQ ID NO: 4751 - DNA, 120 bp, Homo sapiens
ctgctttcctgtggaagaggcctcagcacctgccactttgccggcctcccagctgggaggctggagcctcggccttaggagcccctcttccagacctaactgggccccttcggtgcccaa

SEQ ID NO: 4752 - DNA, 315 bp, Homo sapiens
gttatcaataagctcctagtccagacgccatgggtcatttcacagaggaggacaaggctactatcacaagcctgtggggcaaggtgaatgtggagatgctggaggagaaaccctgggaaggctcctggttgtctacccatggacccagaggttctttgacagctttggcaacctgtcctctgcctctgccatcatgggcaaccccaaagtcaaggcacatggcaggagggtgctgtacttccttgggggatggccataaagcacctcgatgatctcaagggcacctttgtcccagctgaagtgtactgcactgtg

SEQ ID NO: 4753 - DNA, 236 bp, Homo sapiens
ctcgtgccgaattcggcacgaggtcacagaagacctcacgtcttcccattcatttgacattgcacccattggacatagggaggggccgcagcaggaattcggtgttggacatagggccggtctgcttcttgtaaaaacctgaacccagaaacaacacaatccgttgcaaacccaaaggacccagtgacttttcaatctcagtcactctaggactctgcactgaatggctgactgac

SEQ ID NO: 4754 - DNA, 263 bp, Homo sapiens
ctcgtgccgaattcggcacgagggtaacaagaaataccgtgccctgaggttggacgtggggaatttctcctggggctcagaggcttgtactcgtaaaacaaggatcatcgatgttgtctacaatgcatctaataacgagctggttcgtaccaagaccctcgtgaagaatttcatcgtgctcatcgacagcacaccgtaccgacagttgtacgagtcccactattcgcttcccttggccgcaagaagggagccaagctctcttc

SEQ ID NO: 4755 - DNA, 184 bp, Homo sapiens
aagttttgtaccatttattttatgacattttacaatgtaagttttgaaactaactgttggtaggagaaagtttcttatggaacgaataccctgctcaacatttaatcaatctttgtgcctcaacatacttgttgatgtcttagtatgcctcagttgggtgaggaaattcccatttgaggtgttc

SEQ ID NO: 4756 - DNA, 225 bp, Homo sapiens
gtggggcaaggtgaatgtggaagatgctggaggagaaaccctgggaaggctcctcggttgtctacccctggacccacaggttcttttgacagctttggcaacctgttctctgcttttgcatcatgggcaacccccaaggtcaaggcacattggcaagagggtcttgacttctttgggggattccattaagaccttgattattttaagggcaccttttcccaactt

SEQ ID NO: 4757 - DNA, 170 bp, Homo sapiens
cacagttcaaaagacccctttcgtcacccaccctgggtatgacactgggaatggtattcagcttcctggcacttctggtcagcaacccagtgtttgggcaacaaatgatctttgagggacatggttttagggcggacccaaaccgccacaacggccaaccccattaggca

SEQ ID NO: 4758 - DNA, 200 bp, Homo sapiens
ggttcctgaaaggatgtacagaggatccccaaccgcctgcgaaacccaagccgccgcgtaggagcatgcgttcgggccctcttcttccacctgttcgactccccatccccaggatgtcaacctcagtccctcaaggccatacctcgacccaccgggtgaggaaggacggtgaggaggagggcccccttggaccagcttga

SEQ ID NO: 4759 - DNA, 258 bp, Homo sapiens
tcgtgtgagcacaccatatatttacagtaggaatagacgtagacacacgagcatatttcacctccgctaccataatcatcgctatccccaccggcgtcaaagtatttagctgactcgccacactccacggaggcaatatgaaatgatctgctgcagtgctctgagccctaggattcatctttcttttcaccgtaggggcctgtcctggcattgtattagcgaactcatctctagagcataggtactatacgggacagt

SEQ ID NO: 4760 - DNA, 343 bp, Homo sapiens
tagaaagggtccttcctggaccgggaccctctgccacgaccatggaccgtaggaaaaagcctttggacgtcacggcctcctcgttggtagatcttaaggctgaactcttccgaaagcaagaagaattcaaacaagaaaaacttctaaaagattctgtgagtttttgtgaaaaccaaaaacaactaacaagaaaccaagtatctttgagcaaacagaatgtaggcgtttcaaatcgagctgagaagggatgctgaacagaagatttaagagcacaagactttagacacagcaagggaaaattggagagaaagccacattatatgtaaaaatgctataggagact

SEQ ID NO: 4761 - DNA, 260 bp, Homo sapiens
gcaaaatgtcatcatatgcattttttgtgcaaacttgtcgggaggagcataagaagaagcacccagatgcttcagtcaacttctcagagttttctaagaagttctcagagaggtggaagaccatgtcttctaaagagaaaggaaaattttaagatattgcaaaagcggacaaggccccttatgaaagagaaatgtaaaacctatatctctcccaaaggggagacaaaaaaagaaggtctaagggtccccatgtacccaga

SEQ ID NO: 4762 - DNA, 157 bp, Homo sapiens
aacagctcctgctccttggaggtggtgggaacttctttttcttttgtacctacttcaacccccatacagttacattaggcctttcttccttaagtgtcttggcagtaaggactctgactctatattcaggagcccctataagtatgagacatataag

SEQ ID NO: 4763 - DNA, 141 bp, Homo sapiens
ctcgtgccgaattcggcacgagtgcttacttttcaccctctcttcaactgccttttgcttcttaaggcttttcttttcgacctcttttctctttaaaacccttctctcacagagtgtgagagccatatctctccggcgtct

SEQ ID NO: 4764 - DNA, 160 bp, Homo sapiens
gcacagtgcggcacaacggacttcaacgcactgtaattcaccaagtgcgggacacaacttcttcagcacacaacccttgttgttccgttccgcaaaaggacacacttgggcacacacacggtgtaaggcacactctccccagtgttgtcacaggcgccct

SEQ ID NO: 4765 - DNA, 118 bp, Homo sapiens
acgtgacgcggggccaggcggccgtacagcagctgcaggcggagggccttgagcccgcgctttcaaccactggacaacgacggttcttcaggggattcccggccttggcgaattttct

SEQ ID NO: 4766 - DNA, 105 bp, Homo sapiens
ctcgtgccgaattcggcacgaggacttctgcagtgtgtggctatccctacaagggccacccaagggatgcccaaaggccaaccttcttcagggcttcgaggccaa

SEQ ID NO: 4767 - DNA, 180 bp, Homo sapiens
gaacaatggaccccaagtcatgtcagtgtggcccctgctaccctcaccatcttgcaccagcagacagaggcagttcttggagagtgttgggtgcgttttctctctcctcctggcgcgtgtggcagagaatgtccacacgcgttttcatttatatatatgctcgtgccggcccagactctc

SEQ ID NO: 4768 - DNA, 205 bp, Homo sapiens
gtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccacacgcgagcggagttcttagatcatagttccactc

SEQ ID NO: 4769 - DNA, 215 bp, Homo sapiens
aaacccagagaatttgcattggctttagccattttggagtgtgcagttaaaccagttgtgatgctaccaatatggcgagaatctttaggacataccaggttacaccggatgacatcaattgaaagagaagaaaaggagaaagtcaaaaaaaaaaaaaaaaacctcgagagtacttttagagcggccgcggcccatcgattttccacccgggtggg

SEQ ID NO: 4770 - DNA, 299 bp, Homo sapiens
cctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtgtgatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccctttcacgt

SEQ ID NO: 4771 - DNA, 301 bp, Homo sapiens
  misc_feature 41, 91, 93: n = A,T,C or G
cggcacgaggtgaaaatacccttaagtgatgacattccacnctgtgatttatttctgcaccatcttgactgatcaatgtgctttgtaatcnancccacccttcagaaggctctttgtaatcctccccacccttgagaatggacttggtgagatccaccccctgcctgcaaagcattgcccctaactccaccgcctgtcccaaaagctacaagaactaatgataatcccaccatactttgctgactctctattcacactcagcccgcctgcacccaggtgaaattaacagcctcgttgctca

SEQ ID NO: 4772 - DNA, 300 bp, Homo sapiens
ccaggccctgccagctatggcagaaatggccgagacggtgagcgaggccccccaggggtggccaggaattcctggagtgcctggacccccgggacctcctgggcttcccggtttctgtgagccagcctcctgcaccatgcaggctggtcagcgagcatttaacaaagggcctgacccttgaaaggcttactgctgcatggctgtctgcatgaaccacgcctggtgaaggagcctgggtgagaaacacatccaaagctggggcaaagatgattaccttcagcaatgattacaatgtaatta

SEQ ID NO: 4773 - DNA, 302 bp, Homo sapiens
gaaaggttgcagtgcttcctgttcccttactggaagttagctttttcttttctctttcttcctttctttctctcactctttctttctctttctctttctctctctctctctctctcactcactcactcacagatttgctaatgccacagaaagggctcttttaacttaagataagtgaaaagtactaaaaaagattcaggtaattatcattcagcactttattgtaattcagaataaaatttatgatggcatatttgccctgcaaatgtcttaatgaagttgttctcaataaaaagctcctt

SEQ ID NO: 4774 - DNA, 300 bp, Homo sapiens
gctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaacctgaacccagaaacaacacaatccgttgcaaacccaaaggacccaagtactttccaatctcagtcactctaggactctgcactgaatggctgacctgacctgatgtccattcatcccaccctctcacagttcggacttttct

SEQ ID NO: 4775 - DNA, 301 bp, Homo sapiens
ctcgtgcccctcgtgccgatcagcaagaaccccaaggacaagaggcatgtctggttcggcgagagcatgaccgatggattccagttcgagtatggcggccagggctccgaccctgccgatgtggccatccagctgaccttcctgcgcctgatgtccaccgaggcctcccagaacatcacctaccactgcaagaacagcgtggcctacatggaccagcagactggcaacctcaaggagggccctgctcctccagggctccaacgagatcgagatccgcgccgagggcaacagccgcttcact

SEQ ID NO: 4776 - DNA, 365 bp, Homo sapiens
gatatactcatgtatgtagttgtgggagtttttagttttttgtttttttacttatgaaataagttttgacctagacacaaggggtatatgaaggaggaaaaaaatttctttgcaaaatctcccaaaacttgcttttttttcccttccacacaggcactattataattttcagtgccatgttaaattggagttatttcatttactttaaggtaggagttactgtgtaatttattaattcatgagttctcataacatttcagcataagtgtagcaaagttgctaataacgggaggggatcatagtggtgttgaatgtaactctgaagtagggaatggccttttaagtctgagagagacatttgaatc

SEQ ID NO: 4777 - DNA, 260 bp, Homo sapiens
gtcttgttgacaaggattcccaagaaatggatcttttcactggctgactctcccatatctgcaagagattctgcaggaacttggtgttacacaaggtgttgtaggcagttcaggtacttaatatttaggatttgtgtgaagttcactgtattgctataattttgtagataaatataaactcacatataattgtgtaatcacatctctctttcgctgtatagagattgctctatatacactctctctctcacagacacatt

SEQ ID NO: 4778 - DNA, 150 bp, Homo sapiens
gacagagtgagactcttgtctcaaaaaaaaaaaaaagtaaaaatcctagtttccctccttaccagctgccctaattattggggaaagcttagctattttgactcttgagtagcatcctcttacgggcactgcacaaaaggttatgggcag

SEQ ID NO: 4779 - DNA, 149 bp, Homo sapiens
ctcagtaggaaactaacccaagacctaaatgttttcttttctagagaataaaaaagttaagtacatgtttccctctgtgtagctaacatccttcatatttttacactatggtatttctttagggcttgaagggtatccatatacacatt

SEQ ID NO: 4780 - DNA, 125 bp, Homo sapiens
tttcttcctcctctcccttttctttttgacccctccctcacctccctcttctgccatgtaactggaggatgtgctatgagtttgcaaacagcttggctgtcaggctgctttttttccagatggtt

SEQ ID NO: 4781 - DNA, 215 bp, Homo sapiens
ctcgtgccgaattcggcacgagaacagactcagagatgtttgtgactcctgaatttcacatagatagcaagttgcagagtcagaatttagggtgtaattcacctgattccaataactcctgtgctttcgggataacagcctttccattcacaggttctggagcaacttgggcaggagcaccttgggttgggagatgtgtgttaaacacacaccta

SEQ ID NO: 4782 - DNA, 270 bp, Homo sapiens
cagatcagaagttcggattgagttgtctgtttgtttctggctaagattaagacaagacattcaatcacagaaatatacttgtgcaccaaccatttttgcacatgcaagtttgataaggatggatagaaccaacgtgcattacaggaccattagggatccgtgcttttggggagatcacatggcaaatgtttgaaatcatagggtatatgtggttggctaagtggaacagggctgtctgttccattctcactctctttctattagattctt

SEQ ID NO: 4783 - DNA, 355 bp, Homo sapiens
ccttctaccctaaggaagattctacaatcctctactcagtgttgaagattcttcctcttctgtccaccccatcttgggggagcagatggtcctatgcaattcacacagttaattccgccgaagaggcagtccctaccagcgttgatcccactgctctaagcgacccctctcatactggatctactgttagacatgacagatccaccacccattcccaaaggacacagagataggactcagtgtctggcccttagatcaataccagtatgatcagctctgcctcatgtttgcctctacactacctgtgagctggctccagtctccacctacatgggcccctccgtaggtgtcacct

SEQ ID NO: 4784 - DNA, 300 bp, Homo sapiens
agaaggccctgctcatccagggctccaatgacgtggagatccgggcagagggcaatagcaggttcacggacacttcccttgaaggatggcctcacgaaccatacccggtaagtggggcaaagacttttatcgagtacccggtaaaggaggaccctaggcctcccattatttgaattgcacccatgacataggaggccccaccaggactttcgctctgacataggcccggtctcttctataaaccctacccagaatctcaattcgttaacccaaggcccaagatcttcgttgaggtactga

SEQ ID NO: 4785 - DNA, 280 bp, Homo sapiens
gtttgctctgtacccatgtgtacagcctacccatgcagggacttggattcgaggacttccaggcgcatagggtagggccaaatgatagggtaggggcatgttttctttagggccttgtaaggctgtttccctttgcaactgggacttacctatatattggcttcaaatagggcttaattcaatttggctatataggggcccagagagagttttaacctctatatttggggtatagttgggaaaaaaaatctgatctccattggatatgtaatattgcact

SEQ ID NO: 4786 - DNA, 273 bp, Homo sapiens
tcttggttcatcttcaaaatcagagactgagctttgaaactagtggtttttaatcaaaggttggctttataggggggggtataattgtatgcactacctgttttaaaaggaattaggtgtaaggtctgtttttcgtatgaatcaggccccattcatggaaggcctaaggctttgggaaataattgtccccatagagcctgcgcaaaatggtatagagatgagatcacagttgtaaatagaaaactctattacaatactctctgtatcaccccc

SEQ ID NO: 4787 - DNA, 335 bp, Homo sapiens
gtgtgcacgtcagacggcacaagggggtgaggaagtttgagtgcaccgagtgtggctacaagtttacccgaccaggcccacctgccggaggacattggggatccacgaccgggtaggggaccttcaaccccccggcagcaaaggttccgaaacctgatcatcgaggccgagaagatggtggtggtggcttacagccccttacagagctgagaggtggtctcgcggaggacaatttggagtccttcgcccagggcggcctcgtcttcccagctccccgacagagactttttgcagagagagcttcaccggcccaggtctctggagccgccatatca

SEQ ID NO: 4788 - DNA, 275 bp, Homo sapiens
ccagaatttgaaggaatatgagtttccaaatcaaaaagacccagcaagttaccagcacaattgggtgtaaatagaccacggaaaggcaaaacacttgaaattcaggattacttaggccaaggaggattatttggacctcaaaggggtaagggcaggcaaccaaccaccaagacgcgattggcgacatataggtttaaggatttaaatggctggagacttctcaatacaccactagactctagatatgacgcaacacctccgaactcctcaaagaa

SEQ ID NO: 4789 - DNA, 235 bp, Homo sapiens
cctggcaagcccatgtgtgttgagagcttctcagactatccaccttttggtcgctttgctgttcgtgatatgagacaaacaagttgccggttggtgtcatcaaagcagtgtgacaaggaggctcttgggcttgcaaggtcaaccaaggtttcccagagaagctctaagaggttaaatggtatattaccccaaatccctccaaccccactttaatcgatggtggaaagcacggtct

SEQ ID NO: 4790 - DNA, 315 bp, Homo sapiens
gtgatgtctcacagaaagttctccgctcccagacatgggtccctcggcttcctgcctcggaagcgcacagcaggcatcgttgggaaggtgaagagcttccctaaggatgacccgtccaagccggtcaacttaaaagccttccttgggtacaaggcttggattgattacaatggtcgcggaatgtggacagcccggctcccagggtacacagaaggaggttgtagagctgtcccaatttgagagacacccccatggtgtttgtgggcattgtggtctacgtgaacccctggagtcttccgcacttaagactttttt

SEQ ID NO: 4791 - DNA, 250 bp, Homo sapiens
aaaaccttgcttcctatccacctgatccagtctgaaggtctcttagcaactggagatacaaagcaaggagctggtgagcccagcgttgacgtcaagcaggctatgcccttccgtggttaattcttcccmgggcttccaggtcggtccccactgcccgcccttcaaaagggcgcccgggattccagcccaggttttatctgccctggggaatgtcccccgcaaatcttcagaataatcccagggtctgggg

SEQ ID NO: 4792 - DNA, 156 bp, Homo sapiens
atgcaagtccagagtggatgtgtataggccgctatggctctcgaaatgtgagaattgaatagcagcacgcagtcactgctcttctgtgcaaaccagatgaggaacgggctgtgggtctcgcactgtggtcctgcatgaagcagtagctggggtcct

SEQ ID NO: 4793 - DNA, 335 bp, Homo sapiens
aaaacgctccctagacccgctgggaagtgaggaggaggcagaagcatctgaagatgacagcctgcatctgcttggaggaggaggcagagactcagaagaagagatgctggcctagagccagccggttgcagcgttggattgtgccggctaagacctgccaaggagatgggacccttgtgccaccttggccagcaaagaggaggggtcagagaacagctgaaatactgtcactagtggtagtgacttgcttttcctgtgcacaaatgtagcccatcaggacagccagccgacgggtcacgccaggggccggcacgacttgcacctggcccaggagc

SEQ ID NO: 4794 - DNA, 323 bp, Homo sapiens
gttctcccaaggtctatgctaaattatagcaagagccctgggcaaccccaaacctagtcctggtagctgagcaccctgtaaggcaggagcaggcagctcagcttgagcagacattgggtggggggtgggggtggtttagggggaggcagcacagtgcagcaaatgtttcttgggagggaggaggctgatccatcaccatctgcttgactatgtagcttggattctcctttgtacctatccctttcgattgggctttacctcatctatctggatcctttctggccaaatatctctggcccaaatgaacattgtacatgatctct

SEQ ID NO: 4795 - DNA, 257 bp, Homo sapiens
ggcaaaagtggatgagtttccgctttgtggccacatggtgtcagatgaatatgaagcagctgtcctctgaagccctggaggctgcccgaatttgtgccaataagtacatggtaaaaagttgtggcaaagatggcttccatatccgggtgcggctccaccccttccacgtaatccgcatcaacaagatgttgtcctgtgctggggctgaaaggctccaaacaggcatgcgaggtgcctttggaaagccccagggcact

SEQ ID NO: 4796 - DNA, 319 bp, Homo sapiens
aagtacttagatttgccacttttttgatgcttgctacatcagagagacctgacctgtaataggtaaggagtaaaaattaaaatttgcaaatatatttctctcctattattcatacatttttgttctcccccaacccccagaactttatgaaatcttcctctcaggagcaaaggacggtggacagtttcagtgaacaggttcagagactgatacagagggtgtgatttctttttttaaataggatttgaggatgacaattcagatactgggcatgtatcagagctgtggtatcgcttacatatatcatcttatttaatct

SEQ ID NO: 4797 - DNA, 332 bp, Homo sapiens
gcaactttgaaaatgtctgtacagccaacggtttcccttggggctttgaaataacaccaccagtggtcttaaggttgaagtgtggttcagggccagtgcatattagtggacagcacttagtagctgtggaggagagatgcagagtcagaagatgaagaggaggaggatgtgaaactcttaagtatatctggaaagcggtctgcccctggaggtggtagcaaggttccacagaaaaaggtaaaacttgctgctgatgaagatgatgacgatgatgatgagaggatgatgatgaagatgatgatgatgatgattttgatgatgaggagctgagg

SEQ ID NO: 4798 - DNA, 262 bp, Homo sapiens
cttctacaaccacactcatggccgggaaatgctggacatctttgtgcaccagctgctggttttggtcgtctttctgacaggcctcgttgccttcctagagttccttgttcggaccaatgtacttctggagctattgcggtcaagtctcattctgcttcaggggagctggttctctcagatgagatttgtcctgtatcccccagtggaggtctccatggcatctgatggatcatgaaaatattttgtttcctcacatatgctt

SEQ ID NO: 4799 - DNA, 246 bp, Homo sapiens
gtcaaggacacatctctacatccgagaggttatctcctaatctgctaaggttgatttgagataaaagctccaattcctatcttttgggactttacgttagaattttcagaatccttgtctctggcccttgatccattcaactagggctactcctctttccagctctagacaaaatttcttctgtaagaatcaccccctcacacctatccctcccctctattgctaatggagtcactgggagttatc

SEQ ID NO: 4800 - DNA, 364 bp, Homo sapiens
ataacaatgcagctccatgtgatccttgcaccttcaagagaaatgccttgcttgccagctgggttctctggccaccctccagcccaccttgctgcttcttggatggaggttcgtgaagctgctctcgcctatccaaatggcagtaacattaacattcattcagtcaggcaacatccatggagtgctattcatgccatgctgcccatgtggaggcagcaaagcgttcagtaaaggctgggcactgcatgagacacaggttgagtccagctcttgctactgctgtctgagctgctgaactcgtagctcactacctcagctgcaaatgggatgataataagacctctaatggctcactgacagacaa

SEQ ID NO: 4801 - DNA, 274 bp, Homo sapiens
aaagctccacgactctgtttccccgtcccttctgaatttatttgcactaagtcatttgcactggttggagttgtggagacggcctgaggtctcagtacgagtgtccgtgagtgtgagcacctctggcaaggtgcctgttgcagggcccggccgccctccatctggccgggtgactggcgccgctgtgtgccgaggcctcaccctgccctggcctaggtcttggagctcgaccgacatacgagcagccttcagcattccattacgcccatctggt

SEQ ID NO: 4802 - DNA, 330 bp, Homo sapiens
gacagattgcttcatttatgtttctacatagtaaggtgactgccaaataatatttgaagtcatctgtctctttgtaaattattttatatgacctataaatttaaaaatgtttttcagtgagtgcttttaacaaacttaagcttctgccctgccaagggaattaatgttatcttgtgaaaggtgttgctgtttgaattgatgagaaatggaagatgagactccctaagagttctcataataaatcatctcatcacaaatcaatacggtatacagagttaaagtggattgaggtaagagatacagctacagaatatagttgcgtttatggga

SEQ ID NO: 4803 - DNA, 360 bp, Homo sapiens
ttcaattgcatatagcttggtttccataacatagagcattggttgactgtttacagaagactcactcaccaggataaacattgctgtatgttacagtaaagctatctggagagacacataaatgattttggcataccattagagagaccatttgtaaaactcaaatgaccacataaagcttatcaaggagtctagattggttttgttttataccatatgggatgaggaaatagaaatgtcagtagaactcattgagggttctctgccacctcctgaaaatagaagttcgctctctcagatttggtttgaagctggacaatttgcttgttgataggataagcttttctaagtcctcatctc

SEQ ID NO: 4804 - DNA, 300 bp, Homo sapiens
ctcatctggggcgctctatggcctgttcctgactgcggctgcacagcccctgaaggccaagaccagcctcccagcctggtctgctgccatggatgccggcctggaagccatgcagaagtatggcaaggctgctccaggggacaggactatgctggattctctgtgggcagcggggcaggagctccaagcctggaagagcccaggagctgatctgttacaagtcctgaccaaagcagtaagagttccgaagctgcagccgaggccaccaagattattggagcttgagccggagagccattt

SEQ ID NO: 4805 - DNA, 260 bp, Homo sapiens
gaaacatttaaaataaaatctcttactaaaattgaatattgtcatttgagataaatcctagctaccagtaaattcacttgaggaattgctggatattttgccgtgctatacctttgatttctatgtatttaaaccaaatttttagagattggctcttaagttttcctctgtgatttgtgaaggtgctcaccagatattttgagaagacgcacacatatacattctactgtgccatactagtagcgtactactactatact

SEQ ID NO: 4806 - DNA, 256 bp, Homo sapiens
ctcgtccttcggaggcgttcagctgcttcaagatgaagctgaacatctccttcccagccactggctgcccagaaactcattgaagtggacgatgaacgcaaacttcgtactttctatgagaagcgtatggccacagaagttgctgctgacgctctgggtgaagaatggaagggttatgtggtccgaatcagtggtggcaccacaaacaggtttccccatgaaggcagggtgttcttcacccatcgccgtctccgct

SEQ ID NO: 4807 - DNA, 288 bp, Homo sapiens
tgggaattaccaaggattttaaagtgggtggatcctgcagaagaaggctagagatgatcctttaaagatattttactgttaattgaaaacgtttttatttaatgtttgctttcacaattttggtgaacttttgctgagcattacttggcttctgatgcatcctgtgtttcagaccagcatcgtgaatacttgaaatcaaaattgtgatggacaggcagggtgatagtaaccttggagagaaagatttcaacatttctcaggatattccttcccgtccttcctttcttt

SEQ ID NO: 4808 - DNA, 317 bp, Homo sapiens
gactaaggtgactgtgcaacaggtccctgcagcactgccggcctggcgcagagggtgaacctggtgccatgggacccagggaagacccggtccccgggacacgttgggccaccagggcctccagcagccaggaccagctggatctctgcagtgggtctaaaggagacccaggagccaccggagaaaggggccttccagccttcccagccagccccgcccccctgacaccctgcccccaggcgaccttgtacggatggtcagctgcaagaggacccctgaaagcaggaatctatgacctctgcccaaggtgatcagga

SEQ ID NO: 4809 - DNA, 276 bp, Homo sapiens
gttgcccaggctggtctcaggctcctgggctcagatggtcctcctgcctcagcttccaaaggcacaggccaagttgtagctttgtcccttgccatcatgcccaacaagaggttctatacctcttaatgaattgactttcataaattggttatgttggtgggcaagttctttaagctggaaattgtaaattcctcctgaaatgttttttcatgcagttaccatgaactaatactacaataaaggatggtcttgggtgtcaaaaaaaaaaaaaaaaaa

SEQ ID NO: 4810 - DNA, 379 bp, Homo sapiens
gccaaagtgagagtccagcggtcttccagcgcttgggccacggcggcggccctgggagcagaggtggagcgaccccattacgctaaagatgaaaggctggggttggctggccctgcttctgggggccctgctgggaacgcctggtctcggaggagcaggatctccactgtggagcatgcagggctctggtggatgaactagaatgggaaattgcccaggtggaccccaagaagaccattcagatgggatctttccggatcaatccagatggcagccagtcaagtggtggaggtactactactgctccccaaacaagtagctactctgctttgatgaatcgactctaaaaggacctggtttatagaataagaacagctag

SEQ ID NO: 4811 - DNA, 328 bp, Homo sapiens
ctcaaaagggtgaatctaagagttattggccttaaaaaagaagttaaaaaagagctggggtagaaagtttattcaaaggaataataacagagaacttcccaaacctagggaaagatatcaatattcaagtacaagaaggttatagaacaccacggagatataacccaaagcacacctgaacataccagtcacacgtaagaggatcacagctgtaataaaaaaagtctctcagcaaagaaacccttaggacctgatggcttcttctgaattttgcaacatttaaggaagactatagcaatcctactcaactatctgacaatagagtatt

SEQ ID NO: 4812 - DNA, 340 bp, Homo sapiens
cggcttcctagtgagtcggcggctgatttagaaggaggttcaggctacggtgagccgaagtggggttggtgaaagcgtgtggggcccgttcctaggggcccagctcccttttgccccaagagatccagctcctcgcctttcctggggcttccgcctttatttctggtttctcctgcagtgtagcctccatccttctttgctgccgctaaagccttgtttttcttagaggtgtggggacttcaaggcgctcaaagaccatcttgggaagccgtgcctatttccagatagacaaactgctccattcgcgtcctgtttctctcaagcggacacagtactatat

SEQ ID NO: 4813 - DNA, 312 bp, Homo sapiens
tcaacatggacgatcgggttactgcgtgtgcagaacattctcaaaatttggcttacctgaattgacaaggtggaggagcggcgggaggctacaatggacttctatgacatcgtgctggagaaggacgagactctggatgtggtcaacgggctactgcagcacaacctgtcccagggggtccagctggagatgcaaggcccctaaaggcgcagctccagccggccttcagcttgggttaggagggcgcctcccagagtcttctccccgtaacaaggacagaggcaagtgcagcagtgctggtcttccggccct

SEQ ID NO: 4814 - DNA, 260 bp, Homo sapiens
gaagaaattataatccagtccctgtaatttttcatatacagtgtttctcatccaataaaagttacagttcatgctaagtgacagaacagaatgacagaaagccaagagaaaaatagataataaaaacaaactcatgggtgattcagagattagagttatcagagtagagtttttaaactgttactgacatttaagaaatagtggaaaaggtatggaaatagatgaaagagaataattttaccagagaattgcagtttgta

SEQ ID NO: 4815 - DNA, 165 bp, Homo sapiens
ctcagagagaaccaccataggtctgtctcctgccgacacgaccaacgtcaggccgcctggggtaaggtcggcgcgcaccgtggcgaggtatggtccggaggcccttgagaggatgtacctgatcttcccaccaccaagacctactttccgacttcgacctagcca

SEQ ID NO: 4816 - DNA, 173 bp, Homo sapiens
tgataggaacaggtcagtgagcagtggaattaccttttaaggtatttgaacacgttggacaagcccacactcaaacctaatgtgtactggagaaagtataacatgaccctgcattcatacacatatgcatgtgtagatgctaaataaatgcatgtgtagtaactcacatgcca

SEQ ID NO: 4817 - DNA, 344 bp, Homo sapiens
gggacgcaaccaaaccatatcagctgggattaattactgcccactggagggaggtacccagttggaagtaactgaataatgagggcaggtctttcccgtgctgttctcatgacagtaagtgtcatgagatctgatggttattttaagggggacttttcctgcaaaagctctcctctcatctgccaccaagtgagatgtgcctttcaccttctcccatgattgtgaggcctccccagccacatggaactgtagtcaattaaacctctctttcataaattgcccagtattggggtatttattagagtgtgcaaatggactaatacactggctaagtccatgcctac

SEQ ID NO: 4818 - DNA, 286 bp, Homo sapiens
ccacccactcctgctcagtacctggcgttggtacacaggcaaggattggcacaaccaaaattggccttttttctccctcttaatattgaagaaattcccacatttctcatttggtaatggtgttgtggcctcagatttcttctagtatttgcttctgatgaatgattatggtctatacataaaaagtaagactaagtattgctgaatttgcagttattgtgtcgtgtatagagctacttccagttggtacaaatgaacccatggatgatgacttcatgttcttctc

SEQ ID NO: 4819 - DNA, 193 bp, Homo sapiens
cttccatatatctttcattaacttacttgctgccttttttttttcttggtacacatttaaataaagtaatccttaacctgtgctgtaaagttcacccttggcatgctgttccagaacctgggtttgaatcccaatcgttgtgaacatactcagtattgataaaaccttttaataggtatgcaggcagccaagg

SEQ ID NO: 4820 - DNA, 251 bp, Homo sapiens
tttaagaataatatgtaacctaagtacaacacccagcatttaagtatgtagaaagtaatcttattctctggggcacaaattgagttattaaatgcagtacattgttttaacagcacacattctggttattactttgtattgcatcattaattaattacattgctgtttaccttgtttaattagatttgacatatgttactgtgtaggtgatcctaagccatcattctaaaacaaattagtggagccctatg

SEQ ID NO: 4821 - DNA, 319 bp, Homo sapiens
gaaactctttttgggctcctttttctccctctggatcaaagtaggcaggaccatgggaccaggtcttggagctgagcctctcacctgtactcttccgaaaaatcctcttcctctgaggctggatcctagccttatcctctgatctccatggcttcctcctcctcctgccgactcctgggttgagctgttgcctcagtcccccaacagatgcttttctgtctctgcctcctcaccctgagccccttccttgctctgcacccccatatggtcatagcccagatcagctcctaacccttatcaccagctgcctcttctgtgg

SEQ ID NO: 4822 - DNA, 307 bp, Homo sapiens
cacaagtacagaccagagacaaagcaagagaagaggcagagactgttggcccgggcgagaagaaggctgctgcaaaggggacgtcccaacgaagagaccacctgtccttcgagcaggagttaacaccgtcaccaccttgtgaggaacagaaagctcagctggtggtgattgcacacgacgtgatcccatcgagctggttgtcttcttgcctgccctgtgtcgtaaaatggggggtccttactgcattatcaagggaaaggcaaggcttggacgtctagtcacaggacgacctgcaccactgtcgctc

SEQ ID NO: 4823 - DNA, 275 bp, Homo sapiens
gtggtgccagacccctgcagcaggccaggttgggatgaggacgaggacgaggaggacacggccccagagtccgcacttgacaaattccttgacaagttccttcttcgaggatgccggtaaccacttcctggggtcggcacacattcccaagggccccgggcccggccttaaaaggggacccggaagaccaaggaggaaggctcccttcagagacacaggagggcgtcatcagcccaggccccaggcacaatatagagaccacacacacagatact

SEQ ID NO: 4824 - DNA, 164 bp, Homo sapiens
agaggagctgtgttataatcctttcagtgctgctgaatatactgataatggaaaataaacaggggtgcacttggtttcttgggcctgtaaaccaaaaaccagatttcagtgtgccaaagctgtgtttttgctttgcaagggccaaggaatgttttctttcagag

SEQ ID NO: 4825 - DNA, 125 bp, Homo sapiens
ctgtgcgaattcggcacgaggcgagtttttcacttccttcaaaaaaggaaactgaggcagtcatcaaattccagccagttcccaagaacaacaagggacccgtcaagtcgtggtggaaagagcct

SEQ ID NO: 4826 - DNA, 250 bp, Homo sapiens
gcacacaggctctcaactgtggtcaatgctgaccagatcctcgtcatcaaggatggctgcatcgtgtgagagggggacggcacgaaggctctctttgtgcccgaggtgggggtgtatgctgacatgtgggcagctgcagcagggacagagaggagaacctctgtaagacactcaggcctcagaaccattggaacgcgttacaaaaggtgttggccactttcctctcaaagactatacccgagggggatta

SEQ ID NO: 4827 - DNA, 285 bp, Homo sapiens
caacagcaaaaccccattataaagtgatagtggtgtgagattgagctcaaagaggtactgaatatgtgatttgcatgaattgaggtttagactctcatgacacctactgttattgcattgctgcctgtccttcaactcactcttctgacctcataggggaggttccccctgacttgggaggaaaaaaattcaggcctggtgtacatatgattctgtggtgatatgctgacacagataggagggatttggtgcatattttggcccacctcggaggtgtctggagtg

SEQ ID NO: 4828 - DNA, 318 bp, Homo sapiens
ccccttcttacccgcaaaagacaagtctttacagaatcaaatgcaattttaaatcttagagctcgctttgagtgacttggttttgtgattgcctcttaagcctatgtatgccatggaggcactaacaaactctgaggttttccgaaatcagaaagcgaaaaaatcagtgaataaaccatcatcttgccactaccccctcctcgaagccacagcaggggtttcagggttccactcagacctctttggcaaggtgacatttccatgcataaatgcgatccacagaaggtgctcgtggtatttgtaactttttgcaaggca

SEQ ID NO: 4829 - DNA, 104 bp, Homo sapiens
ctgacctgatgtccattcattccaccctctcacaggtcggacttttcttccctttttttctaagagaccggaactgggcagagcttgcaaaataaaatctcggt

SEQ ID NO: 4830 - DNA, 310 bp, Homo sapiens
cacgtccggctaatttttgtattttcagtagagacggggttttgctatgttgggcaggctgggctcaaacttctgacctcaagtggattcacctgcctctgggctttccaaagtgtttaggataaacagagtgtttagcccaccttgcccccgctctaagattttttcttaattgcaatataatatctcaaacaaattttttctaatgagaaaagaatttttgtgtatcccctgaaagtgtttcatcatttaaaagagcgttgcagcagatatgattactttgacgacgaaggcggctaatactactaag

SEQ ID NO: 4831 - DNA, 315 bp, Homo sapiens
gccagtttgaatataatgtagaaggagtgacttccaaggaaatggctacccaacttgccttcatgcggcttctggccaactatggctttcagaacatcaccctaccactgtcaagaacagacattgcatacaagggtgtggggggacttggccacctctaaaaaggctttttattcttacaggggctctctatttatgtttaaactctttttctcgggggcaaccacagcggtttactatacactacttttttgttgggggggggcccttctctaaggccacagatgtggggggggaaaaatagtctgtagtact

SEQ ID NO: 4832 - DNA, 286 bp, Homo sapiens
aagagatcgacttcctaagaagcagcaagcaagtgcttccactgatgggtgtcgataagctttcttgggaagagcagagttttacttcttttgaagttagaaaagttgctgaaactaaagaaaaagagcaagcatctctaaaaccaaaacatgtaaaaaagtacaggatggcttatctctatattttcagagaaaatttctcaaagagagagcacagcgctgaaaacttctctaggagaataaaaaagcagcagcaacaaaggggcgctctaggagaaaaagagac

SEQ ID NO: 4833 - DNA, 286 bp, Homo sapiens; identical to SEQ ID NO: 4832

SEQ ID NO: 4834 - DNA, 190 bp, Homo sapiens
gctggtcttattttaggtgtaagcccatcttgctggcaaggctaagattagaacagctcataggagagtcatgattttgaatcacccagataaaggttgatctccctacggagcagcccaaataaattaagaaaaagacttcctaggacaacccccaaacattgatgcttaaggagcacactcaaaggga

SEQ ID NO: 4835 - DNA, 325 bp, Homo sapiens
accttatatttgcagagcactttgcactttgtcagacatgaccaggcttgtgttttttcatccagcccgcaaatgcttgtccagtacctactgtgtgccaggtggtagaaaagtaaacacggttaggttgatgtcttgaaggagcctacaggctgggggaaacatataaaacaaataagtataagagatggtgagtcagagatatgtgatagactcgggcttaaaggaggggtgttttgttataccacgggatatcaggggagggctttttagaggaggaggcatatagggggcacatataaacactatttttgggagactctct

SEQ ID NO: 4836 - DNA, 311 bp, Homo sapiens
atccatctttgacgcctggcagaaggggcagcgtcaccaaaccttgcagacaggctctctctggggcacaggttcttccgggtggcaggaggacaggcctggcctagcacattgtttgtcacgctgtgtactgttgcccaaaaggagagtgcttgtctgtacagacgtgtgaggcccggattgtgtgtgctcgaggccaggaagaggaagggagctgctgcacctgcttgggtgacaaacagtgatgaatagcacctcacagcaattaggatgactgtcatcaaagacacagaaaatagcaagtgtgagcc

SEQ ID NO: 4837 - DNA, 306 bp, Homo sapiens
ctcgtgccccttcagcacaggtgagcgcaagagccggccacatggggaccgtaagtcctgtgagatgggcctgcagctccgccagactttcgaggcagccatcctcacacagctgcacccacgctgccagattgatatctatgtgcaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagc

SEQ ID NO: 4838 - DNA, 306 bp, Homo sapiens
cttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggtcctg

SEQ ID NO: 4839 - DNA, 301 bp, Homo sapiens
gaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtatttggagcataaaatgtatgctgttgtgaccaataatataaaatatggtaattggatttaacttcacaccatagtatgcattgttatacatactgtgtacctaattatgtatagcagtgtaggctcaattatatct

SEQ ID NO: 4840 - DNA, 303 bp, Homo sapiens
gcggctggctctcgttttccggataacgactacagctccgactgtcagtgccggccttcctcgtgtgaggggatctgccggacccctgcaaattcaatttctttcccattccgggcccttccctatcgtcgccccttcaccttggcatcatgttcaagaaatttgatgaaaaagaaaatgtgtccaactgcatccagttgaaaacttcagttattaggggtattaagaatcaattgatagagcaatttccaggtattgaaccatggcttaatcaaatcatgcctaagaaagatcctgtcaaaa

SEQ ID NO: 4841 - DNA, 302 bp, Homo sapiens
gtttctccatgttggccaggctggtctcaaactcctgacctcgtgatacgcccgcctcagcctcccaaagtggctggggattacaggcgcgacaacccatggcccggccagtggtcctttcttatacacgtacatacatggatgatgggcttgagtgcagctggcagggcagtggggcttaatgagaggggatctttgtaaagacagctcttcacttcagctcagtagctttggtcataggcaagtttgttttccattatcataatttgatgattctagtgatgaattcaatgctagttctt

SEQ ID NO: 4842 - DNA, 303 bp, Homo sapiens
tttctgagagattcaaagcctccacgactctgtttcccccgtcccttctgaatttaatttgcactaagtcatttgcactggttggagttgtggagacggccttgagtctcggtgcgagtgtgcgtgagtgtgagccaccttggcaagtgcctgcgcagggcccggccgccctccatctgggccgggtgacttggcgccggctgtgtgcccgaggcctcaccctgccctcgcctagtctggaagctccgaccgacatcacggagcagccttcaagcattccattacgccccatctcgctctgtg

SEQ ID NO: 4843 - DNA, 299 bp, Homo sapiens
ccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgcccctgagtgactgccccagcccaggccagaagacctccttcaggtg

SEQ ID NO: 4844 - DNA, 297 bp, Homo sapiens
tctttgagaccttcgtatagcctataaaatgtatgggagatgttggtattttatgtgtataaaagcaacaatatcagcaacttcgtgtttatactgcaccttggttgttgatgtcaagtaaaaaaaagattgttttgtaacacataaaaaaatggaagaaactgataccacacctaaggaccaaagataagaaagacttttgcccaagacagtgaaagtaattataaaaacaagctttgaccacttaccaagtatctgaagagatgagttcatactatgatttagaaagtggttcaa

SEQ ID NO: 4845 - DNA, 292 bp, Homo sapiens
cctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttc

SEQ ID NO: 4846 - DNA, 295 bp, Homo sapiens
agagaaggctcacgatggtggccgctactaccgggctgatgatgccaatgtggttcgtgaccgtgacctcgaggtggacaccaccctcaagagcctgagccagcagatcgagaacatccggagcccagaggcagccgcaagaaccccgcccgcacctgccgtgacctcaagatgtgccactctgacttgaagagtggagagtacttgattgaccccaaccaaggctgcaacctggatgccatcaaagtcttctgcaacatggagactgtgtgagacctgcgtgtaccccactcag

SEQ ID NO: 4847 - DNA, 290 bp, Homo sapiens
ggggccagaaattcccaagttggtcacaggtggcttagaagtgtgtgttatggttttacggatttccttgaagcctctctccttctctgcctacaaagaccctatactctcagtctccccaacccacccccaaggagctgtgggaggctttgtgttatctgtgaaactccaaaacaggggtgttgcggagaagggagagttcaaggcaaacgcaaggacttgacttagctccctaggtgccacagtcagatgccggacacaggatttatatataaatatatatatatggg

SEQ ID NO: 4848 - DNA, 245 bp, Homo sapiens
aatggcggtggggggggatggtgctgtatgagacagacgtagttcctgccctaagagacatacagttgagcagggtgctcatgtcacccccaccagccagagggaccagccagaggaaaagagagttgggttaggtcgtaccaggggtttgtgcctcctcttgataccttggagcccacggggtgaggttttttttttagattgattgggagggcttcagccttggccttggcttcccttgggtg

SEQ ID NO: 4849 - DNA, 285 bp, Homo sapiens
ggaccttggcctgagatgtgatctgtctagctatgatacaacactgcttcacagataaagtaccagcttcaggaattggaaggttattgatttttcttggataacatgggtacatttcagtcatatttgaattttaatttagttggattctcacttatttgtaaagctaaccggtttgtattggaaatattataaatattctggggagtctcaaatggtggatttaatactagcttttaggtaatttaggataaattaccatttaatcctataaccatctctcta

SEQ ID NO: 4850 - DNA, 295 bp, Homo sapiens
cggaggtggcagccatctccttctcggcatcatggccgccctcagaccccttgtgaagcccaagatcgtcaaaaagagaaccaagaagttcatccggcaccagtcagaccgcatatgtcaaaattaagcgtaactggcggagacccagaggcattgacaacagggttcgtggaggattcaaggggccagacctgaatgcccaccattggtaatggaggcaccacaaaaccacaggcacatgtctgcccagtggcttccggaggtccctggcccacaccgtacaggggcgctggga

SEQ ID NO: 4851 - DNA, 285 bp, Homo sapiens
agtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagacgagcagcatttcggttgaagggctttgattcccatttgcgggcaggtgcttggacggtgtcccgagacccaccgggagggcggcgcattgcctttaaccccacctgtcaggttttggccggttttctcctaggttg

SEQ ID NO: 4852 - DNA, 150 bp, Homo sapiens
accacattggcaagggggagcctcggccctgaacagagcagctgctgatgtctggaggctgattttcctgttctctgttctccactggaaaggttgtttacgacaaacctccttgtcaaagtgtgtaaaaataaaggattgctccatccg

SEQ ID NO: 4853 - DNA, 297 bp, Homo sapiens
agaaatcatggaagaaaggtatacaagtacttgcctttactcctgcatgtagaagactcttatgagcgagataatgcagagaaggcctttcatataaatttatacagctctgagctgttcttcttctagggtgccttttcattaagaggtttggacagaagggtaaagctattaggattgaaagagtcatctatactggtaaagaaggcaaaagttctcagggatgtcctattgctaagtgggtggttcgcagaagcagcagtgaagagaagctactctgttttgtgcgggaggagc

SEQ ID NO: 4854 - DNA, 190 bp, Homo sapiens
gcacgaggttttcaagagctgaattgagaaggaaagagactggagtggttaatggtgatttgatttctggcattctgagttttctgctacaattagctgcattacttggtgccaaagagcagttgggaattgttgagttgctgtatcctttaaaaaaaaaaaaaaaaactcggggggkacttytdgggsg

SEQ ID NO: 4855 - DNA, 263 bp, Homo sapiens
cggcacgagctgtactggagccacccgcgaaaattcggccaggggtctcgctcttgtcgtgtctgttcaaaccggcacggtctgatccggaaatatggcctcaatatgtgccgccagtgtttccgtcagtacgcgaaggatatcggtttcattaagttggactaaatgctcttccctcagaggattatccggggcatctactcaatgaaaaaccatgataattctttgtatataaaataaacatttgataaaaaaaaaaaagg

SEQ ID NO: 4856 - DNA, 349 bp, Homo sapiens
ctcgtgccgaattcggcacgagaccaagccctgaggtttcattaagcccctctaaggcagaacttgtcctcccagccccaggagccttcttctcagtcttttcagccgtccagctcttactttctcttgggtttctgaatcttatcttgctcatgcatagtcaggaattatttaaggattttagcagagttgtatgcatactttgaagctacccactctgtgggtctgtcttttcaggaatttttctcctcatatatctagctgctgtgacagctccagatacctctgactcctcagtatctcaggactttcgctttctgctttcacactctttctcttctgtctgcac

SEQ ID NO: 4857 - DNA, 230 bp, Homo sapiens
ggaaatttgcccatctgcatggcaaagacccacctttctctatctcaccaacctgacaaaaaaggtgtgccaagggacttcatcttacctatcagtgacggtccggccagcataggcgctggggtcatttacccttttgtcggaacgattagcaccattccaaggcttcccaaccgggccttcttttattacatagagatttgataacccgaacagagacacagtgtata

SEQ ID NO: 4858 - DNA, 225 bp, Homo sapiens
gagaagtcccccctgcgggtgaagaacttcgggatctagctgcgctatgacttccggagcggcaaccacaacatgtacccggaataccgggacctgaaccaacggcaggcgctgtcaaccagtcttaccgagacaagggtgcccgccacccggcccgagcccattccattgagatcatatgggtggggagatatacgggccagacgataccgccggccgtctgtt

SEQ ID NO: 4859 - DNA, 138 bp, Homo sapiens
tgtcctctgccagcctacaggaggaaaagcaaggcttacagaaggatgttccttcaaggagggaggcagcactaaaaggcactctgaggtcaaggattgaagtggggaaacccactcaattaaaccacatttttggat

SEQ ID NO: 4860 - DNA, 238 bp, Homo sapiens
tgtagatttggtcttttcacacagtcacatatttcttagaggctttgtttatttctttttactcttttttctctaaacttctcttcttgcttcaattcattcatttgatcttcaatcactgatactctttccttccacttgatcgaatcagctacttgatgcttgtgcatgcatcatgggtgttcttgtgccatggttttcagctccacagggaatttagggcttctctacgctgtta

SEQ ID NO: 4861 - DNA, 258 bp, Homo sapiens
cctcaattgacctccacctccaaggagcaggagaaagtctgtgatgcttgatgtctttccattctcaggcaacaggagtcttgactcttcccacatatcttacccgcatgaaattggtgaaaactatcaagtccacactcaaaaaaaatcataggacatgtttcctggcccacagtccttctcctcacatatttatcacaaggctgattttcacagtagggttctgcatattatggggtgcaaatgccaaccctgtcg

SEQ ID NO: 4862 - DNA, 295 bp, Homo sapiens
ggagtcttgttggggacatgagacttacttgggacaagagtagaaaacaacaggttaaagtggcaaaatgtacattgtggattttcagtgctgttatcagtttagaggaaattattttgggccaaaaattttagtgatgtctccaggagaagcaggattttatttgggtttttaagagtgggatttggaaaattcaggagaggacattcccaggtgttggaatggcataagcaaaagagtgagtgtgtgtccaatgtgtgtgtatgcaggggtgcttgtcgtctgtgtatttagc

SEQ ID NO: 4863 - DNA, 262 bp, Homo sapiens
tcccagaggccctttgtgaactcaggaggctaatgaaatgcacgagaatgttattaaaatacgttcgcacacgttttgagagtcttgccttagatggattgctgcttcagtgccctccttgcctcactttttgcctttcgctctgtaaagctgccttgaggacctcctgctcgaggggcacacatccttgtgtcacccttattccaagggctgggcacagtgcatcattttgctcttgtctctctttatgggtcagggcttt

SEQ ID NO: 4864 - DNA, 260 bp, Homo sapiens
ctggaagcacccctgccccctttttcagggatttttatctcgaggcctttggaggagcagtggtgggggttagctgtaacctccaggtatgattaagggaggatttgggtagaaactctccagacccatgcctccaatggcaggtatgctgcctttcccacctagagaggggaccctgtccatgtgacagcctcatcagagcctcaccctgggaggatgccgtggcgtctcctcccaggagccagatcagtgcgagtgtg

SEQ ID NO: 4865 - DNA, 220 bp, Homo sapiens
ctgaattatgaggacactatttgagagttagtggccagaaaacgatgaaatcttatagatcttttgacagttctctgtttaggggagcctagactgatatcaagttctccatatcaagcttcattggtgacctcatttgctttacaggtgaccagccatcttgcaggcttacatgcttctgagagcctcactgagaggatgctgctggagtcacagctga

SEQ ID NO: 4866 - DNA, 190 bp, Homo sapiens
ggagcgcggctgcgcgcgcgcgtcgagggggagaggcagcagccgcgatggacgtgtttcctcatgatccggcgccacaggaccaccatttttaagggacgccaaggagtccagcacggtttttcgacctgaggcgcatcgtcgagggcatccttaagcggcctcctgacgagcagcgccttatacaagg

SEQ ID NO: 4867 - DNA, 212 bp, Homo sapiens
gtcactcagcataatgagcatttaacatacagaggcaatgtactgttttgtgttgatctatgtaaaagaatacaattcttttttacataattagtgaaattttattttttattgggaaccactaaatggtgtaatattccttttgcttttaaaaaaattcctggtggcaaatcaagttaaataattgctccaattctctcgcgcaatcactg

SEQ ID NO: 4868 - DNA, 240 bp, Homo sapiens
cacctcgctgctccagcctctgggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcacccagatcggtgccaagttctgggaggtgatcagtgatgaacatggcatcgcccacaccggacacctaccacg

SEQ ID NO: 4869 - DNA, 165 bp, Homo sapiens
aagaccttcgggtcaaggcagaggcaggaaactaactggtgtgagtcaaatgccccctgagtgactgcccccagcccaggccagaagacctcccttcaggtgccgggcgcaggaactgtgtgtgtcctacacattggtgctattctgtgtcaaacacctctgtat

SEQ ID NO: 4870 - DNA, 140 bp, Homo sapiens
cctctaggcaggagaagaggcgattggcggcgattggcatctctcgggcgccctggcgttgcttccttgctgtccagccttttcccggttgttaacccggaggccttccttggggcccaagattaaccctttccttactt

SEQ ID NO: 4871 - DNA, 135 bp, Homo sapiens
ggggacctctaactccacacatactacacccggggggttggtggggccacccctcttggtctggtgttagggacagaggaaaactctgtgtgcctccttggttgtaacagacctggatcctctgcataccccagc

SEQ ID NO: 4872 - DNA, 137 bp, Homo sapiens
atctcaacgttcgagtaaactggaggactgtggctattcctgaaccttctttgagacagaatcctcagaatctcacacttataaccttcctaaccttttaacttgaatgctttgccatattacaggcacagagcact

SEQ ID NO: 4873 - DNA, 255 bp, Homo sapiens
cctgtgtattggtgacttggaggtgctaacctaggaagaattggtttgatcaccaacagagagaggcaccctggatcctttgacgtggttaacgtgaaaaatgccaatggcaacagcttttccacttgactttccaacatttttgttattggcaagggcaacaaaccatgggtttcccttccccgagggaaggggttctcccttaccctttcctagagagagacacagagtttcgcgccaaccagcagcagtggc

SEQ ID NO: 4874 - DNA, 239 bp, Homo sapiens
aaattatgttattttttacaactaattttgtactctcagaatgtttgtcatatgcttcttgcaatgcatattttttaatctcaaacggttcaattaaaccatttttcaggatttaaggggattacttcaaattcagtattcaggaaaccttcaggatttaggtaaaagggtggttggactgggcacaggtctttatacctctgtcactgtacaggtactcattaagaggatattgattg

SEQ ID NO: 4875 - DNA, 277 bp, Homo sapiens
cagctctgagctcccttctgctccccagggccaccggcttggcctttaggacagagataaacctagcccgggaggttgggaaaggcaaaggttgaggccaagttcaagggaccgcggggccaagcaagttttcccttacttccagcttccttgggagttaaggggccgttcccttccttacacccgaggcttggagggcgcgcgcacagacaggacagcctgtctctctagccctggagtgtcttggagaccaactcaggcgcttagtccacgcaat

SEQ ID NO: 4876 - DNA, 132 bp, Homo sapiens
agaagacctcccttcaggtgccgggcgcaggaactgtgtgtgtcctacacaatggtgctattctgtgtcaaacacctctgtattttttaaaacatcaattgatattaaaaatgaaaggattattgggaaggt

SEQ ID NO: 4877 - DNA, 288 bp, Homo sapiens
attaaaaacccaaaggaacctgagggaagtgttgcagcacccaagatcagatgcagtggttttcagatgcctgacttttcttaatctaatcaggaaaccctccagccttatgttaattctttccacaaaaggctcctaaggctttaattctgttcctggctctgcactagatatatcttccttgggtgatttgaattacacctcaaatgatttaattcacaggttagggacagcgtgatttatcatcatctgctggcctcccagagctcagctagactaggctgctgt

SEQ ID NO: 4878 - DNA, 188 bp, Homo sapiens
tgaaagactgagaatttaccactcatggacccttgttaaaataatttttaacagttggcttcaccaggaggaaatttagtccagagggttggtgaaagatgcaaggaggcaatgtgaggcggtaaacctgttgcttgggtcagtagggctatgctttcaaaacctattttggaaaggctttccattag

SEQ ID NO: 4879 - DNA, 282 bp, Homo sapiens
gcgggtccgacggtcacacctacttccagatctgccgcctgcaggaggcggcccgcgctcggcccgatgccaacctcactgtggcacacccggggccctgcgaatcggggccccagatcgtgtcacatccatatgacaattgggatgtgacaaggcaggatgttatctattggctgttaaggtgtttgccacccaatggcctcatgagtggagaaggatgcttggacatcagctccagggtatgaccccacatctctgtgcagtttaggggttagacccaga

SEQ ID NO: 4880 - DNA, 138 bp, Homo sapiens
gttttgtggaccactttggttttcttttttgcgtgtggcagttttaagttattagtttttaaaatcagtactttttaatggaaacaacttgaccaaaaatttgtcacagaattttgagaacccattaaaaaagttaaa

SEQ ID NO: 4881 - DNA, 180 bp, Homo sapiens
cggctttcatgtcccagagacctgttgtgctgtgtattttgattttctgtgtatgcaaatgtgtgtatttaccattgtgtagggggctgtgtcttatctttgggttcaaaacagagactgtattttttgcctttaaaattaaatatatataaacgggaatataatgagccctatctgtgt

SEQ ID NO: 4882 - DNA, 145 bp, Homo sapiens
ccggtcaacctgaggcttgtggtgccggccacccagtgcggcttcctgatttggaaaggcgggtgtaaggttaaagagattcccgagagtacgggggcgcaaaggtccagttgccggggatatttctctgccaactctcacccca

SEQ ID NO: 4883 - DNA, 130 bp, Homo sapiens
actgtatgcagtcaatgtataaattcagacatagtgcacaatgccagaagttggactagtaatctttaaattatgctaggaaattgttttggaacacaatttccagagaccctatgtcttttggattttt

SEQ ID NO: 4884 - DNA, 112 bp, Homo sapiens
gccagtacaatccccaggcgttttctgtgttcagaagtagtaagaatgcctttaattcaaaggattatctaagctctttaaagctgtttttcttccctgtcataggcccctc

SEQ ID NO: 4885 - DNA, 125 bp, Homo sapiens
cctaagcaagaggaagtgcccctctcaaccttttcgggcttcttcgtcccaggacttagacggagggcaaccccggcccctaggccttaaggcttctttcttattcaaataaatgtttcttaatt

SEQ ID NO: 4886 - DNA, 130 bp, Homo sapiens
cgtgccctcaggaagaggtccaacggtttccctgagcctttgggtctccaggttacccaggcccctcagccatttgcagaaaatgccgagacgggtagcgaggccccccaagggggtgcaagaaattcct

SEQ ID NO: 4887 - DNA, 280 bp, Homo sapiens
aatactatttgttatagatcataatatgcataaaactgtacagaaatattttgtaatgtgttgattttaaaaaaaggatctgtaaataaagttttaaaaaaagagtttaaattgcacacgctgaaatatgtaggtatttttgctatttatttaaaggagtattttagggatattgaactatctgacattgacagtaatcaaaggtccaatcatctgaatgcttttcctcgaggagatgtgagctcagaactgactgcattacgggccttttttgcacctc

SEQ ID NO: 4888 - DNA, 142 bp, Homo sapiens
acggggcgcccccagagatggccagcaatcggaagttagcaaacttcgcaagtcttcagccccgcggcaccattctgcaggcttcttctgtaccacgggacggtttcatcaggttccatacccgaaaatctctcgggttcca

SEQ ID NO: 4889 - DNA, 280 bp, Homo sapiens
gcatcttcagtattcgcaaatgacgacaaaagggaagagagagcaccgagatagtctctaggcctttagaaacatagagttgttcctttggcacatatatgcgatctataaggaggggatattgtagacatcaaggggatgggtactcttcaaaaagggatgtcccacagtgtttaccatggcacaactcgtagagtactacaatagtgatcccagcatactgcttcgcgatgttgtaaacacacacgatgatgaggagagactcgtcacgagaagtaat

SEQ ID NO: 4890 - DNA, 215 bp, Homo sapiens
gacaagtgacgcgtatgatggagcagctcagacggcacctggcacacatcttcaggcaatccggccaaggagctgttcaaccgaggatgttggaagaggtcacactacccgaagcctgtagagaacacagagtttccagagggcacacccttagaagggcgcggagagtggtgtttcgcttttcttcagtgctatagcgtcttcgagacatacac

SEQ ID NO: 4891 - DNA, 255 bp, Homo sapiens
atgatttctaaccctagcatcatgacatgtatatagtgtgttgtaaggcatttgccagctaatagttaccagtactgaaggcttgtgattacggttaattgaggaaacttttaagcaggttcaaaagttataccccttatagagtggacatcttaattgtatatatatggctcttccctttttatattgtatcacagggatattaaaatgtgtatatatgacacatatccctgagtttataagcatattataatg

SEQ ID NO: 4892 - DNA, 250 bp, Homo sapiens
ggtaagtggggcaagactgttatcgagtaccggtcacagaagacctcacggcttcccatcattgacattgcacccatggacataggagggcccgagcaggaattcggtgttgacatagggccggtcttcttcttgtaaaaacctgaacccagagacaacacaatccgttgcaaacccaaaggacccaagtactcttcaatctcagtcactctaggactctgcactgaatggctgacctcaactcatgtcc

SEQ ID NO: 4893 - DNA, 295 bp, Homo sapiens
gccggcttggcccgctgcaggcctcaggcaggcggggccatggttggtccctgcggtgggacccgatcttggcctgcctcttagaagccctgagctaccttggggtcttgggttggtttcttggaaagtgtctttcccagaactttcccttgctctctctgtctcgtgagtgtgtgtccacagagggcaccccagactgagagccctcaccgcggaaggagggagagccccgtaggcacgtgtccactcttaatcagagggacagagctctctaatataactgctcgcagtgcac

SEQ ID NO: 4894 - DNA, 155 bp, Homo sapiens
ggaaactaactggtgtgagtcaaatgccccctgagtgacttcccccagcccaggccagaagaccttccttcaaggtcccggcgcaagaacttttttttttctacacaattgtgctattctttgtcaaacacactctcttatttttttataaacaa

SEQ ID NO: 4895 - DNA, 116 bp, Homo sapiens
tgacccttctgcaggagagggcaaataagttggtgaaataactgatgattaaggactacaaggagattcccatcaagcgcgcagacattcttaaggatgtcatcagagaatattat

SEQ ID NO: 4896 - DNA, 108 bp, Homo sapiens
ctgagctggacctcatcagccgcctttccagagaacatggggcttttgcatgccgtgaagtgcactcacttggacagcaagggggcaagggagcccttagcccttgct

SEQ ID NO: 4897 - DNA, 292 bp, Homo sapiens
gcgggatgaggctggccccctcctctgctttagccccggcaagcctcccgtggagctgtaggagctggagatggcatttcgtttggtgctcgagctcgtccaggatgtcttggatgtgttgktatatctctatttctcgagctctctggcgtgtgagagtctcgtctctcagagagccccgggcctctggcacacaagaggagagagggcctccatatgtgcccccagaggcccacaaatacagagccgtgcatatccccgtgagctctggggaccgctcttctgatcatca

SEQ ID NO: 4898 - DNA, 268 bp, Homo sapiens
taagtgctgtttgggctaacaggatctcctcttgcagtctgcagcccaggacgctgattccagcagcgccttaccgcgcagccgaagrttcactatggtgaaaatcggcttcaatacccctaccggcgtgcaaaaggaggaggcgcgcgcaagacgtgtgagagcccttctcgagcgcgcacggtcagagactcagatactgaccgcgcaaggagctctcgcgtgtgtcacacagggagaaaagagaggctcctctctggagatgtat

SEQ ID NO: 4899 - DNA, 245 bp, Homo sapiens
ctcgtgccgaattcggcacgagcagaagtgtcatctctctctgagcacgcattcccctgcagcagtcgaggaatgagcagattgagttatgcttgggcagagaggccttggaggaaaggttttcagccagtcgtttgtaaggcgctcgtcggcaccctctgaaacgcgccccacctctacagaccccatatctcacagactgtgctctaaatactctacagcacgagtctcaggatatttagggg

SEQ ID NO: 4900 - DNA, 230 bp, Homo sapiens
cttgaccttatctaactaccagaccaacaaagccaagcatgatgagctgacctatttctgatcctgactttggacaaggcccttcagccagaagacttacaaagtcaatcttcgtctaccagagcgtgcacttgtgtatcctaaaatataggttcactctctccgggctgtgtcccctcttgggttgggagggggcacggtatctctcagagtctctctttgtcacatat

SEQ ID NO: 4901 - DNA, 275 bp, Homo sapiens
cctggaagagggactccaatgggcatgccccctccgggaaatgcggcctcctccccctgggatggcgaggccttctttgacccttggccacagagtatgggagtagcttcccagaggcgttggctcgatttctcaaggccacgttaacacagagactcttttgtttacttatagctcgtttgttcgtggagtctcatatggattgtctctgtgttcccctacacaggtccccttccccccggggatgcgcgccccaacaaggcctagagtcatat

SEQ ID NO: 4902 - DNA, 210 bp, Homo sapiens
ctccaggggaagcctggtcagatgggaaattcaggcaaaccgggccaacaggggcctccaggagagggtgggaccccgaggacccccgggggctttcttgcaggtagaggagaattagggccagttgggttcccagggcttccagggtaacttgggtcttctgggatggcctttggcttccttggcttctttggcccctttagtgtccta

SEQ ID NO: 4903 - DNA, 290 bp, Homo sapiens
ggcagccatcaggtaagccaagatgggtgcatacaagtacatccaggagctatggagaaagaggcagtctgatgtcatgcgctttcttctgagggtccgctgctggcagtaccgccagctctctgctctccacagggctccccgccccacccggcctgataaagcgcgccgactgggctacacggccaagcaaggttacgttatatataggattcgtgttcgccgtggtggccgaaaacgcccagttcctaagggtgcacttacggcaggctgtccatcatggtgttacc

SEQ ID NO: 4904 - DNA, 292 bp, Homo sapiens
ccaagatttgccacttgcatcttctgaagttgtggcctgagccacacatggacctgcttgagccatggtgggaagcagtgaaagagctctctgctggaatgcaggaagcagagatgtgaggtcggtctgggcagggagcctgtgtaggttgctcctagcccaacccctcaaactattctgccctctgagagctctggggcctgtgatgagcagggcagcctcaaagatctctgaaatgctttcagggtctatctccattgtattgatggtggctctcttctgtctgtgttaa

SEQ ID NO: 4905 - DNA, 288 bp, Homo sapiens
gcttgatggtgtgtacaaactcacctgaatgggacttttttagacagatcttcatgacctgttcccaccccagttcatcatcatctcttttacaccaaaaggtctgcagggtgtggtactgtttcttttgtgccattttggggtggagaggttggatgtgatgaagccattaattcaggacttattcctccttgtgttgtgttttttttggcccttgcaccagagtatgaaatagcttccaggagctccagctataagctgggaagtgtctgtgtgattgtaatcaca

SEQ ID NO: 4906 - DNA, 208 bp, Homo sapiens
ctggccgagagtccaggccttgctcccccgaccgccatggagggggcagcccggcacagctgctgggagcccttgtgtgtctggtcacactttttaggcgtcacgccaaaggccagcctcctggccccaatacccattttggaggcccctgtggccgtgtggatgtcggtaacagttgtataaaataaattctatttatcgctattgt

SEQ ID NO: 4907 - DNA, 292 bp, Homo sapiens
tctctcttcatgttgactttctctaccagcccaggccaggagagtccggtggagtccttcatagcctttctactaattgagttggcttgtggattatactttcccagcatgagcttcctacggagaaaggtgatccctgagacagagcaggctggtgtactcaactggttccgggtacctctgcactcactggcttgcctagggctccttgtcctccatgacagtgatcgaaaaacaggcactcggaatatgttcagcatttgctctgctgtcatggtgatggctcttcttg

SEQ ID NO: 4908 - DNA, 240 bp, Homo sapiens
gaaatcctgaagtcaaagtcaaaggatttgatcctgtgataaatcagattattgataaactgaagcatgttgttcagttgttacagggtggatcacccaaacctgacagtgggaactccttcagctgggcagtggtggaggcatggttgaacacgtcagtggggactgtgatgatgaagatggttgcgggggatcaggaagtggagaagtcagaggacactcaagttcacagactggatg

SEQ ID NO: 4909 - DNA, 250 bp, Homo sapiens
gtcatttaatgaaacccctctttttccttgaaccaaaagagaccttgtttttcctttgaggaaggcagggagttccacttttaattttttatggaccatctcacaccactttccacctaaccctacgtactgttaatatggggctggcctgtcaagtctgggcaagattagtgataggatgctatcaggtcagaccccatgattgttagagtagctgaaagattcaggagttcttattttgaactctggc

SEQ ID NO: 4910 - DNA, 282 bp, Homo sapiens
ctgtgacaagatggcatcagatatcgaagatcatatctaccacgagctcacgagcacggacatgaagtaccggaaccgcgtgcgcagcgcataagcaacctcaaggaccccaggaaccccggcctgcggcggaacgtctctcagtggggccatctccgcaggtcttatagccaagatgacggcagaggaaatggccagtaatgacttagggagttgaggatgcatgacccaggaggcatccgtgagcacagatggccaaggcttgcgcaacacactgaactc

SEQ ID NO: 4911 - DNA, 209 bp, Homo sapiens
tccctcttctgccatgtaactgggaggatgtgctatgagtttgcaaacagctggactgtcaggctgctttttttccagatgttcctcctctgcctcccctttcccttctctcccctccttttccttccttccttcctttccttggtgcactgagcaccatttggaagcttgtagagaaaccaaaattaaagagagagagagagagcgtg

SEQ ID NO: 4912 - DNA, 246 bp, Homo sapiens
agagcaggatttctctgcctcttccaaacttttcctccctgaacctgagggaaactaatctggattcactccctctggttgatacccactcaaaaagggacacttctgattaagacggttgaaactagagatggacaggttatcaacgaaacttctcagcatcacgatgaccctgaataaaaattgcacacactcagtgcagcaatatattaccgcaaggataaaagagagattcatatcttaaaa

SEQ ID NO: 4913 - DNA, 147 bp, Homo sapiens
ctcgtgcgaattcggcacgaggagtcaagacctccatgcccacctcttaaaattatcttgaaaaacaaatgagctgatgtatgtgacagcagattttcagcagtaaggcgctgtactggtataggttgtaatgaatttttgaatacc

SEQ ID NO: 4914 - DNA, 185 bp, Homo sapiens
cctggacctaacagacctaattttccaatgggtcctgggtacagatggtcccatgggtggattaggagggattgagttcacattcacatggaattggctctttagggctcaggagatattggacagtatttccaagaaattctccccaataatatgagcctcagtaaatcaacccgggcactcca

SEQ ID NO: 4915 - DNA, 121 bp, Homo sapiens
aaactaaagagcttctgcacagcaaaagaaactaccatcagagtgaacaggcaacctacagaatgggagaaaattttttgcaacctactaatcttacaaagggctaatatcccagaatctt

SEQ ID NO: 4916 - DNA, 161 bp, Homo sapiens
catctatgtgggcccacttgtgtgtctttgctcttgtggctttcaaatccttggtccaactgtgagctttcctcttctgtgaaggtttccacttcctaaagtcaccccgcatttcccgacttttaaatcacagtgaccccaaatttttactctttttgcaa

SEQ ID NO: 4917 - DNA, 168 bp, Homo sapiens
ctgaggctagtgctgcattggacttcttctaacaaaaattgaaagcaaacattgaaaggatcaaatttgatttaaaataatttatttgtgtgctagaacaaagtcccagggtcctttaagataatacagtaaactccgcacccaggatgtaaaattcacaatggcccg

SEQ ID NO: 4918 - DNA, 150 bp, Homo sapiens
accatgaagagcctgatccttcttgccatcctggccgccttagcggtagtaactttgtgttatgaatcacatgaaagcatggaatcttatgaaccttaatcccttcattaacaggggaaattcaaattacctcatatcccctcagcagag

SEQ ID NO: 4919 - DNA, 247 bp, Homo sapiens
  misc_feature 218: n = A,T,C or G
aaatataatggatgatgatgagggagaagttgtggaatatgtggatgacctcttggaactggaggagaccagctagcccacagcaaccaaagagactttctcttggcgttcaggaaacacagattctttgtccttttcccaacagcccaggctgttgatacctcagagccttctctttactctccaaagttaaagggaggccccgtctctctaactgncatgtcatcagggggtgagcctgtccttt

SEQ ID NO: 4920 - DNA, 245 bp, Homo sapiens
agttgcccttgttgcaagtaatgaagcctgatttgattatgaagctgcttaatcactcttcatgtgttcagaattactgttttttttgtttgttttccttttggtcactgtgtacattaaaattttggaggatgctttactatgtaaggatatagatggtcattttaatccattcagccacatacggttgggctggtacacagcttattctgatacacgagtgctggggtgcatatggagagatt

SEQ ID NO: 4921 - DNA, 241 bp, Homo sapiens
caaactgaaggtatgtgcactgcgcgtgaccagccgggcccgcagccgcatcctcagggcaggggggcaagatcctcactttcgaccagctggccctggactcccctaagggctgtggcactgtcctgctctccggtcctcgcaagggccgagagtttaccgccatttcggcaggccccaggaccccggcacagccacaccaaaccttacgtccgctccaaggccgcaagttcgagcgtcc

SEQ ID NO: 4922 - DNA, 244 bp, Homo sapiens
atgacaaagaaaagaaggaacactggtcgtgccaaaaagggccgcggccacgtgcagcctattcgctgcactaactgtgcccgatgcgtgcccaaggacaaggccattaaggaaattcgtcattcgaaccatagtggaggccgcagcagtaaggaccattcctgaggcgagcttctccgatgcctatgtccttcccaagctgtatgtaaggttacatcactgtgtgagttgcgcattacacagc

SEQ ID NO: 4923 - DNA, 100 bp, Homo sapiens
ggagagattcagaaagacccccctatcagggtgggagaggagggctttggaagagcagttagagaacaaaccaggggggttcttttggttgtttaatttt

SEQ ID NO: 4924 - DNA, 277 bp, Homo sapiens
aggtcgacactaggttttctctgtgtggttcagctacttttcatttgggtattacacagtcaaatttacattaatctattaaaaattggccattttatttaaaccatttcatggcaccggtggatccaggtgttgtctgaacatattccttggttcctttttgggtatttggcgtgacttaaaaggggttaatctcgggcagagcacatatgtgataaagagagagttgcgcgttaaaatatatttctgagcactgtagagcacaacacagagcgcg

SEQ ID NO: 4925 - DNA, 244 bp, Homo sapiens; identical to SEQ ID NO: 4922

SEQ ID NO: 4926 - DNA, 220 bp, Homo sapiens
ctcgtgccgaattcggcacgaggctgattaatatattctgtgaaagaactcttctcatctgaaggtaattctctactaatctttattaccacaaagatcccgtctttgtacacatgaaattagtaactgcattttcaacatgatgaaccatttgaaatttacattttctgtaaagagaatagtgcctgcacgttgtttcactacctctttcccttcaaac

SEQ ID NO: 4927 - DNA, 215 bp, Homo sapiens
ggagtatccttcatctaaatttaccaattaacattttgtttgcagaagttgcagttattgtgacaattcaaccctcaaatattttcagagtacaagggcacacttttacataaacacgatctaaggctcacattcaggagaatttaacactgacataatattattatctaacatgcaatctgtattcagagttctccaattgtcctcaacagtgt

SEQ ID NO: 4928 - DNA, 193 bp, Homo sapiens
attatgttgaattgtagtcctcataatttcttgttttatttcctttactgtaaatgagagaaaaagaaaagaaattattattaaagtaaaaaaaaaactcgagagtacttctagagcggccgcgggcccatcgattttccacccgggtggggtaccacggtaagtgtacccaattcgccctatagtgagyctt

SEQ ID NO: 4929 - DNA, 205 bp, Homo sapiens
agaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagatacagacgccacccagccctggggggaggcccacgcctgctggaccaa

SEQ ID NO: 4930 - DNA, 238 bp, Homo sapiens
cagaatcagaagttcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttaggagataccgctgcctctgtggggggcagaatcacataggcaaaagctttgaaaatcat

SEQ ID NO: 4931 - DNA, 238 bp, Homo sapiens
cggttgcgcagtgaaggctagaccccgtttactggaattgctctggcgatcgaggggtcctagtacaccgcaatcatgtctattatgtcctcataacggaggggccgtcatggccatgaaggggaagaactgtgtggccatcgctgcagacaggcgcttcgggatccaggcccagatggtgaccacggacttccagaagatctttcccatgggtgaccgcgctgtacatcggtctgtg

SEQ ID NO: 4932 - DNA, 170 bp, Homo sapiens
tcgccatgaaggtcgagctgtgcagttttagcgggtacaagatctaccccggacacgggaggcgctacgccaggaccccacgggaaggttttccagatttcttaatgtcgcaaatgcgcagatcggccttttcctcttcccaagcaggcaatccctcgcgccagcagtaa

SEQ ID NO: 4933 - DNA, 223 bp, Homo sapiens
gtaccgtggccagggtcagaaagtgcagaaggttatggtgcagcccatcaacctcatcttcagatacttacaaaatagatcgcggattcaggtgtggctctatgagcaagtgaatatgcggatagaaggctgtatcattgggtttgatgagtatattaactctgtattagatgatgcagaagagattcattctaaaacaaaggcaagagaacacctgggtcgg

SEQ ID NO: 4934 - DNA, 185 bp, Homo sapiens
agatggcggaggtgcaggtcctggtgcttgatggtcgaggccatctcctgggccgcctggcgccaatcgtggctaaacaggtactgctgggccggaaggtggtggtcgtacgctgtgaaggcatcaacatttctggcaatttctacagaaacaagttgaagtacctcgctttcctccgcaagcgg

SEQ ID NO: 4935 - DNA, 224 bp, Homo sapiens
cagagctgcctggggaatacagcatgaaagtgacaggagaaggatgtgtctacctccagacatccttgaaatacaatattctcccagaaaaggaagagttcccctttgctttaggagttcagactgttcctcaaacttgtgatgaacccaaagcccacaccagctttcaaatctccctaagtgtcagttacacagggagccgctctgtctccaacatggcgatc

SEQ ID NO: 4936 - DNA, 245 bp, Homo sapiens
ctgtccattggactgtaaggtttatgtaggcaatcttggaaacaatggcaacaagacggaattggaacgggcttttggctactatggaccactccgaagtgtgtttggttgctagaaacccacccggctttgcttttgttgaatttgaagatccccgagatgcagctgatgcagtccgagagctagatggaagaacactatgtggctgtccgtgtaagagtggaactgtcgaatggtgaaaaaag

SEQ ID NO: 4937 - DNA, 230 bp, Homo sapiens
tctgcctttgttggcctgatgtgctgctgtgatgctggtccttcatcttaggtgttcatgcagttctaacacagttggggttgggtcaatggtttcccaatttcaggatatttcgatgtcagaaataacgcgatcttaggaatgactaaacacagatatatgtgcagatttagagctgtcacaaactcggtaaaatgtactgttagataaaatgtttgttaatttagttg

SEQ ID NO: 4938 - DNA, 167 bp, Homo sapiens
gtccactctgcacttggtcctgcgcttgagggggggtgtctaagtttccccttttaaggtttcaacaaatttcattgcactttcctttcaataaagttgttgcattcccaaaaaaaaaaaaaaaaaaaaaacctggggatacttttagggggcccggggccccatgg

SEQ ID NO: 4939 - DNA, 140 bp, Homo sapiens
gagacgtggcggcggttgggccggtgatacccgggcgctttatagtcacgccggcttcttcgtacacctactcctcctcctgctcctctcctggagcagaggaggttgtggcggtggctggagaaagcggcggcggagga

SEQ ID NO: 4940 - DNA, 249 bp, Homo sapiens
ggagtggtcagcgggtcacagctgcccccactctataaagcagggctaattgtgtaccctttgcaagaaattgcttttggtctcctacccaaatactcacaagggtcttatcagacggccgtcttaaagtccagcatgctcagggaccctgtgtaggatctcgtttgtgtgtgagtgggctgctctgaggtctccactcgggctgtccatttagccatgtgccatctctgtaagtcagaggtgtttgac

SEQ ID NO: 4941 - DNA, 253 bp, Homo sapiens
gaatgccgtacttggaaagaaagtccctctgcaattgcatagttcagaagccctcacttttcagccccgaggatgggtttgttcatcttccaccacctttgaggacctggtgtcccaaaagactttgcctatcccagcaaaacacacacacacacacacacacacacatataagagacacacaagggcgtctgcacagagagagagagagatctcagattgccacgcagagtttactatcacacagactcaga

SEQ ID NO: 4942 - DNA, 164 bp, Homo sapiens
gcttcctgaaaacttctttttttacaaaggaaattagatgtacatgtataattcagtgtgctttgtctttctccagattaatatcggttacactgctgatgtttgtaaattaaacagatatttacttcataaaaaaaaaaaaaaaaaaacctcggggggtactt

SEQ ID NO: 4943 - DNA, 282 bp, Homo sapiens
gctgcaggtcgacactagtggatcaaagaattcggcacgagctcgtgccgaattcggcacgagggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacct

SEQ ID NO: 4944 - DNA, 279 bp, Homo sapiens
cttttgaaaggtttattcacattgtagaacagcaaatgacatttttacagtatttttttgtaaagcaaactattttgtgccttgaatttggtatatgtgtattagtgaaacattgtaaaggtgaacttctacctctgtatctaaatgtataccatccacttgtaaatgactataaactattatgtgattgcccttttttttaagagtgtcttgtttaaatagtggccaatgtttaaggctgttaaaataagccaactcttactaatttgggggtgtata

SEQ ID NO: 4945 - DNA, 295 bp, Homo sapiens
cgcggcccgggttcgtttcccggtcagggaaccactggcagggagagacattcttgactcctctcttccctggtgtgttgtgatccagggaatgaaaagaaatttgaccctcgattggttctctccttggacttaaggaatcttacctctttcttccacaaagttctcccaggcaaggagcagctgcccattctgagcccagggcagcctcttcaaccattattggtctaacctcgcttgtcaggaaaccaagcccacccttccacattgggcctggctgctctattctgtacca

SEQ ID NO: 4946 - DNA, 151 bp, Homo sapiens
ccatcaccctacgtcccctcccccttcgacttgtcctcatcactgcatattgagctttcactttggcaaagtcttcaccttccagtaccatcacctttggggcttaaggtttcaagatatttaatttgtgggaggacacacacactttagk

SEQ ID NO: 4947 - DNA, 125 bp, Homo sapiens
ttaagatagatcgccatcatgaacgacaacctaactatccccactaggaagttcatgaccaaccgactacttcagagaggaacaaatggtcaatgtatgtcccctcacccccgggaaggcgcaca

SEQ ID NO: 4948 - DNA, 206 bp, Homo sapiens
ctcgtgccaattcggcacgagctttgtgcttgtctcaatcttatggctgtcaacaactgtgggcttgctggtgggtgccctcctttctccccaatatatacgtctttggtagactgttggtgcatgctacaaaaagagggggaatatgagccgcgggaatagcttatttttcccggagtgccccttggggagacttattgttgtga

SEQ ID NO: 4949 - DNA, 182 bp, Homo sapiens
cggtggctttccagaatttatgccagttgcaccagcatgcagaatatttgtaatgcatttcaaagtggatataatggcaccctttgtcagaatcacaaagctcactgcggcacttctacaagaggacacttagggaaatcttgccctatgtaacctagtcaaccccaagcaaaaagaatgac

SEQ ID NO: 4950 - DNA, 212 bp, Homo sapiens
gatccagctcgagtcaacgtccctgtcattggttgccattctgggaagaccatcattcccctgatctctcagtgcacccccaaggtggacttttcccaggaccagctgtacagacactcactggggcggatccagggagggccgccacggaggtgggtcaagggctaaagccggagcagggctcttccacccctcttccatggcgtatgccg

SEQ ID NO: 4951 - DNA, 100 bp, Homo sapiens
gaaaaacttaattggcaaggttggaattttggaggcaagaggcaaatttttttttggttaaggttattttggcacactaattggagagatctctttaagc

SEQ ID NO: 4952 - DNA, 110 bp, Homo sapiens
aaaaaccctaatatttgaatctatttatgtctttcaatttaaattcacttcagttttggttattgtaatatattaccttttaccatggtattatcaacttataattttaa

SEQ ID NO: 4953 - DNA, 140 bp, Homo sapiens
agaaggagaaggtggaggagaaggcaagccggaaagagcgaaagaaagaagtggttgaggaggaagagaaccgggcttaggaaggaggaggaggaacctcccaagattgaaagaaggagattaaggggaaggagaagatt

SEQ ID NO: 4954 - DNA, 200 bp, Homo sapiens
attgaccttggggtccatgtggatggcttcatcgctaatgtagctcacacttttgttggtgatgtagctcaggggaccaagtaacaaggagggaagcaggtgttattaaggcagctcaactttgtgctgaagctgccctacggctggtcaaacctggaaatcagagacacacacagtgacagagaggcttgagacacaga

SEQ ID NO: 4955 - DNA, 235 bp, Homo sapiens
gaagatggcggacattcagactgagcgtgcctaccaaaagcagccgaccatctttcaaaacaagaagagggtcctgcttggagaaacttgcaaggagaagcttccgcggtactacaaggacatcggtcttggcttcaagacacccaaggaggctattgagggcacctacatttacaagagattgccctctcactctgtaatgttgtacactcgagggcggaatcctctctctgcg

SEQ ID NO: 4956 - DNA, 265 bp, Homo sapiens
gaataatccataagtatctcccacagggacataatgatttaaattaaaaaggccttagaaagccatttcatttaggaaggcaaaatttttcatttttgaagtagtaataaaaagatcagataccctatggatgattttttttctttgaatctttctagtttcagatctccattaattcttttaagtgtataggtttcatttttttcactatatatattctctttgggggaattatagtgaagtgagtgaagatataagagtattt

SEQ ID NO: 4957 - DNA, 250 bp, Homo sapiens
tctcagccaattgtcccaaccattttgagggtcactaccagtacaagagcatccctgtggaggacaaccacaaggcagacatcagctcctggttcaacgaggccattgacttcataggtaaatggaatggatgccttgggcttttctgcctttctcttctcattttagccactaaggcccaaactcttttggcaagagcttcaaggtttctgagcctcttcccacaattcagtatcagacttgcgttggg

SEQ ID NO: 4958 - DNA, 316 bp, Homo sapiens
ccacagggggacactttgcccataatatagctcctaacagaggtgtgtcttgtacttgcagtgactatttctttctctattctggacatcaccttggcctttattttagaggcaaacgcacagaggaacccagggtaagtctgagtcattcttcactcaaggacttcagtaataactccaaagatagctgacagtggggaagactggaattttgagtgctgagttattctcctatcccaggcacctcacccccttagcccaatcaaagagccagggcactccccacccagacttcagagtgtagtccgaatacacc

SEQ ID NO: 4959 - DNA, 317 bp, Homo sapiens
gcagccttcatgaaactggacacaccagctacttcagatcccctctctggtaagggcagaggctggagtgcccagggttgtcaaacatactacacatgtactgccattcccgccttgattcagtggcagacatcactaattaggctctttcccttctgaacccttcagcacactctagtgtcatttaaataatacttcattttggatgtcagataggagctatttgcaccccagagaaattgatgacgcctgaaagtgtaaattctgaggagctctttcaagatacagtagggtgtacaacctgtatcctttagagt

SEQ ID NO: 4960 - DNA, 315 bp, Homo sapiens
cacaaacgctgcccagagttcttctacccagagctggtgaagaatatccgagggaagaagaaagatctgtcagatcctttcaatgacgaagaaaaggaaaggcataaagtagaggcccttgcccgaaaatttgaagaaaaatacggtggaaagaaacgtagaaaagaccgaatacaggacttgatcgatatggggtattgttattatgaatccgactccttcatcgataactctgaggcgtattatgagcttgttccgcttctttgactacgagtatggaggagtttacattaactctgggaacccgcagtttag

SEQ ID NO: 4961 - DNA, 180 bp, Homo sapiens
taacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgag

SEQ ID NO: 4962 - DNA, 316 bp, Homo sapiens
gatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctcgtgaagaattgcatcgtgctcatcgac

SEQ ID NO: 4963 - DNA, 316 bp, Homo sapiens
gcgaggcgctggaacagtccgggagattctcgctctgctgctttagcttcggagtgtttggcgacggggcagcgcgagatgtggaggctcatgtcgaggtttaatgcattcaaaaggactaataccatactgcaccatttgagaatgtccaagcacacagatgcagcagaagaggtgctattggaaaaaaaaggttgcgcgggagtcataacactaaacagaccaaagttcctcaatgcactgactcttaatatgattcggcagatttatccacagctaaagaagttggaacaagatcctgaaactttcctgatca

SEQ ID NO: 4964 - DNA, 313 bp, Homo sapiens
tacatcgacaagacgatccgggtaaagttccagggaggccgcgaagcagtggaatcctgaagggcttcgacccactcctcaaccttgtgctggacggcaccattgagtacatgcgagaccctgacgaccagtacaagctcacggaggacacccggcagctgggcctcgtggtgtgccggggcacgtccgtggtgctaatctgcccgcaggacggcatggaggccatccccaaccccttcatccagcagcaggacgcctagcctggccggggcgcggggggtgcagggcaggcccagcagctctggtttccccc

SEQ ID NO: 4965 - DNA, 292 bp, Homo sapiens
atgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggcccaaatcaagagtgagatgtagagaggtgtaaaatagagaaagttgagtttgtgaatc

SEQ ID NO: 4966 - DNA, 279 bp, Homo sapiens
ctcgcctcggcctcccaaagtgctgggattgcaggcgtgagcacccgctcccggcaagggaggctttcttaatggcgccaggaaaagtccgagggccaacgcccattggactaacttgggtcatgtgtctgtctctgaagtagtcactgggtctgacccttcctggctttgacgacatactcctgtttagagctgaaagtggaaagtctgtccagaaaacgggaggccgaccaggcctggcaaggaggtgccatgcacttctctcctcatgtcccaggg

SEQ ID NO: 4967 - DNA, 175 bp, Homo sapiens
gtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggagc

SEQ ID NO: 4968 - DNA, 283 bp, Homo sapiens
gaaagagttagataccttccaaaagagaaaaggaatgtaatgggaggagagataggcaacagaaaacaagcatctgtcccttatggagaaaaatgtatttttaacagatactagagaatatagaagttgctatatcaacaaaaaatttttatttgctcaaacaggtggataagccaatgtgtatttactgaataaatgagtatgtgctagtggagatcaattagtgagtgtaataagtgtaacacgtaaatggataaactcagtaggggacacattatttctt

SEQ ID NO: 4969 - DNA, 260 bp, Homo sapiens
tgtggtggtcgcaccagctctctgctctcccagcgcaggccgccgccctgcccctccagcttcccggaccatggccaacctggagcgcaccttcatcgccatcaagccggacgggtgcagcgcggccttgttggcgagatcatcaagcgcttcgagcagaagggatttcgcctcgtggccatgaagttcctccgcggcctctgaagagcacctctaagcagcactacatttacctctaaagaccgcccactctttcctct

SEQ ID NO: 4970 - DNA, 100 bp, Homo sapiens
atattgtagacatagtaaagttttttggggatatgcgccggaatagcatgtatatagaccccattttaggcttggcgaaatgagttaagcaggttgcaat

SEQ ID NO: 4971 - DNA, 237 bp, Homo sapiens
gacactagtggatccaaagaattcggcacgagcctgacaggccttccctcctctcaaacctgggcagatggggggcctctctgggagaggggagggggccctgttcacttgtaccagagtctctcttttacacttaacctcctcctgcagtcagactgaaatataaaaaaggttggtggtggtggtgaagggcctggtggagatgtgggacccgatctcctatttttaatttcctgt

SEQ ID NO: 4972 - DNA, 288 bp, Homo sapiens
gagccttttgctcatcccaaattatgaatcttaaaaggtgcatgattaaggaggaaaaaaaaattatgtcctctgcctgtgtgaacttcctatgtgagggggcatggaggccagattgtttaaggagattttgtaaagcagggtctgaccactcagtgactggacaggcaacttacttttccctgaggctgggagttcccccttcatgctttcactgtggtacttcactagtagctcaggcagatcttttttaatatgcattgccacctttgaatttgtaaggcacgc

SEQ ID NO: 4973 - DNA, 200 bp, Homo sapiens
gaacgtcttgaggttatcaataagcctcctagtccagacggccatgggtcatttcacagaggaggacaaggctactatcacaagcctgttgggcaaggtgaatgttggaggatgcttgaagagagaacccttggaaggctcctggtgtctacccagggacccaagaggtctttgacaagctttgggcaacccgtcccctg

SEQ ID NO: 4974 - DNA, 291 bp, Homo sapiens
ctcgtgccgcacagatggaagagtgctgtcctgtgctactcaccctcggacagacagagttggcccagttccgcggtgaaaggaaggttcaagtctcagctgccagatctcagttgccctcacagctacagtccggggagaaacagcgtggcttggaagcaaccccgcaaagccaaggctctggcagtgctctggcgctacagaccccgtgcacgggagcccagctccgcagggtggcgcgcctctgctctagcttttccgccctcttagagttttgcgctgcgggtctcg

SEQ ID NO: 4975 - DNA, 165 bp, Homo sapiens
taaccttgaatctagtcacaataataatatcctatgtattgcaaaccagagatctcagtcagatcccctaaggggactggagaatacacactatgattttgactttcttgctctttctccctcttgcttttttttctctttctcccttcagagttagcccctcac

SEQ ID NO: 4976 - DNA, 150 bp, Homo sapiens
accagatccaggcagccttccgggagccacggcttcttgtggttactgaccccagggctgaccaccagcctctcacggagggatcttattggtaaacctacctaccatttcggtttgtgtacaaaaggttctcctcttgcgctatgtgga

SEQ ID NO: 4977 - DNA, 166 bp, Homo sapiens
gaaagaagcagtctgatgtcatgcgctttcttctgagggtccgctgctggcagtacccccaactctcttctctccacaaggcttcccggccccaacccggcctataaaaagcgcgccgctctgggtctacaaggccaagcaaggtttacgtttatatatagggatt

SEQ ID NO: 4978 - DNA, 181 bp, Homo sapiens
gaaaagctctgcattactgtgcaaataacattcaatttctgttttgctaaaagaaattgggaagctggacaacccgattacttgggtcattgccattggccaaggagaggccttgtcttgggttaattttttgttgggcagtggaacagatttccatttgtgaaggacgtcaataacttca

SEQ ID NO: 4979 - DNA, 62 bp, Homo sapiens
ggtcgacactagtggatccaaagaattcggcacgagtgggaggctgaggtgggtggattacc

SEQ ID NO: 4980 - DNA, 228 bp, Homo sapiens
gggccatggaaattccttctatccctcttaacttagtgtcaacaaaaagtcttagtgcaggcaaacccacttgactttattttgggggaaaaggccatggggaggaccctttagattgcacttccaaactagaaaccaaacgggggtgcctccaaggggggtcgttctcctttgtctttagaaaaagggaatcgagaagaaccctttagaatgaacctccgaactaca

SEQ ID NO: 4981 - DNA, 117 bp, Homo sapiens
ctgcaggtaatcctggggaacctggcttgagagggccgtagggaagtcgggggcttcctggagttggaggacaaagaggaaccacttggaccccgggttttcaaggaagaccagggt

SEQ ID NO: 4982 - DNA, 116 bp, Homo sapiens
aagctgtgggcaggcaagcccttcggtcaccgtttggctacacagaccccttccctggtgtcagctcaggcactttgaggtccccgaccaacaatttcaggggttcctgcttaagt

SEQ ID NO: 4983 - DNA, 175 bp, Homo sapiens
ggcgccatcatgggagtggacatccgccataacaaggaccgaaaagttcggcgcaaggagcccaagagccaagatatctacctgaggctttttggcaaggtatataaggttctttggcgagaggacccaatctcacaaattaacccaggttgtgttgaggaggttgtttatgagy

SEQ ID NO: 4984 - DNA, 216 bp, Homo sapiens
cagaggtgtgcagagccacaacaggtgctgagggagactctaatgcatgattcaggttaaacccagcaggaagaaaggactctcccaggtaactctccagtatatagcgctcgctattataggtgggacttacatagaacacaaaggccttccgagggcacagagccaatatatgtcmaaatattttgtatgtaggagagactatattatgtgata

SEQ ID NO: 4985 - DNA, 116 bp, Homo sapiens
ggaaaatcacaattacaccactttagaccctatgtgtaggaagggtaaaacttaaccttgtgtgtttaggagtgtattgaataacctctataacgttgaggaaagctgtttacttg

SEQ ID NO: 4986 - DNA, 170 bp, Homo sapiens
ttaacattgggtcttcccaagactttatagctttatagtgcctattatacttcaggttactttacaaactcattttataaccttacggcacaaaattggaaaataggaaagtagggtttttggcttcaacacatttttaggaaacatttgcattgactgtaccacggggt

SEQ ID NO: 4987 - DNA, 140 bp, Homo sapiens
tttcagagtcagtcattggttatacatgtgtagttccacagcacataagctaggaggaggagatattctaggggcactaccatctgttttcaacaatgaattgccacaaaatagggacttccacaacaatttcatattcc

SEQ ID NO: 4988 - DNA, 170 bp, Homo sapiens
cagcaatgatattaatcacctctttggggcttccccacaccaaccctcctagagctttgttttgtccttcttccaaaaaaccaggaaaccaaaaccatttcttcaaaaatgcaggattctaaggtggattagagagtggggtagaggcaaggagagagagatggtagtcg

SEQ ID NO: 4989 - DNA, 122 bp, Homo sapiens
ggagtgcaaaggaggcgacctgcaacagaggagtcccggtcaccagcaaccatgacggaccagcaggctgaggccaggtcctaacctcagccgaggagatgatccgctgaagttcaaggcct

SEQ ID NO: 4990 - DNA, 155 bp, Homo sapiens
cagacacctggcttttcaatctatgccacctcccctatgctcttcaacttgtaggggcagattcttcctttcactcccttccttttttgccttttcattgttatactctaaaaaaatttcaaaaccaaaggtgcaaacaatactgattggtttca

SEQ ID NO: 4991 - DNA, 108 bp, Homo sapiens
aagcaagtttgcatttaataaattatatatgcatcacaaaatttatcttccatagagagagatatattatgtacatagaggtgcacatttttattatgtaccatagaa

SEQ ID NO: 4992 - DNA, 117 bp, Homo sapiens
cgatattttcatgaaccatcacctgcaggaaacaggtttcacaaaagaagcctacaagaagtacatcaaagattacatgaaattccattcaaaggggaacttgcaggaccagagccc

SEQ ID NO: 4993 - DNA, 175 bp, Homo sapiens
tttatgggctgggaatgtattttgaccgttgcaacatgccatagagatataagggaattagtcctatcattgtcattgccatgtgaatcaattggaggggcaaggctccagtggcaagccctgcaagagttcaaggccaagggaaggagcaggtttcaaggggcaaatttggggt

SEQ ID NO: 4994 - DNA, 160 bp, Homo sapiens
cgggcgcgacccttcgaatgtaatatatgtttggagactgctcgggaagctgtggtcagtgtgtgtggccacctgtactgttggccatgtcttcatcgtggctggggacacggccagaccggcaagggtgtcccagtatttaaagctggggtccgcaaga

SEQ ID NO: 4995 - DNA, 213 bp, Homo sapiens
ttgcctgatgtgtgtatcatcggtgggatgacagaacaaacatatttatgatcatgaataatgtgctttgtaaaaagatttcaaggttattagggagcatactctgttttttaatcatgtataatattccatgatacttttatagaacaattcttgcttcagggaagtctaggagcaatatttctttcaaataaaaggtgtttaaacttttwa

SEQ ID NO: 4996 - DNA, 325 bp, Homo sapiens
atcgtagtacaggacttgtgacctcattattataacacaactagaacactgagctcttgtgcttcagatgttgccttgtgtgtaacaaaaaataacaataggaaaaggttattttgattccaactcactaatgtttcttttggagaggttacaaggttttgggtacctaaaggaaggcaatcaacctctatttccatacaacctcggtgtgaattcaaagttctaaaaggggaaatcaaaggaaaggctctctttaaggtatggtcatatttcgagttatatggggttcacggtgaattcaccaacacactcctatttcagagat

SEQ ID NO: 4997 - DNA, 326 bp, Homo sapiens
ccgaatacgagttcttttggggctcccgggccagccggggaatcaccaagatgcaaattccgggggttcctgggccagggtttttaaagaaagaccccccaggcctggccctccccgatacagagaagctctggaggaggccagagctctcgcgggaggctaatcccactgcccactaccctcgcagcagtgtctctgaggactagcaaagtctggaggcagatgaatggttcctgaccctcaccaggcctgttgaagggtggggggtgggcattatagtatttcaggatttacagtccagtattcacgtgtaactttaaagtttt

SEQ ID NO: 4998 - DNA, 323 bp, Homo sapiens
ggaccaccagggcctcgaggtaacagaggtgaaagaggatcttagggcttcccaaggccacccagggaaactaggccctcctggacctcctggtgcccctggtccttcctgtggtggttttggagccgctgccattgctgggattggaggtgaaaaagctggcggttttgccccgtattatggagatgaaccactggatttcacaatcaacaccgatgagattatgacttcactcaagtctgttaatggacaaatagaaagcctcattagtcctgatggttctcgtaaaaaccccgctagaaactccagagacctgaaattct

SEQ ID NO: 4999 - DNA, 326 bp, Homo sapiens
tcaaagtatactgtgatttctctactggcggaacctgtatccggggccaaacctaaaaaaatcccagcaaggacctggtttaggagctccaaggaaaggaaacaggtttggttaggagaaactatcattgctggcagccagtttgaatataaatgtagaaggagtgcactctccacggaaatggctacccaacttgccttcatgcgcctgctggccaaactatgcctctcagaacatcacctaccactgcaagagcagcattgacatacatggatgaggagactggcaacctgaaaaagggcttgtcattctacagggctctaatc

SEQ ID NO: 5000 - DNA, 332 bp, Homo sapiens
cagcaccatggcggttggcaagaacaagcggcttacggaaggccgcaaaaagggggccaaggaggaaagtggttaatccattttttaagaaagattggaataatgtaaaagcacctcctatgttccaatataagaaatattggaaagacggctcgtcaccaggacccaaggacccaaaaatggcatctgatggtctcaagggtcgctgtgttagaagtgggcctgtgctgatttgcagacgttatggaggttccatttaggaatttcatgcctaattacttaagttgtcaggggaaaaactgtcctcaactaactctccatggcatgcgtct

SEQ ID NO: 5001 - DNA, 210 bp, Homo sapiens
caagaacacacacatatacacgaatagacatcaaactcaatgctttatttgtaaaattaggtttttttttaattcctcctgccaaatgaatgtgcaaaaccttttactggttgcaatggaaatcggccaagttttatatcctctaaatctcaatgttcctcaaagctctggaataaatcaatataggaagttaccctctctgcgccacat

SEQ ID NO: 5002 - DNA, 254 bp, Homo sapiens
ttgtatttgagagaaattataagagccatcacctccagctacaggtcaatcccgttccaatcaagcttgttcttacttacttaatgacattaaagaatgccttcattaccaaggcacaggagcagcagatagagctgttggaaatccaagagcactctgacatcaggcagattgacacagccaggagcagcatatttattatgtggaactgagaaacaggagaaaagctttttccacagcattaaaaacagaat

SEQ ID NO: 5003 - DNA, 192 bp, Homo sapiens
tcttcacaaaggatttggacaaggccaattacctgtcccaggccctccaggcggggcactgtgttgggtcaacctgctattatgtgtttggaggcccaggtcaaccctttggtggctaccagatgttcggggaagtggcccgcgaagtttgggccgagtaccgggctgcagggcattaccatgtaggtgaaa

SEQ ID NO: 5004 - DNA, 178 bp, Homo sapiens
ggttcctgcccagaaagccacaggccagaaagcagcgcctgctccaaaaagctcagaaggggtcaaaaagcttccagccccagaaagcaccttcttccaaaggccatcttggccaagaaaggcattaagttggccattcattaaaaggttattaagggttccttttttgaccctcttg

SEQ ID NO: 5005 - DNA, 245 bp, Homo sapiens
agaatcttaggagagagcgaaattcgcgatgcaatgatggcaaaggccgagtacctcttcccggataggtgacaaagagggagcctcttacaagccttttcgcaaggcaatattaccaaaactttggccctgggtaacccgattggatatttaattcttattctcctagggattgggcttatttatatatgggataaggatctcatcacacgagacacagaaagggccaaacgcttattagagga

SEQ ID NO: 5006 - DNA, 151 bp, Homo sapiens
aagtctggtgatgctgccattgttgatatggttcctggcaagcccattgtgttgttgagagcttctcagactattccaccttttgggtcgcttttctggtccgtgatatttaggcaagacaattgccgggtgggtgttcaacaaatcgatt

SEQ ID NO: 5007 - DNA, 125 bp, Homo sapiens
ccatttgttagcatcgtcacacgattgtgaattttttattgtcaaaagaagcacaaaactttgcaatacctatttttttaggccaggcaaaaaaaaaggaatcttaatggtattaaaaatggtgt

SEQ ID NO: 5008 - DNA, 103 bp, Homo sapiens
gggggctaggcatgagatcacttgacccaggaggtggaggttcagttaaccaaggtcaaacactgcacttccagccttggcgacaaaattagagtcttgcttc

SEQ ID NO: 5009 - DNA, 140 bp, Homo sapiens
tctacattacccatctcctcttttgcctctgagaagagtatatatgcttctgtaccccactggggggttggggtaatattctgtggtcctcaggccctgtacctttaataaatttgtatgccttttctcttaaaaaaaaa

SEQ ID NO: 5010 - DNA, 235 bp, Homo sapiens
gcaaggagagccaaagctaagacccccgaaaccagacgagctacctaagaacagctaaaagagcacacccgtctatgtagcaaaatagtgggaggatttataggtagaggcgacaaacctaccgagcctggtggatagctggttgtccaagatagaatcttagttcaactttaaatttgcccacagaaccctctaaatccccttgtaaatttaactgttagtccaaagagggaca

SEQ ID NO: 5011 - DNA, 140 bp, Homo sapiens
ctcgtgtaacggcggcggtgtcggcagctgctgtagcgaagagagtttggcgcgatgtctcacaccatttttgctgggtacagcctaccaaggagggccaggaagggcaggaacttatgcttgactacggaatctgtgaa

SEQ ID NO: 5012 - DNA, 215 bp, Homo sapiens
ggttcggcgagagcatgacccatggattccagttcgagtatggcggccagggctccgaccctgccgatgtggccatccagctgaccttcctgcgcctgatgtccaccgaggcctcccagaacatcacctaccacttgcaagaacagcgtggcctacatggaccagcagactggcaacctcaaggaaggccctgctcctcccagggctccaacggg

SEQ ID NO: 5013 - DNA, 230 bp, Homo sapiens
ctcgtgccgaattcggcacgaggcgtggtctacgccgagtgacagagacgctcaggctgtgttctcaggatgaccgagtgggagacagcagcaccagcggtggcagagaccccagacatcaagctctttgggaagtggagcacccatgatgtccagatcaatgacatttccctgcaggattacattgcagtgtaaggggaggtatgccaagtacctccctcacagtgcag

SEQ ID NO: 5014 - DNA, 210 bp, Homo sapiens
tatcaataagctcctagtccagacgccatgggtcatttcacagaggaggacaaggctactatcacaagcctttggggcaaggtgaatttggaagatgctggaggagaaaccctgggaaggctcctggttgtctacccatggacccagaggttttttgacagctttggcaacctgtcctctgtcctctgtccataatgggcaaccccaaag

SEQ ID NO: 5015 - DNA, 206 bp, Homo sapiens
ctttctaactcattctatgcgtccaacattactctagacattaccctattacccaaataaagatattataagaaaggaaaactacggaccaatatctctcatgaacatgctccagaaatcctcaacaaaattattagcaaattgcagttcagcaatgtttttaaaagagtttacatgtttgctgccagtggggtttttttccaggt

SEQ ID NO: 5016 - DNA, 285 bp, Homo sapiens
tctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcacctccccttttttctcctattaatcaggagacactccaaggttaatgggatggtcggatctcacaggctgagacctcgttcacctccaggcatttcatgaaaaagctgcttctaattaatcatacaa

SEQ ID NO: 5017 - DNA, 288 bp, Homo sapiens
ctcgtgccgaattcggcacgagtctgcgtaggatttaggtagagaatgctcttagagagccttcaaaggcctgggagcatcctgaggtatgctgagctgaggacccaaaggctcattccaagcccagctgatgggccaccccattgaatgggattggctcagaaatggtgtgggagaagctgggcgtggtagctcatgcctgtaattccatcactttgagaggccaaagcaggaggatcactcaagccctgcaagtttgagaccagcctgggcaacatagtgagaccg

SEQ ID NO: 5018 - DNA, 288 bp, Homo sapiens
ctcggctttaagatgtttgctgtgggtgtgggcaatgccgtggaggatgagctgagggaaatagcctcagagcctgtggcagagcactacttctacacggctgacttcaagaccatcaaccagataggcaagacgttgcagaggaagatctgtgtggaggaagacccgtgtgcctgcgagtccctggtgaaattccacgccaaagtggaggggctgctgcagtccctgaccaggaaactggaagctgtgagtaagcggctggccatcctggagaacacagttgtctaa

SEQ ID NO: 5019 - DNA, 288 bp, Homo sapiens
aaaagctggacagtaaggtgaacatcattccaataattgcaaaagctgacaccattgccaagaatgaactgcacaaattcaggagtaagatcatgagtgaactggtcagcattggggtccagatatatcagtttcccactgatgaggagacggtggcagagattaacgcaacactgagtgtccatctcccatttgcagtggttggcagcaccgaagaggtgaagattggcaacacgatggcacaggccaggcagtacccctggggtgtggtgcaggttgagattgaaa

SEQ ID NO: 5020 - DNA, 286 bp, Homo sapiens
ctcgtgccaattcggcacgagtagaggaagcatatgagctataaagccccaaggcttctttccagaaaaatgaatagtccagattgacagatgcacatgattcaaataggtgagtagtaggaaatagaattatgagaagggcagagttcattaatgctaggctaaaacatttatattttatttagttgacaggaaggagtgactgacaaagtttttgggcaggggagacacatggatcacagctatgctgtggagaaattacacgctgatgggttggaggagggga

SEQ ID NO: 5021 - DNA, 289 bp, Homo sapiens
ccacaactgtcttaactaaatgtgctgtatttttctttaaaagttaagagttctatttggtgttttcaggaatatacgtgaaaagacatgccatgttttggtaaataccatcagagttgtgtaaaggcgtgtactaggtgccaatctcaatttgtggagataatctccatttacccctcctaaaactacactcagtatatacactctcccataaggtgtgtgcagtaaaaatgttatattactccaccactggcaagggcacagcacagcagccttatttgagagagcg

SEQ ID NO: 5022 - DNA, 290 bp, Homo sapiens
atttttactactgttaatttaaataaaatttgttctgtggataaaatgaggttggcagtgaagaaaattaaaaacagcctcattcatgtaactgggttaagtaaaaatacattttcactatgtgttcataaactctttaatgaagctgtttgtctttcagttcaaatataagtgatgtttaggctttatttctgttaatagggctttttaccattgattaaatgagggattgtatctctctgaagagatttatattctgtaaataaaaattcgttgtaacactaaagttg

SEQ ID NO: 5023 - DNA, 265 bp, Homo sapiens
ggatctacagaataagcacaatcccagtcaaaatcccagaagactcttttttttgtataaattgccaagctggttctaaaatacagaaatgaaaagacctagaggattaaaactattttgaaaaaaaaagaccacatttggaggacttactctatgtgctctcagggtttactataaagctacagtaattaagacagtgtagtttccatatagggatagacatgtatcactatatagacacagagtccacaaataagcccacatg

SEQ ID NO: 5024 - DNA, 283 bp, Homo sapiens
cgggaggccaaaatgaagtttaatccctttgtgacttccgaccgaagaagaatcgcaaaaggcatttcaatgcaccttcccacattcgaaggaagattatgtcttccctctttccaaagagctgagacagaagtacaacgtgcgatccatgcccatccgaaagatgatgaggttcaggttgtacgtggacactataaggtcagcaaattggcacagtagtccaggtttacaggaagatatatgttatctacattgaacggtgcagcgggaaaaggctaatggc

SEQ ID NO: 5025 - DNA, 288 bp, Homo sapiens
ggcccctcccgcctgacctggggcaagtgctttcaactctctgaacttcggttcctcatctgccagttggcagacgctcagcaaatcttcctagactcacggggcgaattgtacagttgggtaaatcgaggcccagagatggcaaaaggaccgtccaaggtcgtacagccacccggaattacaattcttttctgccgggtacacacgtgtacatccacgtgttacctaagagagctttccagcctgtgcttaggagaactgccctacatcatctgcaagtaggacgcg

SEQ ID NO: 5026 - DNA, 210 bp, Homo sapiens
gtgccgaattcggcacgaggatgaggccataccgaacgggggagcccccggcagtccttggggggcctggaggagatctttggctcacctcgactcccttccgggggggacatcgaggccagattgagggcggcccaaccaggggaccccagggacaagccctttcttggcaccttcccaaggacctttaggactttttcccaccccagg

SEQ ID NO: 5027 - DNA, 319 bp, Homo sapiens
tgtcagattgcttatgccgtatagaggggatatgatagtctgcgcagtattgcacacgaactgccacaatatggtgtgagggttggcctcacacattatgctgcagcatattgtactcgcctgctgctggcccgcagctttctcactaggtttggcatgaacagatctatgaaggccaagtggaggtgactggtgatgaatacaatttggaagacattaatggttaagccaggtgcctcacctcctatttggatgcaggccttccagaacctccccctggcaataaagttttttggtccctcaggggcctttggtgggg

SEQ ID NO: 5028 - DNA, 217 bp, Homo sapiens
atggattggagtttgcagtgactctggggccagcaccaggggacgacgttcaaccttagcctgaagggacccgctcccagctcagaggccgtctctgactctctcgtgcgtattttggaccctgatttacactctcctacccttgggaggttctggcgtttggcacagagccccctctccctgtttggagctcagtgctagaccaggccccttgccc

SEQ ID NO: 5029 - DNA, 178 bp, Homo sapiens
ggatggacagtgctgtccgcacgccggctcagctcgccgctgcctgcactccagccgccatagagtcagctcggcgcactctaaccgcatgtccagaggcggccggatgtggaggtgagcttgtggacagctcgggctctgaaattgggaaagagatatcaaaggacaccccatctct

SEQ ID NO: 5030 - DNA, 170 bp, Homo sapiens
ctcgccgggcgcagactggctctggctccttggaaggtctttcctgattatgacctctatatagagtatataggtttgtcctttttcaaggaggtctttgctgtacaatcgatgtatataacttttataaggtacatttcatataccgttttaacactgtgtaaaaaaaa

SEQ ID NO: 5031 - DNA, 224 bp, Homo sapiens
agaggctgtggagaggctggctggtacccagctgcgtgtgctagaggattactctgtcccctgtgcacatgctgcccatgtgccaggcctcaggatcctaggcccaggcatcatggtctcagcctccattggatcaccggtctgaccttctggcgtctgggcgcatggtgaccccacctccatgattagcactgtgtcccatgtccctcatgtggctcaaaggg

SEQ ID NO: 5032 - DNA, 223 bp, Homo sapiens
ctcagtaacagaatcctggtggtgttaattgggtgttttgcctggagattcagattccttctatacctccgattctgcccagaggagggggggattcaccagtgttaacaaaattagaggattgttttgctgtttaagactgattatttgaccactgcagcattactagccaccagtgttaaaggccagatgaggggaaccattttgctttagcagtaatccc

SEQ ID NO: 5033 - DNA, 166 bp, Homo sapiens
gcaagatggtcacagcagctgtacttgagcaccggaaattggccagggttcttgcttttgtcggtgtctgttcaaaccggcacgtcttgatccggaaatattggcctcaatatgtgccgcaagtgtttccgtaagtccgcgagggatatcggtttaataagtcgct

SEQ ID NO: 5034 - DNA, 242 bp, Homo sapiens
gacgtctgaggttatcaataagctcctagtccagacgccatggtcattcacagaggaggacaaggctattatcacaagcctgtggggcacggtgattgtggaggatgctggaggagaaaccctgggaagggttcctggttgtttacccatggacccagaggttctttgacagytttggcaacctgtcctctgcctctgccatcatgggcaaccccaaagtcaaggctacatggcaggagggt

SEQ ID NO: 5035 - DNA, 215 bp, Homo sapiens
gatgattataccgtcagagtgattgatgtgttctatccacagcaggcaggtcagtgtggagcagtgaccagtgtccagctaaatgttggatatttgagcagcaggaggccgggatggttttggtggtatcacagtcacctgcttggtggtggcttctggttggatacacactcagcagactttgaggcctgtcggagagacctgtgcagtggttk

SEQ ID NO: 5036 - DNA, 157 bp, Homo sapiens
ttggctctgacactgcagatcgtatgtagcggatctacagatccatcagatgctttagacaagtgagcatagagaagtgtggcagccccactgacagtagctcacttagattttcactttgatggattaccagggtttagacattccatcaccattc

SEQ ID NO: 5037 - DNA, 191 bp, Homo sapiens
agacgacgtcagaatgcacctgaagggaggaaagaggagacaggtaatagccttggacttaggggcttaggagagattatttgggtcttccattctttcaatccgttaattcaactttttccattctacttatcttctggcaggaaaccatcttccgttgacgtgggagtaggtaaggcagcccgcattat

SEQ ID NO: 5038 - DNA, 218 bp, Homo sapiens
catatcataagcagcgaggaagatctaatagctctgatctcagtttctcatctctacaatagggcagtagatggcatgcacctcccgggcctgttctgagattctagatgcctcccattgacactgggagagcctggcacagacaaggtccaacccaggccttttgatctgtctgtcctttggcctgggacattcctcccaagatacctcctgagggg

SEQ ID NO: 5039 - DNA, 286 bp, Homo sapiens
tggaccccggactctcgcttccggttctgtgagcagctctgcacatgcagctggtagcgagcatttacaaagggcctgaccttgaaaggcttacttctgcatgctgtctgcatgaccacgcctgtgaggagcctggtgagaacacatccaagctgggcaagatgattacctcagcatgatacaatgtttacttcagtatgatacaggagtctacttgacaatacaagtagaggacggtgctatcagtagtctcttccttccgtgggggagcagcagatcatcagtt

SEQ ID NO: 5040 - DNA, 258 bp, Homo sapiens
aaagcatatgcagccaaccaggatgcaaatgttttgaaatgatatgaccaaaattttaaggtagggaaggtcacccaaaccacttctgctttcacttaagtgtctggcccgccattactgtgggaccaggcatgatctggttactgtgatatattaaatatccacagtactcacttttaccaaatgatcctagtaattcgcctagaaattatctttctctcacctgcttattcatcaatttctccccagtatttttta

SEQ ID NO: 5041 - DNA, 248 bp, Homo sapiens
ctcgccctctggcgagacaatcgcagcatgctatgagagaagagagttataagaaattcgagaacttgatcacttccaggagcattgaaagtacagacactgagcctcaacagtgttcgaaacttgagcagtgcacacagatttaagagtacagccatgttaacaaaaggctttggatcagtttgtaacttctccgagcaggaagaaagttaataagcgtcaaggagggttaggtaggggtacaatcg

SEQ ID NO: 5042 - DNA, 254 bp, Homo sapiens
gtggttgaggtaagtcaagtatttagtagagagtgagatgagtaagcagcatgaatatagggaggcatcaagcacatggtattgagtgatgtcgaggagtgataatttagagaagggttgttagtgaaaagaagtttaagtggcgacgagatacgcgattgtaagatatcgatacgagctacagcactcacgatttacagagtatgatgagataagtttgcaatgtctatactttcgcttttggagactacgac

SEQ ID NO: 5043 - DNA, 224 bp, Homo sapiens
gtcgcttcaacattcacatctttgttcctcattgttgttatatacattgatattgtcgtagctgttatgacatattttattagaggtagcattttttcagtatgccaaggtttgcttctgagatgactctatactattaatcttcatgagtgttagatatgagtatctgcatttaacgttggctgcgatgttagactaatgaatatctcatgctctaaagcaaa

SEQ ID NO: 5044 - DNA, 175 bp, Homo sapiens
  misc_feature 161: n = A,T,C or G
tctgcttgggcgatgggcttccagcagaccactgtccagaaagctgatctgtagttatgtagatgcacatatctgtcctaagacctgtttaatccatttgggaaggatgttgggaaggccactttcctcgaggggtacgggacggtagggactctattttnataatacatcgtcg

SEQ ID NO: 5045 - DNA, 323 bp, Homo sapiens
ctgcgttggcgaaaggaagtagcacacttcaatacaaggatgtctaactttcttctaaatgagaattcactgtcttgctgtgtgatataacagatagtccaggtcgtgagttctgtgaaaggtaatcgtagagctagtatattttatattttgtacattgctttttcatggggagcgggtagtattatagtccaacagtcagtaatttttataatctcagttataacagccctaaaacttacaacgttacaagtttttaaaagggctgatacactgatttcttcaaataataggcagctagctaggggtacgcgggaggatcc

SEQ ID NO: 5046 - DNA, 271 bp, Homo sapiens
taactgtctctgtctttgtctctgtctttgccagagtctgtgcccagcattgtgcgataggagagccctgaaaggccagagtgtcctggttaagggaaatgatcaagtctcctcgtatcgctgtcacatgtatcaagtctctcgtccctggtcctctcgtactagggcctctcgtcctctgccctcctcgaaagatgtagaactgaatcatgtaaattgacctctgcattgaggcctaaggtacaagacatctgccccctgtccctgcctc

SEQ ID NO: 5047 - DNA, 204 bp, Homo sapiens
gaagcgttgcagcaaggagatatgcctaccacttctgtagtaaggagagagcccaggacactttccattgacctcttctcctcttcacatgtaggcaggagcctgagccttcagctgcctgcacaaccctgacattggctgctggtgacttaatctgccaatgtgctgcagctcgttttctcccattacagcaggactttcagc

SEQ ID NO: 5048 - DNA, 282 bp, Homo sapiens
caggcctgcagctatggaaaatggccgagacggtgagcgaggcccccagggtggcaggaattcctggagtgcctggacccccgggacctcctgggcttccggtttctgtgagccagcctcctgcaccatgcaggctggtcagcgagcatttaacaaagggcctgacccttgaaaggcttactgctgcatggctgtctgcatgaaccaggctggtgaaggagcctgggtgagaacaccatccaagctggggcaaagtgattacctgcagcatgatacattttt

SEQ ID NO: 5049 - DNA, 359 bp, Homo sapiens
  misc_feature 239: n = A,T,C or G
tgcaattgctcttctccacgtctttcctgctacaagtgttttagatgttactaccttattttccccgaattctattttttgtccttgcagacagagtataaaaacctcctgggcttaaggcctaaggaagccagtcaccttctgggcagggctcctatctctcctccctatccatggcactaaaccacttctctgctgcctctgtggagagattcctattactgcagtacatacgtctncaggggcacctgccactgctcctgctcttctcagcacctgaggcaagatggtgcttttctctcccggtaatgtacttttttattcctccatctgcagctggcctaatactttagtaaagg

SEQ ID NO: 5050 - DNA, 224 bp, Homo sapiens
atcatgcattgttgaggtggctgatgtctgacattacagtttccatgaacgtttattgtgttttaatttatttattaagatgggttctcagatatttatatttttattttatttttttctaccttgaggtcttttgacatgtggagagtgagtttgattgaaaatttaagcattgtttgcttattgctccagacattgtcaataaaagcattgagttgactgcg

SEQ ID NO: 5051 - DNA, 293 bp, Homo sapiens
tcggcggcggctctgagatgcaccctcatctacacgctctgggaggctgtgacgcagcgagagacgagcagtccgacagctcgacgacgcagatctcgtgattcgtcatcatgaccgagcatcactgacgtagagagtgacgtagtagagcaggtcgggttcaggttagcgaccccagagtacagtggctttgctttaacaaccaccattccgaacttcagcatggccacccttattggcctttccatcaaggtcaagcttcttcggtccttctaagcgtttcaagatgacgt

SEQ ID NO: 5052 - DNA, 245 bp, Homo sapiens
atttctgggagcactttgataaggacggctggtccctgtggtactcagagtatcgcttccctgaaggaacctcactcagacccttcattgagcttgcaatctcatcactggaattgttccagcgactggacaagctgagggaggatgccttcgccagtgtcatccttttttggaaccacatagcagctccatttcttggagtctgggtcttccgaggccaggagcttgcctttcgcttgatcgat

SEQ ID NO: 5053 - DNA, 329 bp, Homo sapiens
tgcggctggaggtggcagctgccccagggaccccagcccagcctgttgccatgtccctctcagcagacaaggttccaggtcctcctggcagaactgaagcaggcccagaccctgatgagctccctgggctgaggagagggtgttccaggcctgtgtggagcggcctgcccgtatgagtacgcctctgactgctctcgggaggcagccttggtctaggatgctgaggccttgccggactttggctccagatcccagctgcctaatttcttcttgaggaacttggctagggttcctaggaccttcccagcataccttccttccttgaagca

SEQ ID NO: 5054 - DNA, 240 bp, Homo sapiens
ctgggaccgccgttcagtcgccaatatgcagctctttgtccgcgccaggagctacacaccttcgaggtgacccggccaggaaaccggtcgcccagatcaaggctcatgtagcctcactggagggcattcccccggaagatcaagtcgtgctcctgcaggcgcgccctgaggatgagccactctggccagtccggggtggagccctcactacctggagtagcagcccgatcgttgaggtaa

SEQ ID NO: 5055 - DNA, 227 bp, Homo sapiens
gtctttgagtggacgtgctaatcctttctgtttgtttctttttcttctaacaggcccctctgctgccagtctgctggtgtttgctggaggtcccctcctgaccctgttttcctgggtatcaccagttggaggctgcaaagcgaaaagattgctgcttgttctttcctctgaggcttcgaccagcaggaacctgcagatgccagccagagctctctgattaggtgtct

SEQ ID NO: 5056 - DNA, 114 bp, Homo sapiens
gttttctgaggacgtccgctggaccaccgcgttcacgccgcatcattggtgccgcgaaagcatttcgaaaattcattgacgaattcaaaggttggacattcgctttccacagag

SEQ ID NO: 5057 - DNA, 247 bp, Homo sapiens
cggcgccgctccgcttgcaccgcgctcgctccgagtgtcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtagaggggaagatggtcagtaggacagaaggtaacattgatgacttggttcattggtggaaatgcctcg

SEQ ID NO: 5058 - DNA, 214 bp, Homo sapiens
aatggaatgcaattaagggaagagaaataacaagcttataataaggttcagtatgaggtattcaaaatttaattagtatttttttaagtaattgtcaagactcacaggatgctgtagcaacaatagactgtatacaaatggggtggcataaataaatgtctttataatctacacaatcaccagtggtgtgccttttaaggcaaggtgccatttt

SEQ ID NO: 5059 - DNA, 241 bp, Homo sapiens
tttaatacctttctaggaggtgtcacaatgtagggtaccaagggttggatgtgatgggcatggtcgtacactgctcattgtgccacaggtgtgactggaagcatgatattctaggggttggtttgtagattcaaataatccagagatatacctaataagattgagtgaaaatttgagtcaatatctagggcattcacagagtagctgtgagttcttggtaatgtaaaaaaggccttgtttt

SEQ ID NO: 5060 - DNA, 198 bp, Homo sapiens
cttatattaatccatgccctgtacctgtgcacgttggactttaattactggggtttttctaagaaggaaattgtattatcaccagacattttaaggacagttagttycctcacatgatcatacacattcatcatcattctcattctcattttttaaattaaccggcgtacctcargatcctgattttggcttgtttgg

SEQ ID NO: 5061 - DNA, 183 bp, Homo sapiens
ctccatgtacattgtagcattattcacattagccagataagaattacatgtcctcttacagatgattggatattgaaatattatatgtgtgtatgtgtgtgtgtgtgtgtccacacactggattttattattccagtctaaaaggatggagtttctctggtgtggtcacacaacatattattc

SEQ ID NO: 5062 - DNA, 230 bp, Homo sapiens
ctcgcctttgggcgagggaattgtagcttgctgtgccctgcctctgaatgggacgtggtggtacagtagctgggattacagtcatacaccaccacgcccatccaatttttgtattttgagtgagagatggggatatcaccattgttacatacaggcctgattcttgactctcctgaccctcaggtgatctaccccccctaaaccctcccaaaggtttggggtttacaggg

SEQ ID NO: 5063 - DNA, 215 bp, Homo sapiens
atgtttttggatgcattatctgcaagtactagagttgtaagatatttctcctctgatatattatttcacagtgaaattcagtatttatcactaatgtatgagcaatgatctttatcatttcaaggcacgtgaaaaaattttttagtatgtccatttaatatagaggattctccctcttggacataggatttgggagtacagcataggataagaag

SEQ ID NO: 5064 - DNA, 119 bp, Homo sapiens
catttgagagtctgttgtctctctcatctctgcagttggtcgaaggtttttaaggaatatcatcatttagggtagagatatctattgggggaagatccactctatgagatctaattagt

SEQ ID NO: 5065 - DNA, 120 bp, Homo sapiens
tgtatctgttgtatgactccatgagtccacagaagcactctatttggttctgtgcatttaaatgcgtgcagaggtggcaataagtggggggagtttttttttggttatttggtttttttg

SEQ ID NO: 5066 - DNA, 140 bp, Homo sapiens
atatcagtgttagtacatgctggccattcagctcaagtagtgttactacctctttgttcttggggattagagttatgattccatgaggattttgggttcagtaccacaatcctttccaggaaaatatgcattatggacta

SEQ ID NO: 5067 - DNA, 220 bp, Homo sapiens
gctcggtgaagctggttgtccgttacacaccgcgagtgctggaggagatggaggcccggtttcgagaaggatgcgctctgcccgccggcgccaccagcatcagagctactcgtcctcggagtctcgaggttaaaaccacagatctggacgttacacgtgcactctctcctgctacagtattaattgttcctggcacttatttaaaggatattgcaccctc

SEQ ID NO: 5068 - DNA, 134 bp, Homo sapiens
tcgatcagctggcgacagagcggactctctaaaataatagtaatagcagcgcgtagtcacgcttatccagtcttggggccagcggcagtcatctagtcagggttaccacctcccacatgtacccattctctata

SEQ ID NO: 5069 - DNA, 349 bp, Homo sapiens
ggagatccggccagagggcaatagcaggttcacgtacacttcccttgaaggatgggctgcacgaaaccataccggttaagtggggcaagactgtttatcgagtaccggtcacagaagacctcacgcctccccatcattgacattgcaccatggacataggagggccgagcaggaattcggtgtggacatagggccggtctgcttcttgtaaaaacctgcaccccagaaacaacacattcgttgcataccaaaggacccaggtgctttccatctcagtcactctaggactctgcactgcattggctgacctgacctgatgtcattcatccaccttctcacagttcgggct

SEQ ID NO: 5070 - DNA, 105 bp, Homo sapiens
gcctctaatcccagctactcgggaggctgaggcaggagagtcacttaagacccaggaagtgggaggttgcagtgaggccaagaggtacaccacttgactgcacgc

SEQ ID NO: 5071 - DNA, 105 bp, Homo sapiens
gcctattgggtatttcttcgtgcaaaattatatttttccagattgattggtcccggggactactgcaaagactatagtttttcggttaaaaatgtacttttccgg

SEQ ID NO: 5072 - DNA, 351 bp, Homo sapiens
tgcctcctccgctgtctccctggagttcttgcaagtcggccaggatgtctcaggctgagtttgagaaagctccagaggaggttaggcaccttaagaccaagccatcggatgaggagatgctgtcatctatggccactacaacaagcacctgtgggcgccataaatccagaccgcccgggatgttggactttcagggcaagccaagtgggatgcctcgaatgagctgaaagggccttccaaggagatgccatgaaagcttacatcaccaagtagagagctaagaaaaatccgggatatgagagctggattggttctctccatgtgttatctaactgcgcaatgcttgttttt

SEQ ID NO: 5073 - DNA, 450 bp, Homo sapiens
gtgtcaggtaagtagtccaggccatgggtaagaagaaagtgttgggtcaaggtgcatctcaagggacaaggtttgttcatagatgtggacaaaaatatcagcatcagtgatgtgacacccagttccttggtggttctagaaatgacagctacactttgcacaggatcctaccaacaaggtggactcattggtgtcactgatgatggtgagaagtaccagattcagcttatgaaatgattggtagactggataggcagatcagaagatcaaagagtgatcgacctgcctctagcatccgagctcttcaaagcactggcattcacacccaagggattcttcttgaagagctttggcctggctttgctaataaagggctttgacctaatatgctttgctcttatgacaaaatcattgggattcttattgagaaagcctacttcactcacggaa

SEQ ID NO: 5074 - DNA, 218 bp, Homo sapiens
gaagaaagcagcgtaccaaggaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtacaaataaataagatcagactctgaaaaaaaaaaa

SEQ ID NO: 5075 - DNA, 135 bp, Homo sapiens
attgtgaccaggacagatgccttccagggtgcctgagctttcggtcacttggcacgagtacttgccaggtcaagccggggacacctggttcagccttagcagtggccgtggaccttgccaaggttgggtaagagc

SEQ ID NO: 5076 - DNA, 164 bp, Homo sapiens
cccccattcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggactggt

SEQ ID NO: 5077 - DNA, 277 bp, Homo sapiens
cccaagattgttgaggtgggtgtgatagtcttcaggtgcagtgcgttcattcactaacgctcactgtcagtgcccatgtttgctagctgcctccatgtgcactagtgagctgctggtgaaagtcgtgtgcaaatcctgtacactgtgtatagaacaatgtaattttatgttaattggttattactttaaaacatatctaccatctgattggctggtaccgagagctgtgggtaaaatttgaaattgtatttagattaagaaatttacatttaaacct

SEQ ID NO: 5078 - DNA, 178 bp, Homo sapiens
gaacgtctgaggttatcaataagctcctagtccagacgccatgggtcattttcacagaggaggacaaggctactatcacaagcctgttgggcaaggtgaatgttggagatgctggatggagaaacctgggaaggctcctggttgtcttaccaatggacccagaggttctttgacactt

SEQ ID NO: 5079 - DNA, 135 bp, Homo sapiens
tgcacggccgcaacaacggcaagagctcatgactgtgcgcatcgtcaagcaatgccttcgagatcatacacctgctcacaggcgaggaccctctgcaggtcctggtgaacgcatcatcgacagtggtccccggag

SEQ ID NO: 5080 - DNA, 100 bp, Homo sapiens
gggctaatgtaggaaatggtagcagttcataaacactacttattgttcatcacttcagatgtcactaggcttatgtaaatgaaacccgagatatttggct

SEQ ID NO: 5081 - DNA, 145 bp, Homo sapiens
ccaccgcaccaggttcaaggcatttgttctatcgggactacattgccacgtcggtcttgggtttaaggtctccaaggagttggccaccgcatccttgggccatcatcctggcaagctctccatcgtgcccttcccaaaggctact

SEQ ID NO: 5082 - DNA, 266 bp, Homo sapiens
cagaaccgcagctgtgggaagagccatgtagggaggctattcccaggcatacacttccactgccttcagctgacgtcacagctgacaaatcatctcctgtatcggagccagaagacttcagctccacaaaatgaagtgttctgtcctgaaacattcttgggaggatccaacatcgagaaacggtgtcctgtgagttccacaatgcttcttgttcatgggttcttccgtatggagtggattaagagtgttttattttgttgtctact

SEQ ID NO: 5083 - DNA, 288 bp, Homo sapiens
gcacagggaaggcagctgggccgtttctgtctgtgtcccatcctgctgtccttctgtcctggatgtttcatgggcccggggcccccagggaagcttaccctcctgtgctgggtggaggccacgggacacctcaggtgccacccaccttggccctaaaacagccaccaggaaagcagccggagagccggacagcgggcagcctgtctgggttcctgaggcctcggggtggcagacgagcccacgcggccgtgtcccagcagcagggttgttcagtcggagcatctgggg

SEQ ID NO: 5084 - DNA, 294 bp, Homo sapiens
ctgccttctttccttttgtgaggttcccaatgtctcgtccagaaaagtactttatttatgcaagtcaggtgactcttaggccacaaaaccatttgatgattaacagattatcattaggtgcatatcttcattgatattttgtgaaatgttatgcctatgttgcaaaagttgaatagttttgtctttatatattgctgtcttcagtgtacagcatggttttacttaattgaatgttaatgtttaatattttcttcttatagaggagatcatgccctcttgtatgacatgttttag

SEQ ID NO: 5085 - DNA, 225 bp, Homo sapiens
gagaatatatggtttgtagggcatgactccctagactccttaggtaggaatttgggcaagataaaaaatcagagcttagtcctcaaaaatattctaaaaataagcaatattttattcctttgtcgaaggcccattttcacattataacaatataaatcttattgcagggatatttcattttgagatttaacatacttccttagaatgaattaaatgtgcaacatt

SEQ ID NO: 5086 - DNA, 296 bp, Homo sapiens
aatcaacaccctcctagccttactactaataattattacattttgactaccacaactcaacggctacatagaaaaatccaccccttacgagtgcggcttcggccctatatcccccgcccgcgtccctttctccataaaattcttcttagtagctattaccttcttattatttgatctagaaattgccctccttttacccctaccatgagccctacaaacaactaacctgccactaatagtatgtcatccctcttataatcatcatcctagccctaagtctggcctatgagtgactt

SEQ ID NO: 5087 - DNA, 291 bp, Homo sapiens
gtcaaatggcggtcttatagtttcaattctgaaaatagcaaacttaataaacagccactttaaacttgttctggcaaaccagaccctgctgtagatatagtctaaggtagttaaccatataagcctcttcaactcttaatgccctccacatgaatcagcagttaagagggttctagaacccatgaaagcttttgtatgtattactaggtgttgtttttctcatgtttgctgattttacagttctgactaagctgacctcaatggatcagtttatgtgtaatattctggtgc

SEQ ID NO: 5088 - DNA, 400 bp, Homo sapiens
gcgcaatctcagctcactgcaacctctgcctccagagttcaagcaattctccttcctcagcctcccaagtagctgggactacaggcacccaccacctccattgtctttttactgcccaaggtaaaatcctgtgactgtgtactggatctgggctgcggttgtcatatttattgatctgaggtcaggcagtgtttttaaggtatatgaggtagtagtgagaattgaaaaggatattttacaaccaaatacaggtttctggtgtcttttgaaaatcaaagattggcactcgactaggctccgcaaaacacagtagttggagctgagcggagcagactacaatcacgtggccggcaccatccacactcgtgctctgacagacagtcatcatcatgctgcttta

SEQ ID NO: 5089 - DNA, 360 bp, Homo sapiens
gattttacatatccttggatcaatcagagattcagttgtggaaattctttttgacaagataatgaagagcaatcagttgccactttaatattggattcccttatacagtgtccgatagacaccaggaagcaactagcagagaattttgtagtcataggtggcacttctatgttgccaggatttctccacaagattgcttgcagaaataaggtatttggtagaaaaccaaaatataaaaaggcacttggcactaagacatttcgaattcatactccacctgcaaagctaattgtgttgcctgttgggaagggcctattttgggagcatacaagatatacttggaagccgttctgttcaagg

SEQ ID NO: 5090 - DNA, 266 bp, Homo sapiens
cctcacgcagcatggttaacgtcctaaaaccgccggactttctgtaagaagtgtggcagcaccaaccctataaagtgacacagtacaagagggcaaggattctctgtacgtccagggaaagcggcgcttcatgacaggagcatgcatggttatggtggccaactaagccgatttccggaaaaggtcaaatcacaagagatgtgtcaaggtctgagtgcctgagcccatcgcagattcaggaatgtccgtctttaaagtagcagctt

SEQ ID NO: 5091 - DNA, 320 bp, Homo sapiens
gctggtagagcattggttatagtcatgggaaaggaaggtgtccacggaggcacacttaacaagaaagcatatgaactcgctttatacctcgaggaggtctgatgtgtaagcagcctctccccatctacctagcaactgtcttcatcaacaaccctaattatggtcacaatgctaccaaactgtagatggtagctaatttttctttacctattttctaatgtcatgattcctgtttgcccatggatcattgtatgttaccactgtatgtaccaacccttcatctcggcacaaaattccaggccaataatgtttgccatgag

SEQ ID NO: 5092 - DNA, 341 bp, Homo sapiens
gggtttcgagcttctgcctcaggcatctccgcgatctcctctcccctccaatcctatccgtgatggacgatgcccacgagtcgccctccgacaaaggtggagagacaggggagtcggatgagacggccgctgtgcccgggggaccgggggctaccgacaccgatggaatcccagaggaaactgacggagacgcagatgtggacttgaaagagctgcagcgaaggaaggcgagctcgagagtaaggatgtctcagatttaacacagctgaaagggaggcctcatcattacttaatcctgcagccaaaaacctgaaaataggtaccaaaaaaaaaaaaaaaaa

SEQ ID NO: 5093 - DNA, 340 bp, Homo sapiens
cgcagagggaggggaggggctgagctgtgaggagagcggggcccaagaaccatgtctacgcgggagtcctttaacccggaaagttacgaattggacaaaagcttccggctaaccagattcactgaactgaagggccacaggctgccaaagtgccccaagatgtcctgccaaaattgctggaatctttacaggagaaccacttccaagaagatgagcagtttcttggagccgttatgccaagcgttggcaattggaattggatactctgtcattcctttgaggcacggtgggctttccttggttcaaaccacagattacattacccgttcgtaggcggccc

SEQ ID NO: 5094 - DNA, 304 bp, Homo sapiens
caggatcgcggtcctgtagcctttttgtcaacaacttgaccttactgtttaagctggcattatgtctccgtgcagtggctgctgctgccctaatacttttagaggcccttaaaatcacatactatgctcaactcactctctacagctctcataactgccaaaatctattttcttcctcacacctgacacatatactttctgctccctggctccttcagctgcactcatgctttgttgagtctctgcaattaccatttttcctggcccagacttcaatccggcctccacaatattcctgataccc

SEQ ID NO: 5095 - DNA, 307 bp, Homo sapiens
ttccgttgcagtcctcggaccaggaccttggcgtggctagcgagttatggcgacgaggccgtgtgcgtcctgaagggcgacggccagttcaaggcatcatcaattttcgggcaggagggaaggtattggaccagtgaggttttggggaggattaaaggccttgacttgaggcctcaatggatccatgtcaatgagttggggataatacagcaggcttgcccagtccaggtcctcatttaatccttttcagaaacaaggtgggccaaagttgaagaggcgattttgggattggcatttgcttctccaa

SEQ ID NO: 5096 - DNA, 154 bp, Homo sapiens
gcgggagaagcccggcagtttgaagctgcttctcgatttgcattcaatatgaaaatcacctcgggagctggtaaaaggaggcctaacccctgttctttagatttacagtccatgcttcactcagccattttacctcacccccaaaaaaaaaaaa

SEQ ID NO: 5097 - DNA, 316 bp, Homo sapiens
tttctgaccagaagaggaatagatgagatgagaattaccacaactttctttgaacagtcagtgattttgggtccagcaggaaagcctattgaaacccgagatttctttaaaattccaaaattctggagatttgtgataacgtgaccatgtattggatcaatcccactctaatatcagtttctgagttacaagcctttgagggggggggagaagttcttccatttcctgccaacggaaaaaaagggtttgacaaaatgaacagtgggtggtcctcaagttgaagtggagagcccgtccgccgccaagcagttgggcg

SEQ ID NO: 5098 - DNA, 296 bp, Homo sapiens
ctcgccctttggtctgttctacccctgctccagcttgccctgctcgtcctgatcctgtgatttctctgtccttggctattcttggcagggagctggaaaccttctgaggatttctggcctccccctggtttttagtttaagggaacacaggacagcagaggatcccttttgcaagtgggaaaccaaggcagactgagggacagggggagcagagccataagatggtaaagggcctcaagaggagatttggccctcctcccctattaggactaataattgattataaaaaaaaaaaa

SEQ ID NO: 5099 - DNA, 296 bp, Homo sapiens
gtggccgggcgtcgctcctcagcgatgtgcagcccgagcatgctctcgccgtccgagtcgttattgtggcgctgaggctcaagtccaagtatcttcagctcaagaggaggttagaggatgagttccccggccgcctggacatctgcgcgagggactcccagccaccggttctttgagtaatggtagccggaagttgattacttagagaaggcatgctacgtgacaagaagcagttttgagtggtcgcccctcaagccccttgtcagttattcgccgaggcagttccggacttgccc

SEQ ID NO: 5100 - DNA, 311 bp, Homo sapiens
ccccgcatgagtcaaatgaagacccgcacaatccttggactccagcgccccacttaatgaggaaagggaggcagagggagatccccaaggccaagaggccaacctcactgaaggaggattattttgaaagacccgggcaagagagaaagcagcgtctccaagaaaatgctgtgagtccagcttttaccagtgatgaaaaaaagatggagagagtggtggtaatgaccagtttccgaggcaggcagactgtaaggcccagagggattgacgaacctatctccctcttcggttgaggaaagtctaaggccccc

SEQ ID NO: 5101 - DNA, 185 bp, Homo sapiens
cggcacgagggagatggtaggccttgtaaattgacagagaggggaacccgtaaggtggttggttgcagttgtgtagtagttaggactatggcagggagtctcagaccaggaatgtcattgaggagtatttcaaatgcaggaaatgaggagtaaatctttggctcacacaaaaaaaaaaaaaaaaa

SEQ ID NO: 5102 - DNA, 205 bp, Homo sapiens
ccactccaccttattaccaaacacccttagccacaccatttacccaatataagtgatatagcgcgtatgagagttttgaacccctgcgcgcatataagtatatgatgtgccccgcagggcgagagatgagaattatatacccagcgcatatatatggcagggctctacccctcatatcctcctcatatattgatttaacctggaa

SEQ ID NO: 5103 - DNA, 135 bp, Homo sapiens
cctgacatcattagaagcatgccagaaccagactcggtgataaagtaaaccttttcacctccaaaatttacacctcgcaaacctctaaacctgcaaaattttcctttattaaaatttgtcttgttttaaaaccac

SEQ ID NO: 5104 - DNA, 114 bp, Homo sapiens
ccgggacgggggtgggatggggtaagggaaattaatatattttagatatcacgctttagaccacagggagcccccaccccccctccccgctctctctcctcgtggtcgctgtcg

SEQ ID NO: 5105 - DNA, 123 bp, Homo sapiens
gtttacagaaaatcttgtgctagatacttttaaaggtatttgataccataaacctgcttttttttccagaagtatccaccacctggtctctcaataatctttgagactaaaaaaaaaaaaaaa

SEQ ID NO: 5106 - DNA, 357 bp, Homo sapiens
cagttgtgactgtactgctaggagctcctgtcaccacgagacagagtgcatgataacagtataagaagctcatttggcacacctaaaggccaacccttttggagtgctctcatgcaaaaggaatcgtgctgtaaaagtaggagttgaagccaacagccaagttctgccattaggaggtgtgtagggtcagctgatcaggattggcaggaaatcacagcctttgtacccatgacggtgctggactttttgaggaaatgatgagtctgtgctggattggtcgcaaggtcatctgtggtatattcctggagtcgctttaggtagtcaagtagccatgttctttttggccttacaaggcag

SEQ ID NO: 5107 - DNA, 163 bp, Homo sapiens
tctggtgagcctatgagaggcgcctcttggaatgacagtgataagagtgatgatgatattggggtacagcctttgaaataacaggatgtctagccgttccgaagtgggcaaggtgtgaacaggtggatatgcagagcgggaggttaaggtcagggagagaagg

SEQ ID NO: 5108 - DNA, 183 bp, Homo sapiens
  misc_feature 122: n = A,T,C or G
tcatgcattaaactgagaatgaagatcattgatagccatagcttttctattctacatggtcaaggcgtagttgttgttattaggtcctagctcttttcttactctcaaggttggaacagatnttggcaggatcttttccccacaggtcttttctaggtgtttgatggtaggctcaggggggtt

SEQ ID NO: 5109 - DNA, 210 bp, Homo sapiens
ggtagtgtgttctgttggctttagctctgtggtgcctgaggcaattaagaggaaatggaaattttaatttgagtcccagaacctagtgattttttttagatatggaatgaggggtaatgacatgcttccatattgagagaccgggtttatttgagtgctaccattgtggagagagagattttttaaaccacaggaggattaatgaggagg

SEQ ID NO: 5110 - DNA, 153 bp, Homo sapiens
attcagatgaggggaccatatgatttgtttttgggacagcaagagggagctcagagacagtctcatttccaattcaaggctttattggggggaggaggtcccagggatagttaccaagaaaagggagggctggcctcattccagacacttggc

SEQ ID NO: 5111 - DNA, 146 bp, Homo sapiens
cgggcatggtggcgcgtgcctgtgatcccagctgctcaggaggctgaggcaggagaatcgctttggaccctgggaggtggaggttgcggtgagctgagatcacgccattgcactccagcctgggcaacaaggcgaaactttgtctc

SEQ ID NO: 5112 - DNA, 235 bp, Homo sapiens
cactttgcattctgacaagcgtatgtagtgacatctcaatgtggtttaattgcatttctttaatagctaatgatgattaccttttcatctgcttatttgccatctgtaaatcttcagtgaatgcctcttcatgtttttttgctcattttctaggtggatttgttttctaatgtttcttaccttttctacctgcttaggtaggtactcagtcattaatttattttagctctcttaa

SEQ ID NO: 5113 - DNA, 335 bp, Homo sapiens
gacatagggctagttcttttcctgctccttatttgtccttcctagactatagcacctgctgggtggcccttgctctattggctccagctctcactagaaaccggtactattccttccttgccttcccttaggatgttaacagcttctactcttggttccttgactggccacaactctgcagtagtgccttcattactgtctcttgaaccacctcagctagatctgtcttcccgctggggcccgaaccatatgcacctttccacatcaccctaatctgcaaaataaatctaatacccagggacgtggggcctaaatgtccacgtcataaatcattg

SEQ ID NO: 5114 - DNA, 275 bp, Homo sapiens
ggcatgatttatgattcctgattatgcaagaaaatgaacccaaacatagacttgcaagacatggcctgtatgagaggaaaagacctcaagaaagcaacgaaaggacgcaagaacagaatgaggaagtcaggggactgcaaggccaatgttggtgctggcaaaaggtagctggagattggatcacagccgaagagtaaaggtctgcaattatgttagctgtggcactgtggattttcgcaggacattaataaactaaaacttcatgtgaaaaaaaa

SEQ ID NO: 5115 - DNA, 300 bp, Homo sapiens
aacaggttgtataaacctgtttcttatactttaacaaaataatttccaagtgtactatgcgatttttaattctagaaggttttctattaaaatgaaaatgaaatgtatgaaatctgtctcttattatttcagtcttctataggttttcgagtgtaaattagggagaaatgcagaataatttaaaattaaagttacttatagagaaagctgaatagaaaataatgtgtatatagcatttgttttcctagaataaagtaagcacttatttagcttttaggttcactatatcccttctcttga

SEQ ID NO: 5116 - DNA, 265 bp, Homo sapiens
taaaggtagaactttttttttttaagttaaagctattactagtaaagccaacgatgtatctattatttttagttgtacacttcgctacaggttttaagtcatatttaaaaatattttgttatgtcttcagttggtactttagttgcctgatagttagcgtgattcaataagttaataagtcagcaaatatttattgcctacctcctagtactggggacaaagccatgaacacagagtccgtatctaaaggtgtaacattggatgg

SEQ ID NO: 5117 - DNA, 240 bp, Homo sapiens
gacgagtccaaccatgaccctcagtttgagccaatagtttctcttcctgagcaagaaattaaaacactggaagaagatgaagaggaactttttaaaatgcgggcaaaacttttccgatttgcctctttagaacgatcttcccagaattgaaggagcgaggcacttggtgacgcaagcttccttaagcacaaggagaaaggggccatccgccttcctcatgcggagggacaagacccttaa

SEQ ID NO: 5118 - DNA, 240 bp, Homo sapiens
ttaagaagcagttgttttattgtcaatgtttttttttccccaagcatatttcttgtatttctgtttccatatatatatatatatataaacttcccaattcaggatattgcccccgccatccatgaaaactgttctggcaccaaagtaatgacaatgttaagtgttaattatagaaaggtagggcaaagggcctttagctgcagtttttacatacctggataaaacattaaaacatctttg

SEQ ID NO: 5119 - DNA, 260 bp, Homo sapiens
cttaagggacaaacttgaaaagcctgttcttcagaaggtgagtggttgagggaggcagtaatatgaagtgactctgtgtattttaactaccagattttttatatttgccactgttaaatagttggagaggggaaattctgattaagcgaaagtggtatcatcctagggaagcttatttcagaacaagtctaatatttcagattctttctttccgcctgtatactctgagtgatgacttactgtaaggggggtatataacc

SEQ ID NO: 5120 - DNA, 315 bp, Homo sapiens
gagaactacaacacaaaagtgcagacttatatttgagaattaatgttaacctttgtgtctagtttgaagcttcttgtatttgtctaaaacaacaagccagaattttgtatctcctttgataaaaagtgtgtataatgtaaagtagttttgcatattctgtgctgcacatgggctgaatttttaaattttttttaaaaacttgaggcagaacctggtaatttgtgtaaatgacaagtgtaaaatcctaccataaaatgctaaaatatgcactgtttcaaataaaccaggaatgcggcattaaaaaaaaaaaaaaaa

SEQ ID NO: 5121 - DNA, 384 bp, Homo sapiens
ttgccatgttggcaggctggtctcaaattcctgacctcaagtgatccgctttccttggcctcccaaaagtgctgggattacaggcatgagccaccacgccccgctgatttttatgtttcctaagtctcttttaatagtttcctcttcctttttttgtttcaaattatttaagaaactataaaatttgtcctcagaattttccgtaatctggattttagtattgttttgttgttgttgtttgaagcagagtcttgctctgtcacccaggctggagtggagtggcatgatcttggctcactacaacctccacctccaaggttcaagcaattctcctgcctcagcctccatgtagctgggactcaagcatcaccaccacgcccgcta

SEQ ID NO: 5122 - DNA, 320 bp, Homo sapiens
tgagacttctccgccgcctccgccgcagacgccgccgcgatgcgtacgtcgcctcctacctgctggctgccctaggggcaactcctccccagcgccaaggacatcaagaagatcttgacagcgtgggtatcgaggcggacgacgaccggctcaacaaggttatcagtagctgaatggaaaaacattgaagacgtcattgcccaaggtattgcaagcttgcagtgtacctcctggtgggctgtagcgtctcttctgcccagctctcagccctctcttggttctgccctcctgcagcagagagaggaagatagagaggagag

SEQ ID NO: 5123 - DNA, 375 bp, Homo sapiens
tcagaagccctttccagaagaggctggtcttcaagaagtctcgtttcttgccctgagtcagtttcaggggaaggatgtgaaatttttccgtgtagaggttacagccttttatgctgttgagctcccaggtaccaaaaagcttggccaacgcttgccagccagccagctgcaggtcgcatctgccaggaagggaggcgccacctcgccaggccagcagggcgtcgtttgttgccattttgttgacgttatgggttatgggtgttctggactgtcttgtgcattcgttgctgttgtgtacctactgtcccatgtccaccacgtctacgcattaggaggacttggtagacggcctaccctctgtttcctccagcaggc

SEQ ID NO: 5124 - DNA, 215 bp, Homo sapiens
aggacacattttcatgccttctctcacagggctctgcggctccggttcacttctgtgtctttacactcccttcacagagacacttgctccccttctctcgttcttggcatcccctaggaccttgcacacccaggtcttctggacttctggacctgcttcttaccatgccgtcttaagcagtcaggagtggctgcctgggtccggtcctagttaaa

SEQ ID NO: 5125 - DNA, 230 bp, Homo sapiens
ggcaaggtctggcagacgttctaggacagtgcacgcaggtcgcgtgattcatggacgacacgagccgatccatcatccgcaatgtaaaaggccccgtgccgcgaggcgacgtgctcacccttttggagtcagagcgagaagcccggagttgcgctgagcttgctgctcgctgggtctagatgtcgggttcgccacttggccgatgggaatggtctgtaaagtctcctcct

SEQ ID NO: 5126 - DNA, 230 bp, Homo sapiens
ggaacaggccactaaatatttgatgatgtatgatttcaaatacagtgaattcctgggagtcatcaaagaagaccggcattttatggttgtttttattaagtgtatatcctttgctcctggaaatgttattaaataattggtttaggccgggcgtggtggcctcatgcctgtaatcccagcactttcaaaggctgagcgaggcagatacctaaggtcaggagtcgaaaccc

SEQ ID NO: 5127 - DNA, 230 bp, Homo sapiens
ctttgtgcgcccctgctgaggagcagccccaggagggaccagagggatgctgtgtcgctgcctgggatctcggggttggcctttgcatgggaggcaggtgggcttggatcagtaagtctggttccggcctccctgtctagagaggaggcaggagccccaggccggcttgtgtttgtcatgcacagaaacttgtgtggggtccttggtaaaaacggtattggaaaaaaaaa

SEQ ID NO: 5128 - DNA, 205 bp, Homo sapiens
cggcgcgtggtctacgccgagtgacagagacgctcaggctgtgttctcaggatgaccgagtgggagacagcagcaccagcggtggcagagaccccagacatcaagctctttgggaggtggagcaccgatgatgtcggatcaatgacatttccctgcaggattacattgcagtaaggggagtatgccaggtacctgcctaacgtgc

SEQ ID NO: 5129 - DNA, 230 bp, Homo sapiens
gacaaagtagataaaccacaaagatgggaaaaacagagcagaaactggaactctgaaaagcaggagcacctcttcctcctcaaaggacgcgagttccaaccagcaacggaacaaagctggacggagattgactttacggagctgagaaaggacttaagacgattaaattactccgagctcaggaggaaattgaaaccaaggcaagaggtgaaactctaaaaaattggaga

SEQ ID NO: 5130 - DNA, 280 bp, Homo sapiens
gatgttcgtcgtggcacttgctggtgacagaaaaatgaccaccatgagcagctggcttcactgctcaggtgattatcctgaaccatccaggccaataaggcgccggctatgccctgtatggattgccacacggctcaacattgcatgcaagtttgctgagctgaggaaagatgatcgccgttctggtaaaagctggaagatgccctaattctgagtctgtgatgctgccatgtgatatggtcctgcagccatgttttgagagctctagctattcaccttg

SEQ ID NO: 5131 - DNA, 140 bp, Homo sapiens
tttcactcaggcctttgcctctaataatgctgaggtggctgatccttccattctgtcttcgggtcattctgtaggtcttctcctccactgtcaagtaagcaatcaggtccgtgacaggattggacatatgaccaattaag

SEQ ID NO: 5132 - DNA, 240 bp, Homo sapiens
agcttagtctgacataatctaagggtatggggcaaggatcacatctaatgctgtgttccttatactctattatatagtgtcattcatgattcagctgatcttacaaattcgtagcagtggaccttgaaatgcatgtggctagattatgctaaatgatctcagtagcatttagtacactcaagctttttttgttgtttctggcttaataaagcttaggattattgagagcaactgttaatt

SEQ ID NO: 5133 - DNA, 120 bp, Homo sapiens
gagcagatacattcactttcatagaggtttagtatgctggattctagttttagtttgtagtaaccaaatgatgtagacacgtccgtagtcccatttacccttgtcacgccttggcctgtg

SEQ ID NO: 5134 - DNA, 125 bp, Homo sapiens
gcaaaaccccactctgcatcaactgaacgcaaatcagccactttataagctaagcccttactagaccaatgggacttaaacccacaaacacttagttatcagcctaggcacccaatcaactggct

SEQ ID NO: 5135 - DNA, 250 bp, Homo sapiens
ggcgcgtggtctacgccgagtgacagagacgctcaggctgtgttctcaggatgaccgagtgggagacagcagcaccagcggtggcagagaccccagacatcaagctctttggggaagtgagcaccgatgatgtgcagatcaatgacatttccctgcagattacattgcagtgaaggagaagtatgccaagtacctccctcacagtgcagggcggtatgcgcaaaacggtttccgcaagctcagtgcccat

SEQ ID NO: 5136 - DNA, 363 bp, Homo sapiens
cggcagagcagcacctacgctggacagcaatatggagcggatcatgaagccagcacttcgggacaactccaccatgggctatatgatggccaaaagcacctggagatcaaccctgaccaccccattgttgagacgcttctgcagaaggctgaggccgacaagaatgataaggcagttaaggacctggtggtgcttctgttttgataccgacctgctatcttctggcttttccttgaggatcccagaccactccaccgaatctatcgaatgatcagctaggactaggtattgatgagatgaagtgcagcagagaacccatgctgcagtcctgatgagatcctcctctcgaggcgataggatgct

SEQ ID NO: 5137 - DNA, 316 bp, Homo sapiens
gtcgcggcgacatggccaaacgtaccaagaaagtcgggatcgtcggtaatacggaccgctatggggcctccctccggaaaatggtgaagaaaattgaaatcagccagcacgccaagtacacttgctctttctgtggcaaaaccaagatgagagacgagctgtggggatctggcactgtggttctgcatgagacagtggctggcggtcctggacgtacaataccacttcgctgtcacggtaagtcgcatcagagactgaggaggtgaagacagtagacgtctctactcttgagcattactggctatataatggtatt

SEQ ID NO: 5138 - DNA, 308 bp, Homo sapiens
gattgagctacttcaggacttaaaacaaaccttgtgctcttttcaagaaatagagatcttattgtcaaggttctacatcaatatcatccctgtcttattaggggattaccgctttcctaagcccaagagtcaatgtcaaaatttgcaatcaggctcaaaaccagagaccaggctgtgaaatccacacatcttttagacctagtcgtctctcttggcctcagcagctctcctgttcttactggttgacatttgatcactctttgcacatcttgtgtttttgctcatgtcacatccagcactagtatgct

SEQ ID NO: 5139 - DNA, 290 bp, Homo sapiens
aaaacacccaagccctcccaggaatgtcttgtgcacttccatagcacactatgttaactccatccaaccacatccacaatcctactcaacttgcatgtttcactgtctgtatctccgtctaggctgtgtgttccttgggaggaggactatatatggctcaccacagtatccaccatgcccagcacttgacacagatgtttgctgaagggaggggggttgaataaattaaaaatatctctacttatactcccaaatcatcttgaactggtctcattcttactaccaggacc

SEQ ID NO: 5140 - DNA, 303 bp, Homo sapiens
gccttgggtgccagctcagccacagtaggataaaacaccagatagattcaaggttctgactctaagccctggttgctggatggcatctatagacccatctgtggttgtaggggacttgtgaccgtgaaggggataacatgaacctagccagcctttgacaacttctgactgtagagcctagggccttgggcaaacctaggcagtagcaaggcagtgattactattggcttgggtgataccagtcctatactgcttcaggtctgtatacagtcagttccagtggtggtggccaagaggtctttg

SEQ ID NO: 5141 - DNA, 305 bp, Homo sapiens
gttcaactgagtttaataggggattaaaaaaacaagctgttaggttcatggcactggtctcatagggttctattggtgataactagctttaacatggggcaaggagtttgtgaatcagggagataggataaattaaaatttaaaatatatagaggagtcctctcgattgctcagcatgatgttagataaatgagttggtcagaaatatcagtatacgctgtttaccaatgttatttatttacattcttctaaggcattatgggtattgtattattggaggctaacctacataggtatcctgtccc

SEQ ID NO: 5142 - DNA, 258 bp, Homo sapiens
cagggggcaagatcctcactttcgaccagctggccctggactccctaggctgtgcactgtcctgctctccggtcctcgcaagggccgagaggtgtaccgcatttcggcaaggcccaggaaccccgcacagcacaccaaaccctacgtccgtctaagggccggaggtcgagcgtgccagagccgacgggcagacgaggttacaaaaataacactggatctactttttattaaaagatttttgtgaaaaaaaaaaaaaaa

SEQ ID NO: 5143 - DNA, 275 bp, Homo sapiens
gactaattgtcggtgttacaaaatggattccactgagccaccctacagcagagggatatgagggaattgttaagggaggcagcacttacattaaggaaattggctacaaccccgacacagtagcatttgtgccaatttctgggtgggatggtgacacatgctggagccaaggtctacatgccttggtcaagggatggaagtcaccctagagtggcaatccagtgacccacgctcttgaggctctgacttcatcctcacacttgtcacttacaggc

SEQ ID NO: 5144 - DNA, 316 bp, Homo sapiens
cttgactctagggcaggctagtgctattgtggtgtcagttgatatttagtttcatttgctgaaccccaaatttgagtgttagttaggggagcctccattctgtgggagagtgtggaaaggcactcttttttctccatattagttaacaagaggtgtctttaggccctggatgttaccatctcatttggtcaagcccctcatacctagtttcacatggatgctaacgtggatgtaatatagttgtgacagcctatgcacaaaagcattacctgatcttaaggttgggtatttcttaaccaaagttgacagactgtgc

SEQ ID NO: 5145 - DNA, 208 bp, Homo sapiens
gatcactgttttcttctttatactttatttttgacattcctttaatggacatgttattacttttataacaaaaattttaaggtttgtttctttttttctaactttatgttttgatataatctcaaatttacaggaaaggtttcaggacagtacaaataattttcatatactcttcaaattccctcaaatgtgcacattttgacacggg

SEQ ID NO: 5146 - DNA, 172 bp, Homo sapiens
ctcaagcccgccgacaagaacaaggggaagtacgggcagttcagtggcctgaaccctggaggccgacccattatcccaccccgcaattccgccaaagccaagaaatagcccccgcacaccaccctgtgccccagatgatggattgattgtacagaaatcatgctgccatgct

SEQ ID NO: 5147 - DNA, 132 bp, Homo sapiens
acctgcattttgggaaatattttcttaaatagagtgttaaattctactaggtgggtattaaatgtctcctaggtagatatttaaaagtacaaaagcagaatagcaccatccaggaaccttaatattttaggg

SEQ ID NO: 5148 - DNA, 147 bp, Homo sapiens
ctcaggcaggggtggagaaaaggcgttggtcgcagtgattggtgaacacagcggggggtgggtggtagcgctggggggtgattttatgtcaagcaagaattgggagaactccacggttgcgaaaaagaaaacctccgggtggcagtt

SEQ ID NO: 5149 - DNA, 160 bp, Homo sapiens
agtttatcagctatttacaaccttcatttcatcacaatctgtgggcttacaaaaaaacaaaaaccttttgtaggttttgtatgttactctatcttcttacctgatatcccatgatgatcccatggtaggtcttctcacctcggatggtgcataacaggat

SEQ ID NO: 5150 - DNA, 150 bp, Homo sapiens
cggcacgagcttgcggcccgtgtttgactcaactcaactcctttaaccgctaataatttccggcaaaaatcccattgctttggggttttgtgtcgtataacccttgtaaccggtttgcaaatccccaataaaaggatttaaaaaaggcaa

SEQ ID NO: 5151 - DNA, 158 bp, Homo sapiens
attggggtgaaatttgagattgtaggccaactgtattttcaagcttctgaacttaggcaaaatattcatcgcaaagtctctagcgtgcatattttttctcaccccaaattacggtttccacggggattattttatatatagttgggtctatctctgca

SEQ ID NO: 5152 - DNA, 113 bp, Homo sapiens
gttgggttccaagtctttgctcttgtgaatagtgccgcaataaacatacgtgtgcatgtatctttatagtagaatgatttataattcacttggggtatatacccagtaatggg

SEQ ID NO: 5153 - DNA, 138 bp, Homo sapiens
  misc_feature 90: n = A,T,C or G
ggtcacctcacctgcaaggctttgtggactctgcacaccgtatgacccccgggttttacagttttttagctgttgaattttggagagtgnggcactggggtgaaaagggtcggggggactgggctcttgttagtcaca

SEQ ID NO: 5154 - DNA, 124 bp, Homo sapiens
agtatttaggatgtatgcatgtctgtttatatgtaagcttggttggggctttcgcttttgtgctacccttcttgggtttttgtaccagagatgttctaaactgatgaaatacattgagaaggtt

SEQ ID NO: 5155 - DNA, 102 bp, Homo sapiens
ccaattcggcagagactgttcaaaaggaatgccccacaagtgttaccatggcaaactggagagtctaaatgttacccagcatgctgttggcattgttgttaa

SEQ ID NO: 5156 - DNA, 131 bp, Homo sapiens
ccaaagccactgcgagattccaaggagaagatttacaaagagcttttttttgttggctgagggaggtgtactgactttctgtagagaccacccataggcccctgtccctaagggcagttttggtggtctct

SEQ ID NO: 5157 - DNA, 130 bp, Homo sapiens
cggcacgagcttagctaccaaaatttcctggggccacttttaaacactaaacatttcatttatcctctaagctaaaatggggctgagttatttaaatctgaatgtaaaatgcattaaatctagcttgggg

SEQ ID NO: 5158 - DNA, 120 bp, Homo sapiens
  misc_feature 32: n = A,T,C or G
cttgtccaattcgcacggcctagttagaactnaaatgtaagtcctttgagtacagagatcatgaattacgaggtgtatatggtatatttgcttgggttgtcttcatgggagcatttcacc

SEQ ID NO: 5159 - DNA, 125 bp, Homo sapiens
gaatcgctttaacctaggaggcgaagtttgcagtgagccaagattgcgccacttcactacagtctgggtaacagagcaagatcctgtctcaaaaaccaaaacaaaccaaaacggaaaaccctttt

SEQ ID NO: 5160 - DNA, 123 bp, Homo sapiens
ggcacgagtwaaagttaaaaaagaacacacattttaattacagggttaaactttgttatactgaacaaggatggtgaaagcactgtggattgtgaatataggaaattgaaggttttaatctag

SEQ ID NO: 5161 - DNA, 275 bp, Homo sapiens
tcaggatagagataatctcctgaaaaacctgaatttcagagattcttagactggctgccaaaggatgaagctagtaaaggagaaaaagcttaaattccatcttgagctcttggattgtgataatacaatgagtttcataagcttttcatttctgtataacctgttcatttgggagtttaatggcttgacttctttgttcattttggatctaaacttctctgttctgtcttcccattcacatctattagaggactgcatcaccatttctttggccc

SEQ ID NO: 5162 - DNA, 148 bp, Homo sapiens
gagaaagcacataccaaggccaccacacaccacctgtccaaaaggggccttcgatacggggataattcctattttatttaccctcagagggtttttttttccttcgcagggattttttccttaggcctttttaccacttccaagcctg

SEQ ID NO: 5163 - DNA, 205 bp, Homo sapiens
ggcaatagcaggttcacgtacacttccctgaaggatggctgcacggaacataccagtaagtggggcaagactattatcgagtacccgtcacaggagacctcacggcttcccatcattgacattgcacccatcggcataggcagggcccgagcaggaattccagtgtggacatagggccggtcatgcttcttgttaaaacctgaac

SEQ ID NO: 5164 - DNA, 205 bp, Homo sapiens
tccgccacggccgtctttggagagcagcagccatggccctacggtaccttatggccgtggcctcaacaagggccacaaagtgcccaaggaccgtgagcaagcccaggcacagccgccgccgcgggctcttggcccaaccacaccaagttccgtccagggccatgtttcgggagtttgttgctttgccccgtccgacgcagcgcgc

SEQ ID NO: 5165 - DNA, 240 bp, Homo sapiens
accctgcagccgcagagatgttgatgcctaagaagaaccggattgccatttatgacctcctttttaaggagggagtaattggtggccargagggatgtccacatgcctaaggcacccggagctggcagacaggaatgtccccacccttaatgtccatgaggcccattcagtcttttaggtcccaggggctacgtataggacacagttttcctgtgagacatttcttctggcaccttacac

SEQ ID NO: 5166 - DNA, 260 bp, Homo sapiens
ggcacgaggtcctatttcgatgaacacgacttcgagccgtcggaccctgagcaggagacgcgaaccaacatgctgctggagctcgcaaggtcacttttcaataggatggactttgaagacttggggtttggtagtagattgggaccacaacttccttcaacagactgtcaagactatggttgagaaaccttcccaggacaaatcatcaagagctctcaaggctgagctcaagtgcccccctgtgtcttttgggaattgag

SEQ ID NO: 5167 - DNA, 296 bp, Homo sapiens
aaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacgggcttacatcctcattactattctgcctagcaaactcaaactacggacgcactcacagtcgcatcataatcctctctcaaggacttaaactctcctccc

SEQ ID NO: 5168 - DNA, 100 bp, Homo sapiens
ctcgtgccgaattcggcacgagggtcgatggagtcgaagcgctgaagggaatagggcggctttccttccagcggagcatcattcggctgttacccaaaac

SEQ ID NO: 5169 - DNA, 173 bp, Homo sapiens
gtttttttttggtggggcggggggcggtaatagggtctcgctctttcaccaggctggagtacagtaatgacttctaactgcagcctccacctcctgggctaaaagtgatcctccaacgtaaagcctctcgagtagctaggactacaggcacatgccaccaccaaagcccacgc

SEQ ID NO: 5170 - DNA, 340 bp, Homo sapiens
cacgaggcttcgggagccgcggcttatggtgcagacatggccaagtccaagaaccacaccacacacaaccagtcccgaaaatggcacagaaatggtatcaagaaaccccgatcacaaagatacgaatcttttaagggggtggacccaagttcctgaggacatgcgctttgtcaagaggcacaacaaaagggcctaagaagatgcaggccacaatgccaggccatgtgtgcacgtgccgaggctatcaaggccctcgtaaagcccaaggaggttaagcccagatcccaaagggtgtcagccgcaagctcgatcgactttcctacattgtccaccccaagct

SEQ ID NO: 5171 - DNA, 206 bp, Homo sapiens
acggccattgctctcaccattggggaatctgaagagtcttggggtatatcaagtccatgaaggaatcctgagagtggctacaggacttaaaaagctgaatcctaaggcttgttctctgagtaaaacatcctgttaaggcaacttacggtgaaggataccccgcgccccagagacactcgccctccatatccagaggtacacacgtg

SEQ ID NO: 5172 - DNA, 150 bp, Homo sapiens
ggaaagccggttagtacgcaaaggaaatgcatcctgggggtttggggctttctagaggccggggctcttggttgtaggatagatacttggggatggttcttgaaacatcagaggttaggccttgagccccaaatcttaggttcctaacta

SEQ ID NO: 5173 - DNA, 201 bp, Homo sapiens
agaaggccctgaagctgatggggtcaaatgaaggtgaattcaaggctgaaggaaatagcaaattcacctacacagttctgggaggatggttgcacgaaacacactggggaatggagcaaaacagtctttgaatatcgaacacgcaaggctgttagactatcctattgtagagtattgcaccctatgtacattggtgggtcc

SEQ ID NO: 5174 - DNA, 163 bp, Homo sapiens
gaagcatcgttaaagtctctcttcaccctgccgtcatgtctaagtcagagtctcctaaagagcccgaacagctgaggaagctcttcattggagggttgagctttgaaacaacttatgagaggccttaggagccattttgagcaattgggaacgctcacggact

SEQ ID NO: 5175 - DNA, 172 bp, Homo sapiens
gctacatgaccatcacctcggagcggaggtgcccgctgacgtgttccagatccaggcgacctccgtctaccccggtgcctacaatgcctttcagatccgtgctggaaacttgcagggggacttttacattaggcaaatcaacaacgtcagcgccatgtgtggtcctctgccc

SEQ ID NO: 5176 - DNA, 201 bp, Homo sapiens
ggagcgcatagtcagcggtgagaagcaacacctgagcctggttaacttagagccccaatccacctatcggatttgtttagtgccactggatgcttttaactaccgccgcggtagaagacaccatttgttcagaggccaccacccatgcctcctatctgtaacaacggcagcgaacacagacgtgccagccatgagcagacg

SEQ ID NO: 5177 - DNA, 222 bp, Homo sapiens
gctgtgttcactcaccaggtacctgcagaaggcctacagggtgccaggcacttctttaatgtgttctttctttatgtgattatttgattaatctctgcctcccccactagactttaagctccctgaaggcaagaatcctgtgcttatgctcaatattagctctcccttggcacagagtaggcactcaacaaatgctccccaaaaggctgtagtggctctact

SEQ ID NO: 5178 - DNA, 211 bp, Homo sapiens
ctcgtgccgaattcggcacgagctaggcctctgaggaggcgaatccggcgggtatcagagccatcagaacccccaccatgacggttggcaagagcagcaagatgctgcagcatattgattacaggatgaggtgcatcctgcaggacggccggattttcatttggcaccttcaaggcttttgacaagcacatgaatttgataccctttgact

SEQ ID NO: 5179 - DNA, 180 bp, Homo sapiens
acaaaaagtacctgatgatcggaagagtatttgaccaaagagcttctggccctggattcagttggaccccgagggacgagccgatgttcgtcaggccaggagagacggtttcaggaaggttcagaccattttgggaaaacttggaccaggaagccattgattttccaggtctaaggtcag

SEQ ID NO: 5180 - DNA, 111 bp, Homo sapiens
ctcgtgccgaattcggcacgagttgttccttaagtcagaacagcagacttaagctctgacaattctgattcgaatgacaactgttcagggattcggaatcctgtcgattag

SEQ ID NO: 5181 - DNA, 221 bp, Homo sapiens
agcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaagtagaaatttaattgcccaaaaaactgaagagtcagctgatgccagaggaaagccgaaatgctaca

SEQ ID NO: 5182 - DNA, 181 bp, Homo sapiens
  misc_feature 169: n = A,T,C or G
ccgcggcgcgccccctcgccaaaggtgggtcttccgggatccgtatcggtttaagaagcggacggagctgttcattgccgccgagggcattcacacgggccagtttgtgtattgcggcaagaaggcccagctcaacattggcaatgtgctccctgtggcaccatgcctnagggtacattcg

SEQ ID NO: 5183 - DNA, 203 bp, Homo sapiens
gggagaggaatggaagtccaaagagtgggaggaatttgatttcagaaccatctccagctgacccttgagccagcaaggacagggagaagggaagagcaagaacacgaagggcctcaagcaccgggatgcctttgccagccttagataattcccagagcgcacagggccctgcaggttcctgggtccttcttccaaggaagggg

SEQ ID NO: 5184 - DNA, 140 bp, Homo sapiens
gccggctccagtcccggcaagccgccgcgcctggtgggaggccccatggacgccagcgtggaggaggagggtgtgcggcgtgcactggactttgccgtcggcgagtacaacaaagccagcaacgacaattaccacaagcc

SEQ ID NO: 5185 - DNA, 145 bp, Homo sapiens
ggcaattgccagaccttctcatcttccactgtcatctcctactccaatacgggtgatggtgcccccaaggtctaccaagagacatcagagatgcgctcggcaccaggcgggatccgggagacacggaggcctttttcgggattca

SEQ ID NO: 5186 - DNA, 185 bp, Homo sapiens
gccgcgtccagtcaaggaaactcttgagggaaattttgagtcactggaccttgcggaatttgctaagaagcagccatggtgggcgtaagtgtttcgggcaggaatctggacctccagcagaaaagtttagcgttggcaacccagcttttccattggaggtttcattggattggtcgcacaggttt

SEQ ID NO: 5187 - DNA, 140 bp, Homo sapiens
  misc_feature 45: n = A,T,C or G
tacatagtaggtatatatatttatgggttacttgagctattttgnatacaggcatggaatgaaccaataatcacatcaggggtaaattgggtatccctcacctcaaacatttatcttattttttagggtgagaaaattac

SEQ ID NO: 5188 - DNA, 172 bp, Homo sapiens
tagtccaagcgggaagccctggtgcggtgggcatgatgggtcctccaggactcctgggcccctgggtacccaggcaagcagggcccccatgggcaccctggccctcggggcgtttcctcgggatcgtgggaaccgtgggtcagatccgcaacacaggggcccaagggaaaac

SEQ ID NO: 5189 - DNA, 305 bp, Homo sapiens
tgcacggtgcagttgactggaacagaaaataaggcattattcatattatagtctagaagcatggtgtcaaggaaaggtcgcctattaataaaattttatgtggatttgaaatgtaattcttttgattcttaaagtgggaatatcattcttttagctacagtattagctactttaggaggcccaatacaattttgtgcatttcctactttttcctttcaccctccttggtccaaatgacctgccaaggattaaattaattctacctgtatagggaaaactctgtatctaatttcctatcttaatat

SEQ ID NO: 5190 - DNA, 270 bp, Homo sapiens
ctcagcccgactgacttgctgcgagtgctggtggagctcacagacggcggctggtggatggtggacttttaacctcactttccctatgttcagcagcacaaaggggaggaggccaccacatcagcccaggagccctgagccagcacaggcagtagggccactcactttggccatccgcacccaaatgcaatcaatcacccaagcttcgggagctaaccttaggtctcgtcaattaactgctaagagccatcaactggctaaagaagggtc

SEQ ID NO: 5191 - DNA, 339 bp, Homo sapiens
cgttcttggcgtcgggaccctacctgacccatcagcaaaaggtgttgcggctttataagcgggcgctacgccaccttcgagtcgtggtgcgtccagagagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttcctgactctcctgggggcacctcctatgagagatacgattgctacaggtcccagaatggtgcttagatgactgcatccttctgagaggcaatgtatc

SEQ ID NO: 5192 - DNA, 280 bp, Homo sapiens
gacgccctctcggggcctgtgccgcactagcctccctcttctctgtccccatagctggtttttcccaccaattcctcacctaacagttactttacattaaactcaaagcaagctcttctcctcagcttggggcagccattcgcctctgtctcgtttttgggaaaccacggtcaggaggccgttgcagacataaatctcggcgactcggccccgtctcctgagggtcctgctggtgaccggcctggacctggccctacagccctggagccgctgctgacca

SEQ ID NO: 5193 - DNA, 280 bp, Homo sapiens
tctacatataatatattcgatagaaatgaaaatcttccgttgaattaactaataaggaggaacaataaacttcatatttaggattcaaaggctataaaggataattttacaagatccccaatatcaacccccagttaaaaagtgttaattttaaaccaattttaaaccaaggcctttttaatttcaatcagaggagccaaacacacacttggaccatgtgtggatttcccaaaaaatattgaagggagatccccccagggacaacccactaattttaaaa

SEQ ID NO: 5194 - DNA, 110 bp, Homo sapiens
ctcgtgcgaattcggcacgggttcaaaaggcagctcttccggaagcttctccaaaaaaaggaacctgggtctaaggggtcctcttcttcctcttcgctgctcgctcgctc

SEQ ID NO: 5195 - DNA, 190 bp, Homo sapiens
ggttgctgccgaaatgggcaaggttcatgaaacctcgggaggttggtgctcgtcctggctggagttactccggccgcaaagctgtcatcgtgaggaccattgatgatggcacctaagttcgcccctcagccatgtctctggtggctggaattagcccgctacccccgacaaagtgacacctgccatgggc

SEQ ID NO: 5196 - DNA, 260 bp, Homo sapiens
ccaagaagacccgtgtgaagctgccctgcggctacaagaaggatatctctcaggcaacagagctggtggttggtgtggtcggctgaaggtcggccgattgacaaaacccaaccttaaggcttggccggggcgtacccacaatttatagggcaagaggggacctcttgcccacgagtcacgggggtgtggccatagatcctctggagcatccttttgagagggcgcacccaccagcatcatcggcaagccctacaaccatt

SEQ ID NO: 5197 - DNA, 255 bp, Homo sapiens
gttagtccaaagaggaacagctctttggacactaggaaaaaaccttgtagagagagtaaaaaatttaacaaccatagtaggcctaaaagcagccaacaattaagaaagcgttcaagctcaacaacccctaacctaaaaaatcccaaacatataactgaatcctcacacaccatttggcccatctctcaccctctagaggactcatgttaggggtaaaggaacacaggaacactactcctcccggataaagctccg

SEQ ID NO: 5198 - DNA, 215 bp, Homo sapiens
gacacgtactacgttgtagctcacttccactatgtcctatcaataggagctgtatttgccatcataggaggcttcattcactgatttcccctattcctaaggctacaccctagaccaaacctacgccaaaatccattttaactatcatattcatctggcgtaaatctaactttctttccacaacattttctctggctatcccggaatgtccccta

SEQ ID NO: 5199 - DNA, 210 bp, Homo sapiens
gcagttcttccccactgatgaggacgagataggagctgccaaagccctgatgagacttcaggacacatacaggctggacccaggcacaatttccaggggggaacttccaggaaccaagtaccaggcaattcttagagttggattacttcttttgggattggcccctcggctcacaattagggggactattatcatacgggtttttgtgtg

SEQ ID NO: 5200 - DNA, 250 bp, Homo sapiens
gaaaattactcagagaggaggactttctaattgtaggtcgggccatcttctttgttaccaagaacttccttttcaaagccaattggaacaggagccgggcttccaattttggtgttggtattgttgattgcttggcccacgacaaaagtgaagaaggtttaaggctttccgagagattaaggattcaaacatttccttacatcaccattgagggttcttgctgaaaattgagaggcagttatgtggtgga

SEQ ID NO: 5201 - DNA, 150 bp, Homo sapiens
aaaacctgggcctcctggtgatgcaggattgcaggggttaacaggtgtaccttggattccttgtgcaaagggtgttgcttggtaaaagggtaggacaaggtctctccaggaaggcttggtaagttgggaaatttaaggaaaacccgggcc

SEQ ID NO: 5202 - DNA, 235 bp, Homo sapiens
ctccaaaaatagatcctgaaaggcactttctgcttagggcaagcagtcatggaataagcatgtaaacaagctggcttctctttaccacaacagccaagtcagctttcttcattgccagccgaaccagctctttcccttccttcttttaaacacgaccaggccccctgtatggctaacccaaagggttttctgtacggcacacctggccctcctctgggatgctctggacatagtg

SEQ ID NO: 5203 - DNA, 198 bp, Homo sapiens
gttccggagagctgagcagtcaagatgtgtgacttcaacgaagaccagaccgcagagttcaaggaggcctttcagctgttttgaccgaacaggtatggcaagattcttttacagccagatttggggatgttatgagggcccttgggccaggaaccctaccaaggcgaaggtctcaaaggttccggggaacccaaagag

SEQ ID NO: 5204 - DNA, 180 bp, Homo sapiens
gaatgtgggacccagcccctctccagctcgaaatcggcagactaggatggaagttccctgttgagctttgggggcccttcaaaagggccaaggaggaaaccgaggccgagggacccaccttccaaattggctttaagctctcaattaacctcccttgcgccccttggaatatgcttggaa

SEQ ID NO: 5205 - DNA, 210 bp, Homo sapiens
gcagcaagagcaaggagaagaaacacatcttggtttggagaaaccatcaatggtggcttccatttcagctatggagattacaatcttgcttccaacaattccaacgttcagagtgtaaccttctaggctctctggttcaaggaaaggtttccaggaacatataactctacacattcaaaggacagagattgtctcatatctgacgcggag

SEQ ID NO: 5206 - DNA, 215 bp, Homo sapiens
cactgtgatcaagaattcggcacgggagaaaccctgtctctactagaatacaaaattgctggtgtgctgtgcatcctgtaatctcagctacttggaggctagacaggagaatccttaacctggaggtgaggttcagttagtcgagatcatgccattgcacttcaccttggcaacaagagttaacttcctcttaaaaaatattagagataaaaaat

SEQ ID NO: 5207 - DNA, 228 bp, Homo sapiens
ctggcccaaggtgccaccccctagcaccttgtcaggctgtcccttgctggggaaagtggcttggttccccatcttctcgccagctgctgatccctacacgggcaggacagattggcagcttcaaattagtcttgagcctctaatcttccattaggctaagcttgggtctctgtcgcttcttccccaggttccccttggtccccccccaatgggccttccctatgtgcc

SEQ ID NO: 5208 - DNA, 205 bp, Homo sapiens
ctgagaggagcgtggctgtctcctctctccgccatggcgtgtgctcgccactgatatcggtgtactccgaaaagggggagtcatctggcaaaaatttcamtttgcctgctgtattcaaggtcctaatcggccagatattgtaaccttgttcacaccacttgcgcgcaaaccaaccagagagcctaatgttgtagagtgattgggc

SEQ ID NO: 5209 - DNA, 217 bp, Homo sapiens
ctgttattctagagatttcaaaatgcatcttcatcttaaagtctaatgtaaatttgtattattttccacttcttgaaccaatgcaaagatctcagaatactgaggttaccgcctcctgatacacacactattcattctttaatcccatatgtatttggagcccagattttacttatcttatacagccaatgtttatttccaattacccacaaattaa

SEQ ID NO: 5210 - DNA, 323 bp, Homo sapiens
tcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtggcagggacggagccggactggacatggtaactcagtaccgcctgcagtgtcgccatgactgatcatggctcttgcatttttggggaaatggagactcccggatcctgtaagggtgtccccatgtctggaagaggagctggtggctccaccctgggccccgaaaaggctgggctttcccttt

SEQ ID NO: 5211 - DNA, 313 bp, Homo sapiens
tggcttcgttctggcccggctcacttctggagctgtgagacccaagacaaaaggggctgagggatttctcattgacaagagttcgtgcgggaaaaccacctgatccctagggatttgtcatcttaagactcaaaagggcttaataccaggacccaccttggcaagatatttacccaccggccatctctgtttactcatgattgttaaatgttaaagcgcagcgctctaaccctgcatattatttacttgcaaatgtctgtaatctgtaattgtgatgcctctcatggaagtaaatatcttttgcagtctctct

SEQ ID NO: 5212 - DNA, 368 bp, Homo sapiens
caggtcgacactagtbgatccaaagaattcggcacgagcactggcgaaatttttgctgacattgatgccatcctcggaaaagtataaagagtatccttggactggacatctttttaaccaggagagaattttttgatgtttcctggaccagggggtttggaatgacccccaaatatgttaggtattggccacctttggcctcaacctgggaatcagcaagtaactcagatggccctctggggtatcatggctgctcccttattcatgtctaatgacctccgcaacatcagccctcaggccaaagctctccttcaggatagggcgtaattccatcaatcaggcccccttggcaagcaagggtaccacct

SEQ ID NO: 5213 - DNA, 260 bp, Homo sapiens
caagcattgggccaagactggcagacacaaagcagggaaaattcaagtgcaagacacattacatttcaagctagtacagactggtttgaaaactgtaagaggattcatcctctaacctctaaacatacaatttttgatgtgcctccaaaaattatatcatggatatttgaggtcgattgtgagagctacctcctccagcagggtttttgatatggactatctcactttatttgagagtttatatagagatgtatgatatc

SEQ ID NO: 5214 - DNA, 300 bp, Homo sapiens
gttttggagaaaccatcaatggtggcttccatttcagctatggagatgacaatctggctcccaacactgccaacgtccagatgaccttcctacgcctcctgtccacggagggctcccagaacatcacctaccactgcaagaacagcatttcctatctggacgaggcagctggcaccctcaagaaggccctcctcatccagggctccaatgacgtggagatccgcgcagagggcaatagcaggttcacgtacactcccctccaggatggctgcacgaaacataccggtaggtggggcagtc

SEQ ID NO: 5215 - DNA, 185 bp, Homo sapiens
gtcgcacccactgtgaaagttggaatatgtgggtctccctsgcctcagggctctgactctgccaggggttgggctctctaacccacaggttgttggctgcctggcccatgtgcccactgtctcttccacttgggctggggttggcagggactgctcctacttgaggggccaggatgctcccccca

SEQ ID NO: 5216 - DNA, 220 bp, Homo sapiens
cccgagaagccgacccagaatccgaggcagtgagggcagcgtagaagagagaaacccagcagatggaccccaataatccaaggggagggtggaatttgaaggaggccgagcaagttagagaagaaaatttgccacatgaaaatggaggggcaaaaccaaagtatccaaaagccggagataccagagggggaggaccatctggggatggcaggaatccagc

SEQ ID NO: 5217 - DNA, 225 bp, Homo sapiens
agaagcattaccaataggaatggatcgatagttgaataatgatttttatacatagatatataacatacagccaggaaacttaaattacttttcttttaaaatatctcacaatttatgtggtatttttaaagactgatcttagaccagtcaaattcccatttatcatttagttattttttgaggtgagagaataatttgtacatattatttagacctctgatattt

SEQ ID NO: 5218 - DNA, 185 bp, Homo sapiens
attcaagtagcacattggtataggtatcagagcagtctagagacaattcatgtcaaaaaatgtacattcatttttagggtggataaaagtaaacatagagattatgttatggctaaatacagatagtgggtaaccttagatttatattagctagcatctaatttgcacacctagaccacatccca

SEQ ID NO: 5219 - DNA, 220 bp, Homo sapiens
acaacttcacaagttgttcttgcccataattttgcccacaagaaaaattaaacttgactttgcttcttcttgcttgttctttaacttgttgataaataattattttttttttaaaccggcaattttaacaaaaaaggggggggggggaaccatttctttaaaattttttaaaacctatagggagtttatttgttatttttgcaggtgtcaatatttgtat

SEQ ID NO: 5220 - DNA, 200 bp, Homo sapiens
gtcaaggcgccaaaatcaatgagatccgtcagatgtctggggcgcagatcaaaattgcgaacccagttggaaggatctactgataggcaaggtaccatcacttggatcttcttgccagcattaggccttggcttaatatcttatcaatgtcaagcttttccctggaggacggggtgcactgggagcacgctaggacacat

SEQ ID NO: 5221 - DNA, 308 bp, Homo sapiens
gcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaagctggaagatggccctaaattcttgaggtctgg

SEQ ID NO: 5222 - DNA, 160 bp, Homo sapiens
gacatttgtctatatttttcatgtatctttggctgatatcagggtattactggcctcacagaattacctttgtaaggtcttccgttcttccttatttttccataataccttgaagggattggatttaggtctcttaaattggataaggaggatttcaggc

SEQ ID NO: 5223 - DNA, 110 bp, Homo sapiens
tcatgtactacaagtttagtggcttcacgcagaagttggcaggagcatgggcttcggaggcctatagccgcaaggatttaaaggcctgtggtttccacaagagcacacaa

SEQ ID NO: 5224 - DNA, 151 bp, Homo sapiens
taagtggctacagggcaacaagactatccctgtgccaaataccagattccaaagaaactctacccacgtcacaaacctgcacgtggatcccctgaatctaaaattaaagttgaaattatgaataaataaaggcttgcaattagggaagggg

SEQ ID NO: 5225 - DNA, 265 bp, Homo sapiens
cgccgctccggctgcaccgcgctcgctccgagtttcaggctcgtgctaagctagcgccgtcgtcgtctcccttcagtcgccatcatgattatctacccggacctcatcagccacgatgagatgttctccgacatctacaagatcccggagatcgcggacgggttgtgcctcgaggttgaagggaagatggtcagtaggacacaaggtaacactgatagactcgctcacatgttgagatatctccccttaaggcccccggacgaag

SEQ ID NO: 5226 - DNA, 327 bp, Homo sapiens
ccctcacaggcagtagattctagaaacaagtgttctgtttgttctggagtgcttttatatttggtggagtgaaatgcattccggatttctgatgatagttttttagtctgttggtttagttgcttgtgacagattaatttttttctacttcatcatcatatacagtcttagattctgagcaaggaggagagcttagagactgccttgctaatttttatcttcataaatattttcttttttctgaatctaatcctagcactgctttatgtacctccttttttcagctaccctctcttttctggtagcagaagaaacagaaaccttacc

SEQ ID NO: 5227 - DNA, 290 bp, Homo sapiens
gctcgtgccgaattcggcacgagggaaaaggggtcctggtacctggtgatgtcaaagtaggcagcttctacttctgttctagcaagagccatgttgactagttttagaacaggaacttttccaagttccctacttggtaaccagatacccaacagtgtgtctagagattctttagtgcactccaatcctctaatactatctacatatgtgctatatgtgtccctgtaaaacacgccatatatcacatcatattttttaaaaatcatatacaaattttttgcgctagggta

SEQ ID NO: 5228 - DNA, 280 bp, Homo sapiens
taaatttaaggggaagctctatgtaagggagacttagagccaaactgtttaagcctgtatccaaccaacaaaggattccttcatggaaccgggcaatcaattaggcttaggatttcttaggattaaatttagggaaaggtaagctctcttagagagcgacaaggttcacacagcacacactcttacacacatgtgtcacatttgagattgactctcacattacacatttgagcgccacacatgtgatatacaggtcttctacacatactgctgagaggat

SEQ ID NO: 5229 - DNA, 188 bp, Homo sapiens
atagcaagtgaacatgtcgtaaatataaaggttcaagtgatgtattgaaaataattttctaactgctttgtatgtatcacatactctaaattgcacagtagggcgtgtttaataaacagatgaattggctgggaaaggtttcaaaataggctcatgatttacagaatcggtccatatacctgctcrcy

SEQ ID NO: 5230 - DNA, 147 bp, Homo sapiens
gtccggcccctccatcgttccaccgcaaatgcttctaggcggactatgacttagttgcgttacaccctttcttgacaaaacctaacttgcgcagraaacaagatgagattggcatggctttaattgtttttttggtttggttttggg

SEQ ID NO: 5231 - DNA, 210 bp, Homo sapiens
agactggtcttaaactcctgggctcaagtgatcccctgccttggctcccaaactggtgagattacaggcatgagcaacacacctggcctgaaattcttaaaggatggagttccgatgcaagcacttggcatggtgtccctaaccttggagacaggaggaggcaggcaatgggaggtttttcacattggggcacaggctctatgtttttgg

SEQ ID NO: 5232 - DNA, 265 bp, Homo sapiens
aggtygacactagtggatccaaagaattcggcacgagctcacttctctggttacagtgctgggccatgggtaacttacaaggcttagcaggaacctgtctgcgcacttcccctttcctgccactaacttgtttccctccagttgcgagagaaaacattgattgagccataactatgtgccaagcttgttctaaggtccttgcatgtattcactcaaacaatccttacaacaattctatcacattcccctttcacagagaggggtc

SEQ ID NO: 5233 - DNA, 190 bp, Homo sapiens
ccccgcttcatcgccgtgggctacgtggacgacacgcagttcgtgcggttcgacaacgacgccgcgagccagaggattgagccccgggcgccgttggatagagcaggaggggccgagtattgggaccaggagacaaggaatgtgaaggcccagtcacagagcttacccagttggacctgggaaccttcgc

SEQ ID NO: 5234 - DNA, 285 bp, Homo sapiens
ctgtatttatagtaaccattttcctttggactgttcaagcaaaaaaggtaactaactgcttcatctccttttgcgcttatttgggaattttagttatagtgtttaactggcatgggataatagagttggagttttatttttaaggaaaattcacaagctaactttcactaatacattatccctaatttattgaaatgtataaattgactcaactcgagagaagggtctcctckgggrgtatgttgtcataacacattaagagatttcccttcattaaactcaata

SEQ ID NO: 5235 - DNA, 350 bp, Homo sapiens
gcctgctgggaacgggacttctaaaaggaactatgtctggaaggctgtggtccaaggccatttttgctggctataagcgggggtctccggaaccaaagggagcacacagctcttcttaaaattgaaggtgtttacgcccgagatgaaacagaattctatttgggcaagagatgcgcttatgtatataaagcaaagaccaacacagtcactcctggcggcaaaccaaacaaaaccagagtcatctcgggaaaagtaactcgggcccatggaaacagtggcatggttcgtgccaaattccgaagcaatcttcctgctaaggccattggacacagaatccgagtgatgctgta

SEQ ID NO: 5236 - DNA, 336 bp, Homo sapiens
cattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctgggcgacttaggaagattcgggcccatagagggctgcgtcacttctggggccttcgtgtccgaggccagcacaccaagaccacttggccgccgtggcgcaccgtgggtgttcacgagaatagtctttaggcctgtctgtaataaatagtg

SEQ ID NO: 5237 - DNA, 285 bp, Homo sapiens
taatacctattagtattagtagatgaccctaatggcaactaacaggaaacttcagaattcaaataattaggcttctttggagaacacagtttaaaaatatttaataagaacaaagatccttaaagagtagtattttcaatattctagtgctcattttagcatatttttatatcatcacatacaacatttaaaaggcaccatatctattaaaccacagcctacctagctttatgctccaaaatctcttgataattacagagttagtaaattattaacacatatata

SEQ ID NO: 5238 - DNA, 190 bp, Homo sapiens
gggatcccacatcctcgctgttccctgtccccccgcaacatcccccaccaatacctttctgaagttttctagtccctcctttttgtttgtgctccttaaagcccagccccatgcctgactttggttcccagtgagcattgtacatttgtggrtattaaatctttggcaaagtcatttacctcgggctgga

SEQ ID NO: 5239 - DNA, 310 bp, Homo sapiens
gacactagtggatccaaagaattcggcacgagctggcaggaaactcacaaaaaggagaactgaaaatttagacatacagttggccattgtaaaaaacatcagtttcctctcatacattccaaggtaaaccaagtaaaataagtgttggagtaacacttgcataaaagaatttaaggagtgatagctctttctgttctgccattcccaacattcctgggggaaaggagactcaatgagttaatactatttcactgagcccaagatagaaactttgggttgacctaaaacatccttattatatagggtagct

SEQ ID NO: 5240 - DNA, 195 bp, Homo sapiens
cacaagcacagggagatgcgtgggctgacatctgcaggccgaagagccgtggccttggaaagggccacaaggttccaccacactattggtgctcttgccgggcagcttggagaaggcgcaatacttttcagctccaccgttaccgctaatataaggaaaggttgtaaaatcatacttaatatacaatttagggca

SEQ ID NO: 5241 - DNA, 210 bp, Homo sapiens
ccactccctgcacgcctgccgtccctgccccgctgggcagcccttcagtgtggctggcgttggggccagtgagttgcctctttccctccttgtctggccccagtggtctggggagccccaggcaccactaagcgtcgtggaagacctgttccgcacaaacctgcatactgaacccgggaaggctgggcaagtgggaagccagagacccac

SEQ ID NO: 5242 - DNA, 260 bp, Homo sapiens
ggactggggacacagggatagctgagccccagctgggggtggaagctgagccagggacagtcacagaggaacaagatcaagatgcgctttaactgagaagcccccaaggcagaggctgagaatcagaggacatttcagcagacatctacaaatctgagggacaaaacatggttcaagcatctgggcacaggcggtccacctgtggctccaaaatggtctcccggtccctgatagcaaagataccagggaatatgtgcgcg

SEQ ID NO: 5243 - DNA, 225 bp, Homo sapiens
gtgccctgcctccaaccccatcctacacttccccagggcgtgcggggctgtgcagacttgggtgccaggcatcttcttcccacccggggtgtccccacatgcagtactgtataacccccatccctccctcggtccactgaacttagagcagttcccattcctgccccgcccatctttttgtgtctcgctgtgatagatcaataaatattttattttttgtcctgg

SEQ ID NO: 5244 - DNA, 210 bp, Homo sapiens
gacactagtggatccaaagaattcggcacgagccaaggcaaaaactaccttytgacttgggttgaggctgggttcccctctattgttcccctatcataagagctaggccaagcctatgggaccttgagtcatgcaggatgggatctttggtcaaaggacaggcgaggagctgtgggcgcagggcctgccgccactgtctacatcttctct

SEQ ID NO: 5245 - DNA, 154 bp, Homo sapiens
cgggggttcagcgtctctgctcccaagtctgtgtggtttccccctaacttcctgcgctgacccagggcctggagctaattcaagacaagctcggctacctggaaccttaggtaagggtacaggtcttgcgacaccttggggaccttggagaatt

SEQ ID NO: 5246 - DNA, 199 bp, Homo sapiens
ggccaaggtacagagagctgtgtgcatgctgagcaacaccacagccattgctgaggcctgggatcgcctggaccaaaagtttgacctgatgtatgccaaacgtgcctttgttcactggtacgttggggaggggatcgaggaaggtcagattttcaaagggccagtaaggacatggctgtcccttgagaaggattatgag

SEQ ID NO: 5247 - DNA, 209 bp, Homo sapiens
ttcaaattcagcggctttgattcagcaagccacaacagttaaaaacagggatatcaggaaatttttggatggtatctatgtctctgaaaaaggaacttttcagcaggctgatgaataagatctaagagttacctggctacagaacgacgatgccagatgacacttaagacctacttgtgaaatttaaatgatgcaataaaagacctatt

SEQ ID NO: 5248 - DNA, 181 bp, Homo sapiens
ctcgtgccgaattcggcacgagggtcaacgttacaacggtagtaaaatctgtcgaaatgcaccatgaagctttgagttaagcttttcccggggacaatgtgggcttcaatttcaagaatttttctttcaaggattttcctcgtggcaacctttcttgtcacaacaaaaattaccaaccaat

SEQ ID NO: 5249 - DNA, 150 bp, Homo sapiens
caggggccccaaggaccccaaggcgtgcccggcaccagcaaggacggccaggacggtgctcccggcgagcctgggccttccggagatcctggggcttccaggtcccagtggggcccaggggacaaccggggattttccggaaacctaaas

SEQ ID NO: 5250 - DNA, 137 bp, Homo sapiens
cgaggagtgtgggctgctgctctcctctgagggcgagtgtcagggctgctacccgctgggatgggcacatcttgtgcaagggccttcagcgccttggaaattccagggggctttaagtcaccgtcaccacttgactt

SEQ ID NO: 5251 - DNA, 296 bp, Homo sapiens
ttgatgttagtagacatttttttcttctgaaatttctaattatctttgttttatcccatttacaaaaagaagtatatagctatactctatcaaacacattattcctaaattatatcagttgctaattgaatctacttgtttctgagaatattcatttcagagcttctgactttctgctttaatactgatagacttttcccttttagagctgatataatctgtcatttacatcttatgtattacaaaggcagggagtatctgaagtaatatcaggagatagaggttatcatacatta

SEQ ID NO: 5252 - DNA, 290 bp, Homo sapiens
cgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctcaatgcccaccaaggtgactctgtggatatccc

SEQ ID NO: 5253 - DNA, 302 bp, Homo sapiens
gaacgtcatctccaaccaggagtgtaacatcaagcaccgaggacatgtgcgggagagcgagatgtgcactgagggactgttggcccctgtggcgtttgttgaggttggtggcagggcctgggcaagccctggaaggtatggggggctagaaatgaactattttatcatgaagcaggctagtcatggctgtcgccgggccctcatcagttcttctaccttccagagtgactacgggggctacttgcctctttaccacaactctgggtcctgaaggtattagatcccacttagtatttcaggcg

SEQ ID NO: 5254 - DNA, 290 bp, Homo sapiens
ggtttcaagtaaccacccagtcaaaagtactagaaactgtgtatcctttattcttattttaaagggtcaatgccttatgctttcagcactagctaaaggatagtcttttaaaaatgaaactaatgctgtcggctaggggctttttgctaaatctattgtttatttgaaggacttgattatttaatgagggcttattggagctattgtacattaattgctcttagcatggtaatccaatatttgatagggattgattatctttcatgggtacagatttttttttttttttt

SEQ ID NO: 5255 - DNA, 320 bp, Homo sapiens
cggtcccgagtcccgcatccatctgttgcggaacttgctcacagggctggtgcggcacgaacgcatcgaggcaccatgggcgcgtgtggacgaaatgaggggctacgcggagaagctcatcgactatgggaagctgggagacactaacgacgagccatgcgcatggctgacttctggctcacagagaaggatttgattccaaagctgtttcaagtactggccctcggtacaaagatcaaactggggctacacaagaatgctgcagatccaaatcggagtttggatcgggccagatggcagtgatcgagtataagggaatt

SEQ ID NO: 5256 - DNA, 321 bp, Homo sapiens
ccaacatgggccgcgttcgcaccaaaaccgtgaagaaggcggcccgggtcatcatagaaaagtactacacgcgcctgggcaacgacttccacacgaacaagcgcgtgtgcagggagatcgccattatccccagcaaaaagctccgcaacaagatagcaggttatgtcacgcatctcatgaagcgaattcagagaggcccagtaagaggtatctccatcaagctgcaggaggaggagagagaaaggagagacaattatgttcctgaaggtctcagcctgggatcaggagattattgagtagatctgacactagaatctgagc

SEQ ID NO: 5257 - DNA, 313 bp, Homo sapiens
gcgtttatcactgttgggtggagtcacgtcccttccctccaccgaagtcatcaaccagatagggaagggaaagatgaggcccagaaaacgagttcaaactctaggtcttgtacacgtatgtaagtaaatgtcaataacccaagcctttgtcatagcagtcacttggttgacttaggatctgggtctgttgaattttgtgcttgggaatggagctggagggagtggggctgtgtacagcagctacctctccaggtctctcacttgcctcccgcgtcctggttgcatggcgaactgtttttcagagtctgtgtcc

SEQ ID NO: 5258 - DNA, 214 bp, Homo sapiens
gttattctctagaaaatagtatttaaagacattttatgaaatcttcattgtcaaaacctttaataaaagtggaaatattttgaaatgcctttttcttgatacactcatccacgtgttgctgattgtccacatttcatgataaatgagagctctgcagagaatgttagcctgtctgttgtaattgtaatcttcaggtaggcacttctttgttaag

SEQ ID NO: 5259 - DNA, 197 bp, Homo sapiens
aattaccgacgctagacgcccagaaaaccctaaactacatgatggcaaagagacaaaagcagccgatccaccagctgagaattcgtccgctcccgaggctgagcaggcgggctgagtaaatgccggcttaccatctctaccatcatccggtttagtcatccaacaaggaggaatatgacattcccagcaataggaca

SEQ ID NO: 5260 - DNA, 216 bp, Homo sapiens
cgcattacttgcttcctgaagagttcccccattcatccatttgttcccattagttgctgcggattatcaagtttttgaaggactgtacatccgaacagacttaagcaggtcgtaaggtgagctggtgtatactccatgtagctggtgagcttttggaggtttggagcttgaagagaattgctaagaagatttgaattatagggagggaacagaaat

SEQ ID NO: 5261 - DNA, 186 bp, Homo sapiens
aatgtttcttttgtataaattcctgtcctgaaatattttattcatgaaaataaggtaagcaaaaaccaactccatttttgccaggatttttgttgtttcttagatttgccctattacggggtgaaacaaaaaggggttttttttagggttaaggacagatattttttacagaaaaaaagggttttt

SEQ ID NO: 5262 - DNA, 237 bp, Homo sapiens
acgtcccggagggcggggcctacctgcctgagcgcgagccctttcatcgtgccggtggagcccgagcggacagcggaatacgaggactacggcgcagagagcctgcagaggagcctcctgagccccaccggcgctggcggcggccctgccccacggacccgggcagtgaaccagagatcacgcgccggccggaggtttggggggaggtgttgaaattctcatttacaggtcagatag

SEQ ID NO: 5263 - DNA, 235 bp, Homo sapiens
cgtaggatgggtgagtcagatgattccattctccgattggccaaggccgatggcatcgtctcaaagaacttttgactggagagaatcacagatgtggaatatttgtcataaataaataatgaacgtcgtgccgaattcggcacgagcattggagaacctattgatgaaagaggtcccatcaaacccaaacgatttgctcgcattcatgctgtggctccagagttcatggatatga

SEQ ID NO: 5264 - DNA, 234 bp, Homo sapiens
caatcttttagacagattcccttttcagtaataataaagttaaactagaggaggtagagattaaatagaggtggccagtaagatttcaaattgtctatgctagtaaggcagcgattaaggcttgaatagaggcagtcacaccagtagttggaaaagtggatagttctcagagactgagagggatgtaccctgtaagagtaaagactccaaagagggataaattagggaatatat

SEQ ID NO: 5265 - DNA, 103 bp, Homo sapiens
tccaagttgcgtctttgttaactccttgacgcggaacatgttattagcctcctaggggggtactatctttttgcgcgactctcggtcctccttcttctgggct

SEQ ID NO: 5266 - DNA, 140 bp, Homo sapiens
ttagtcgcgactattctccaaagaattcggcacgagggcaagtaaggggatgggactagaggtccagtggggatgatgatcccttcatgatccacttaccagaatcgttgtggcctgaggctgtaaccttaagataaagt

SEQ ID NO: 5267 - DNA, 209 bp, Homo sapiens
gagagagagagtgagaactagtctcgagtttttttttaattatgaaatgtgaacctaaggttgtattctttgtagtcttgcagcagtttttgtggttaagaagagagctgtgattttgttgaggacacctaaagtgtattcatccctttcatgtataaaaggggaaaagttgatgagtaattggggcatctaacagtgagggaagagga

SEQ ID NO: 5268 - DNA, 229 bp, Homo sapiens
gagattatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatggccaaccccaaagtcagggcacatggcag

SEQ ID NO: 5269 - DNA, 126 bp, Homo sapiens
gaatggtactgttcaaaaggaatccccacaaggtttaccactgcaaaacctgaagagtctacacatgtacccagcattctttggcattgttgatacaacagttagggccaggattctgccaggaga

SEQ ID NO: 5270 - DNA, 231 bp, Homo sapiens
gaggaaatgcggagccgcgtggttctgggggagtttggggttcgcaatgtccatactactgactttcccggtaactattccggttatgatgatgcctgggaccaggaccgcttcgagaagaatttccgtgtggatgtagtacacatggatgaaaactcactggagtttgacatggtgggaattgacgcagccattgccaatgcttttcgacgaattctgctagctgaggtg

SEQ ID NO: 5271 - DNA, 209 bp, Homo sapiens
ccaacatgccatccagactgaggaagacccggaaacttaggggccacgtgagccacggccacggccgcataggcaagcaccggaagcaccccggcggccgcggtaattctggtggtctgcatcaccaccggatcaacttcgacaaataccacccaggctactttggggaaagtttgtatgaagcattaccactcaaagaggacccagag

SEQ ID NO: 5272 - DNA, 105 bp, Homo sapiens
gtctaccttaacatctcttgatttgagccactcccactgtcatcagctttcacctggattatcgtgacaggcctcctactgcttcctctatcatggtggccagag

SEQ ID NO: 5273 - DNA, 107 bp, Homo sapiens
aggtagtaatactatcattgaagttaatggcaaaagggttcagaggaaggcagtatccttgggggttttgcttgaaggtggaaaattggggaacaattgttaatttt

SEQ ID NO: 5274 - DNA, 170 bp, Homo sapiens
taacagactgccacttgagtgcgccttgcaggcactcccagagcagccatggaaggagctggccctcacaccatccacctccacactgcctcctggccagctgcccaccccagttccaggtgggagagggagcaggacaagccagccccttccaggtggcagtcggaagg

SEQ ID NO: 5275 - DNA, 224 bp, Homo sapiens
tttaggaatcaaaaactaaaataagtggaattatgtatcttttctaaagttaaaaaagtaaaatattttattatgagttattataaaaattggttaattgtataggragatgacagtatttttttcaagttatcataaaaagtgaattcagatgacatttgagaagtaggggaaagggaatcatgttaacagttttagttctattaacactaatttttgtgaag

SEQ ID NO: 5276 - DNA, 227 bp, Homo sapiens
tttttgtcctcattgatttattatctgatataagggacatataaggagacatatcaatctcaaaaattgttctcaaaaggttttattttttttaaccacagataatgaaacaaccaccatcggttaattttgatccaaaaatattgcatctacccgcaatttcagtgggtaagttatatatatctgaaagaccacagattgggatgccttttttgataacaagaggt

SEQ ID NO: 5277 - DNA, 116 bp, Homo sapiens
cggcacgagattccattagtctccattcaattccattaatctccattccattccatttctactccaactggattccattccatttctatttcctttccattccattccaattgcca

SEQ ID NO: 5278 - DNA, 300 bp, Homo sapiens
agcacagtgtgaatagaacagagcgggatcaagaatttcacagaagacaggtcagctgaggggcctgcacacacagggtgttgaggaaccacagatgggcgccgagaggcctgccttttgcctggcccaggctcacccccacccttgggcctaacctcctccaggaagccttccagcatcccgaagcgtaaggtggccttcttgcagggtcccgatgcaccctgagcctgtaccttgggtggaacttgttatgctatcccgtgctagccctttgtgccctgtgtcgctgtagagtgtgag

SEQ ID NO: 5279 - DNA, 280 bp, Homo sapiens
gctcccgcaaagaagggtggcgagaagaaaaagggccgttctgccatcaacgaagtggtaacccgagaatacaccatcaacattcacaagcgcatccatggagttggcttcaagaagcgtgcaccttgggcactcaaagagattcggaaatttgccatgaaggagattggaactccagatgtgcgcattgacaccaggctcaacacagctgtcttgggcacagggatatggggtgtgccataccgcgtccgcgtgcgcgtctccacagaacgtgttgtgg

SEQ ID NO: 5280 - DNA, 260 bp, Homo sapiens
ccgaagcaaggctgccatggaggaaaggtgaccctgcccatagtcaccaccttgggccgaagcatgcattgcccaacttcctgtttataggtgctgccacttaaagcaattccacttaactttcccaggagtagggcttcaatagagtttctctctgtccccaacatgagcattcagcagggtatacacagggtctctctctgtctctctatcacaagagtgtacactctcacatctctaggggctcagagcacagccac

SEQ ID NO: 5281 - DNA, 165 bp, Homo sapiens
ctagtctcgagttttttttttatttttttctggagacagagtttcgctcttgctgctcaggctggagttcaatggaacgatcttggctcaacacaattcctccctttcctgggttcaagagagattttttgaaccccggagagaaagagtttcacttagaccaga

SEQ ID NO: 5282 - DNA, 195 bp, Homo sapiens
cacgcctgtaatcccagcactttggggaggctgaggcgggtggatcacttgaggtcaggagttcgaaaccatcccagccaacatggtgaaaccccattttcttcttaaaataccaaaatttatcttgctttggtgcaagcgcctctttatttcacagtactctcgcacaggtttagagcacagagagatctcctt

SEQ ID NO: 5283 - DNA, 190 bp, Homo sapiens
gcacactcctggtttggaactttaatagcgttgcaacgaaatcctatatccagtttcctgtaatttaattgaaggaaaatacatgccaataaagactttattattaacagagccagatagcatcagagaatcatgtgtactgttattattatcagagatgtgctctaactcttttaggggcacagattaa

SEQ ID NO: 5284 - DNA, 228 bp, Homo sapiens
gttgaggtggtctgaatgttctgacattaacagttttccatgaaaacgttttattgtgtttttaatttatttattaagatgggttctcagatatttataattttattttatttttttctaccctgaggtcttttgacaagtggggagtgaatttgaatgaaaaatttaagcacatggttgcttattgttccccaggactgtcaattaagcgcattaaggttattcgcg

SEQ ID NO: 5285 - DNA, 180 bp, Homo sapiens
cttaattgtttaactcttaagattatttgtgatctggatttatgtatttgttagatacatacggattgttaaaatggaatgcaagtttttcaaaagcccaggtctaaatgtaatggttggttattgttctataaccccagcccatcaatttctgtgtgaaatcataaaccatatacagga

SEQ ID NO: 5286 - DNA, 194 bp, Homo sapiens
gcagcttcattttgaatgagggtcgctgtctgcccattgatagaggccagattgtcttggaagttccaaagttgcaacgatttctggctagtgccacgaggtttacttgactgttgtgtgaaaagctgataaggaaaccattccagaaaaaagctcttcgttttacaaacatgaaaataaaacatgtaattttg

SEQ ID NO: 5287 - DNA, 173 bp, Homo sapiens
gaaaattaggtctgaattcaagagaaagtacggcaagtccctgtactattatatccagcagaaactaagggcgactaccagaaagcgctgctgtacctttgttggtggagatgacttaagcccgacacggcctgagcgtccagaaatggtgctcaccattcttccagctatca

SEQ ID NO: 5288 - DNA, 138 bp, Homo sapiens
ccagtttttgctggatttgtacatagccattctagaaatagagttgagggaaattatccatatacatatcactaataggcttcttgggaattatttaggaaagcatttttaaacccggcaagtggtgacttaataggg

SEQ ID NO: 5289 - DNA, 111 bp, Homo sapiens
ccaatcttgaaacacctgcaggatattaaagtgaaattttctgaccctggacagcctatgtcttttgtgttagagttccacttttgaacccaacgacttactttaccaact

SEQ ID NO: 5290 - DNA, 110 bp, Homo sapiens
ctcgtgccgaattcggcacgagcttcaaccaggtggagatcaagcccgagatgatccggccactacctgggcgagttctccatcaacccaccaagcccctaaagcaatgg

SEQ ID NO: 5291 - DNA, 173 bp, Homo sapiens
aacacctctgattactcctgccatcatgacccttggccataatatgatttatctccacactagcagagaccaaccgaacccccttcgaccttgccgaaggagagtccgaactagtctcaggcttcaacatcgaatacgccgcagccccttcgccctattcttcatagccgaat

SEQ ID NO: 5292 - DNA, 300 bp, Homo sapiens
gtcaaatgttttctgaaaatctgagtaattcaaagcatgcctctgcccctttaatatttttaataacctgcattgttgctgtctgccaaatattaaattgaaatcttcatttcaattttattatctggaaagggcactggattgctctgcaaccaaagaaagcaatatggaatgaaaaaactcattcacttttgtcttattttctttttaaagtgtattggcatgtaatttgcatagagagggggctctcgtaagtctctcacattgaggctgtttagggaaatcctcattcagtttggt

SEQ ID NO: 5293 - DNA, 210 bp, Homo sapiens
ctcgtgccgaattcggcacgagcattactgggggcttcagtggaggaagtaatgctgagcctgcgaggcctgacatcacttaccaggcgcctcagggaacccagccagcacagcagcagcagccttgcctctatgagatcaaacagtttctggagtgtgcccagaaccagggtgacatcaagctctgtgagggtttcaatgaggtgctga

SEQ ID NO: 5294 - DNA, 310 bp, Homo sapiens
ctcgtgccgaattcggcacgagcgacggtgtcgcccgtgttttcgttggcgggtgcctgggctggtgggaacagccgcccgaaggaagcaccatgatttcggccgcgaagttgttggatgagttaatgggccgggaccgaaacctagccccggacgagaagcgcaaaaacgtgcggtgggacacgagagcgtttgtaaatattatctctgtggtttttgtcctgcggaattgttcacaaatacacgttctgatctttgtgcgtgtgaaaaaattcataatgtaaatctcagaaacagtgtgagagagctc

SEQ ID NO: 5295 - DNA, 300 bp, Homo sapiens
accagctccgaaatcaccaccaaggacttaaaggagaagaaggaagttgtggaagaggcagaaaatggaagagacgcccctcctaacgggaatcctaatgaggaaaatggggagcaggaggctgacaatgaggtagacgaagaagaggaagaaggttgggaggaagaggaggaggaagaagaaggtgattggttaggaagaggattgagattaagattaggaagcttagtcaactacgggcaagcgggcacttaagattattaggtttacgatttctataccagaagcagaagacccccg

SEQ ID NO: 5296 - DNA, 170 bp, Homo sapiens
gtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaaggttattgggaagta

SEQ ID NO: 5297 - DNA, 230 bp, Homo sapiens
catatgcttgtctcaaagattaagccatgcatgtctaagtacgcacggccggtacagtggaaactgccgaatgggctcaattaaatcagttatgggttccctttggtcgctcgctcctctcctacctggatgtggccagttttggaggtgctgaacgaggttaaccgaagggcccttgaagaagctggccagccaaggccgactcccaaggggcaagggtgacgcaccat

SEQ ID NO: 5298 - DNA, 116 bp, Homo sapiens
ctcgtgccgaattcggcacgaggagtacttctagagcggccgcgggcccactcgagttttccaccccgggtgggggtaccacggtaaggtgtaccccaattcgccctatagttagt

SEQ ID NO: 5299 - DNA, 280 bp, Homo sapiens
gtcgtctattccgtagaatcacatgatctgaggaccattcatggaagctgctaaatagcctagtcttggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatcttttaagagtccagtgtccatggaaacattccacatgccgtgactcttggactatatcagtttttg

SEQ ID NO: 5300 - DNA, 105 bp, Homo sapiens
atgaaactgaagaatattttcaattattggatataccaatgtaagcacccatattttccactctatctctgcctaggggaagagtgtgtttatatgtgcccctct

SEQ ID NO: 5301 - DNA, 317 bp, Homo sapiens
cttgtaaaaacctgaacccagaaacaacacaatccgttgcaaacccaaaggacccaaggtacttttccaatcttcagtcaccttagggcctctgcactgaatggctgacctgacctgatgtccattcatcccaccctctcacagttcgggacttttctcccctctctttctaggagacctgaactgggcagactgcaaaataaaatctcggtgttctatttatttatggtctcctgtaagacctcgggtcaaggcagagcaggaactactggtgtgagtcaaatgccccctgagtgactcccccagcccaggccaga

SEQ ID NO: 5302 - DNA, 190 bp, Homo sapiens
ggaagatgaccctgatgccctgaaggatcctctctatcagattgatctgcaggcatatctcacagatttcctctgccagtttgctcagcagccctgctacaaaatgtttttcaaggcaaccttatggcaatgaggggcggggtctcaagacctcggccactaaaaaggggaggccctcttcacatgctcc

SEQ ID NO: 5303 - DNA, 219 bp, Homo sapiens
ggcagtggaattgctttcctgagaatcattctgaggctgggctattgcttctcccttgcttcaaagaatctagcagcgggggataggattttgcaacaaaaagctgacccagaggccatacagagcagggatatcccattgccccctcctccactgggttcagagggtaagagagcacccttcaataaacccaggctccacggccgtggggggctgctg

SEQ ID NO: 5304 - DNA, 190 bp, Homo sapiens
tcgtgccgaattcggcacgagggtcgcgcggaggcggagctttggtgcgttcaagattcaacttcacccgtaacccaccgccatggcccaggaaggcatttcttctggaagggtaattgaccgtaatacttctttacaagaaggttcttaagacttccctcaatcacgattgcctagcacgtggagattt

SEQ ID NO: 5305 - DNA, 190 bp, Homo sapiens
ctcgtgccgaattcggcacgagccagagcttctgcccaactgtcaaccttgacaaattgtggactttggtcagtgaacagacacggtgaattcttctaaaaacaaggatggggctgctcccatcatttatgtggggcgcatcgggctactacaaagttcttgggaaagggaaggtcccaagcagccttca

SEQ ID NO: 5306 - DNA, 105 bp, Homo sapiens
tccgcgctcgcattgccacggaaaggccaaggaaggaggtaaggcttagaacaacgatcatattaatttgaaggttgcggggcaagatgggtctgtggggcagtt

SEQ ID NO: 5307 - DNA, 135 bp, Homo sapiens
actggatcctgatacagataaatgggttagatgcaataagatgccagtaaaggacacaacatacaggtatgctcagaatccccatcaagatgttaagacagcagtatattcaaatgtttactctttagtattcct

SEQ ID NO: 5308 - DNA, 137 bp, Homo sapiens
taacggccaggtcatcaccattggcaatgagcggttccgctgccctgaggcactcttccagccttccttcctgggcatggagtccttttggcatccacgaaactaccttcaacttcatcatgaagttttacgtggac

SEQ ID NO: 5309 - DNA, 134 bp, Homo sapiens
gaagaaactagagaaacaagaacaaaccaaacccaaatccagcagaagaaagttaataaccaagattagaacagggactaaattaaagttgaaaacaaagaatacaagatgaagggaaaacaagaagggcttga

SEQ ID NO: 5310 - DNA, 276 bp, Homo sapiens
cggcacgaggcagcccgtcctgcccctccacccacccaccaggtgcccagtgttcccaagggccccgaattccaacctttattcaggcgtaagatctctgcaccccaaatgcctgttagggaggatagtgaaggctgagccctcctgggctcatcaaaagccagcagtgagagaccacccccatctctctgaggtgacctcgtagggcagtccgtgctgtctggctggcctcggtgaggtggcagggacacggctggcgcctgggcctcgctggca

SEQ ID NO: 5311 - DNA, 135 bp, Homo sapiens
caagaccgcagtgcagagtgaaggtcaagctgttgcagcgcagatttcctccctgctgaggtttgccgccggtgaaggatgggagctacggagggaagggggtgttcctcggaaaggaaggtggggtttttaaaa

SEQ ID NO: 5312 - DNA, 125 bp, Homo sapiens
cgaactcatggccaatcttgttacatgtacactctacctacccccatatccaacccttgacaaccaagacgtagaatttcacttggaaatatttcagtatgtatcttcaaaagataaggcctttt

SEQ ID NO: 5313 - DNA, 205 bp, Homo sapiens
tcccgccaaggagcttcttcgttcctgcgcatatagactgtacgttatgaagaatacccaggaaggactttgtgactgtcacttgctgctttttctgcgcttcagtaacaagtgttggcaaacgagaactttctcctggcccctgcctgctggagatcagcatgcctgtcctttcgatctgtacctacctactctctcttgcctg

SEQ ID NO: 5314 - DNA, 262 bp, Homo sapiens
ccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttattgaggcaacaaaaaaacaaagcacatgctgcccagtggcttccggaagttccttgttcacaacgtcaaggagcttgaagttcttct

SEQ ID NO: 5315 - DNA, 285 bp, Homo sapiens
cggcacgaggtcctatttcgatgaacacgacttcgagccgtcggaccctgagcaggagacgcgaaccaacatgctgctggagctcgcaaggtcacttttcaataggatggactttgaagacttgggggttggtagtagattgggaccacaacttccttcaacagactgtcaagactatggttgagaaacctccccaggacaaatcatcaaagagctctcaaggctgagctcaagtgcccccctgtgtcctttgggaattgaggagggaggagactctcatataga

SEQ ID NO: 5316 - DNA, 208 bp, Homo sapiens
cagcgatgccgcccctctgcagaggtcccagtctctcccacactcggccaccgtcacggtgggtggcacatcttaccccagcactttcagcagctcagcgctgagcgaaagagaggccttccggcttgacaaggttcaagcagcttctttccggccccaacaaggaccttggacaactacaacttttcccaaccctgggattaaatta

SEQ ID NO: 5317 - DNA, 134 bp, Homo sapiens
gcctcatcttaaaagggagatagcctgaagccctttgactgcattgatcagggacaggaccatgatattgttacaatacctagggtcaccctatggctgagctctctcttatgccctttacaacaatctgtgtg

SEQ ID NO: 5318 - DNA, 202 bp, Homo sapiens
cccagagattgtcacagccctggccattgcgggaacctcaagttcaacccagagaccgactacctgacgggcacggattgcaagaagttcaggcttgaggcttcggattcagattagctttccaaaggggagttttacccagggcaggacacctatccagcacccacccaagggcagcagcgggcagcttgtgtgacgtgtg

SEQ ID NO: 5319 - DNA, 156 bp, Homo sapiens
cacccacctcggcctcccaaagtgctgggattacaggtgtgagctaccgcgccctgccttgactcaatttttatatggtttgaacaaagtggtaatttttaaagtggttatcacctgtaacagtcttttctaaactaaggttcttacaagaaaatg

SEQ ID NO: 5320 - DNA, 167 bp, Homo sapiens
gtcaggagttcgagaccatcctggccaacatggtgaaaccccgtctccactaaaaatacaaaattagctgggcgtggtggcgggcgctgtaatccagctacttgggaggctgaggcaggagaatcgcttgactccaggaggcgcagctgcagttagcttttatggta

SEQ ID NO: 5321 - DNA, 165 bp, Homo sapiens
gtctttctgcccctccaagctgatgaagggaagcctttgccaatggcccatggaagacacttgggtttgagaaacccttcccacttccaaagaccaaagagattaggaaaaggccttgcagtattctccaactccaaacaagcttttagggggctccaggaaaag

SEQ ID NO: 5322 - DNA, 105 bp, Homo sapiens
cattttttataacctggcaaaatcttgttaatgtcattgctaaaaaataaataaaagctagatacttggaacctaacttccaatgttggattgttttacccacaa

SEQ ID NO: 5323 - DNA, 116 bp, Homo sapiens
gcggggttggggggggtcctggtctttgcgcttctcgactcggtcctcttttcgacagcgaacatgtcgcggcctgtcagaaataggaaggttgttgattactaacagtttaagga

SEQ ID NO: 5324 - DNA, 135 bp, Homo sapiens
cttcccacaacactttctcggcctatccggaatgccccgacggtactcggactaccccgatgcatacaccacatgaaacatccatcatctgtaggctcattcatttctctaccagccgtaattataataattttc

SEQ ID NO: 5325 - DNA, 113 bp, Homo sapiens
ctcgtgccgaatttcggcacgagggttttgcttaggcgcagacggggaagcggagccaaacatgccagttggcccggagcttgggtttgttcccaaaacttattttaccccgc

SEQ ID NO: 5326 - DNA, 150 bp, Homo sapiens
cggcacgaggaaatgaatatgctgcactttacaaccactgcactacctgactcaggaatcggctctcgaaggtgaagcgagaggaaccagacctcatcagcccaaccatcaaaggcaaccattcggaaccagcaggcccccgaaggaccc

SEQ ID NO: 5327 - DNA, 105 bp, Homo sapiens
cacctcttaggctgagcattctttaaatagtcttcattgccatttgttcttgtagcaaatggaccatgtgggatggctaattttttttttattaaggaggttatt

SEQ ID NO: 5328 - DNA, 113 bp, Homo sapiens
aaaaaatcagctgagattttgtcttgttaatttagaaaacactttttaagctgtctttctaaaaatctctggggttacctcacaggaatatgttttttgcaacaatacatttg

SEQ ID NO: 5329 - DNA, 110 bp, Homo sapiens
ctcctaaccgcgagtgatctgccagcctcggcccccgaggtgccgggattgcagacggagtttcgttcaatcagtgctcagtgttgcccaggctggagtgcagtggcgtg

SEQ ID NO: 5330 - DNA, 105 bp, Homo sapiens
atcgtggggccactgtgccaataaacaaaaacacctgtttgggtttacctcagttgcagtagttattttcatttagaaggttgttctaagattattgtttcagtt

SEQ ID NO: 5331 - DNA, 103 bp, Homo sapiens
ctctgtcctgttatacatatttagggcagaaaaaaagttacatgtcgattaggtacttatcaaggaatgggcaagctgagatttttggtaataggggaagctt

SEQ ID NO: 5332 - DNA, 122 bp, Homo sapiens
tgggcctggggtgggggcttatgagttggtgctagagccagggccatcttggactatgctccatcccaagggccaagggtcaaggggccgggtacatttttttccctaggctgagcaccttt

SEQ ID NO: 5333 - DNA, 136 bp, Homo sapiens
cccaattggaccaatctatcaccctatagaaggactaatgttagtataagtaacatgaaaacattctcctccgcataagcctgcgtcagatttaaaacactgaactgacaattaacagcccaatttttccaatcaa

SEQ ID NO: 5334 - DNA, 208 bp, Homo sapiens
ggggaagcggagcaacatgccagtggccgggagctgggtttttcgcaaaacttatgtgaccccgcggagacccttcgggaaatctcgtctcgaccaagagctgaagctgatcgggcgagtatgggctccggaacaaacgtagggtctgggaggtcaaatttaccctggccaagctccgaaaggccgcccggaactctagacgtttaat

SEQ ID NO: 5335 - DNA, 230 bp, Homo sapiens
aaaattttaagaattcttaagtctaagggacttgctcctgatctttctgaagatctcttaccatttaattaaggaaagcaggttgcttgttcgaaagcatcttgagagggacagaaaggataagggttcttaatttcctcttatttttatagagagcccgatttacccgtttggctgtatataggccagcgagtgcctccttccaatttgagagtgtagtctagtcatam

SEQ ID NO: 5336 - DNA, 255 bp, Homo sapiens
accggagccttcaaggtcttggaccctgaggaaaggcaccatcaagaagaagttcctggaggagctgctgaccacgcagttgaccgcttttccaaggaggagatcaggaccatgtggccggccttcccccccgacgtgggcggcaacgtcgactacaaacacatctgctacgtcatcacgcacggcgacgcaaggcccaggtgtagggcaccgcggcttctgctgcccgacgttctgttcggcccgcactacacc

SEQ ID NO: 5337 - DNA, 312 bp, Homo sapiens
ccaagtactgtggcggctctatggcttaggcacaggagtggcccagaagcagaatgaggatgtggactctgcccaggagaaggatgagcatcctggcgattatcaccaccatgcagcagttatggcgccaggttctgcagggtgggcctgatccagagtggtgctcactgtgctgactgttactatctccccaagagaaaatgcttcttttgagcacactgtacctcccatctgcattgagcagagagacttttgtttactgagacaaagatgtttaatttagacccagagagagagtttgctctgaatttg

SEQ ID NO: 5338 - DNA, 214 bp, Homo sapiens
ctgaagtcagtaaatgaactaatctacaagcgtggttatggcaaaatcaataagaagcgaattgctttgacagataacggctttgatttctcgatctcttggtaaatacggcattatctgcattgaagatttgattcatggagactattactttggaaacgcggttcaagagagcacaatatacttccgtgtggcctacaaatgtctttctcac

SEQ ID NO: 5339 - DNA, 156 bp, Homo sapiens
ggtttctgtttaatgcatcttgccttatctttttttattactgtgtacaaaggtttttttacacaaaggaacttaatgcctgtattaataaatcagtgtggaggctcaatttggataggtcccaaaggtgaggatttgttagaggattagtgtcca

SEQ ID NO: 5340 - DNA, 186 bp, Homo sapiens
ctggtgcagaccagggccaaagttcttggaagctccttttgccatctgctgaggtcgcaaaactataatttaattcctggtggctaagacctgggttacccgcaacttttaaaccaaatttcacagctgtttaaggtgagaccttgagaggttttctcttatagagatgtgagcttgcgccctttc

SEQ ID NO: 5341 - DNA, 120 bp, Homo sapiens
ccggaacctcctcagctcttccctcttcagaggttcctaccctaagagaattttaaccacttaacaagtcctggttgatcttagaagggagattgggtataggcaaagaggacacacact

SEQ ID NO: 5342 - DNA, 105 bp, Homo sapiens
taggaccgagcagtggccaaaggaagctgtacaatgcagctcatccggaagaagttcttaaccaccctcttggtggccgatttggaaggagccggaaggagtgcc

SEQ ID NO: 5343 - DNA, 245 bp, Homo sapiens
ctcgtgccgaattcggcacgaggaattttcatgtaagatcctatggccggtgcagtcgctcacggctgtaattccaagcaacttttgggggccaaggaggttggatcacttaagtcaagagagtttagagacacagtttggaaacacatgtgtgaaccccctctgtgtatctaaaatatacaaaatttgcgctgggaaatgggtgcgcggatatctgataattcctagacactggggtgcgctga

SEQ ID NO: 5344 - DNA, 160 bp, Homo sapiens
aatcatcaagtggcatcgaattaatttgttattaaaggtagatgataatctgtagaataggttcagtgtcttccctgaggaggagttaatttatgaaggagggcctttgtttaacctatgacttatttctattgacacatgagggacttaatatatagag

SEQ ID NO: 5345 - DNA, 165 bp, Homo sapiens
cagtgggctacccgggcatgaagccccagcagcactgcccaggcgagcttcagcagcagagtgacaccagcagcctgctgaggcagacccatctttggcaatggatatgacccccaaagtaaccagatcacgaggggtcccaagtctagcccggacgagggctct

SEQ ID NO: 5346 - DNA, 128 bp, Homo sapiens
aaggtgccaatgggattctccctagccctgttgagacaaacagtatgtctccagacattggaaatattcctcaggggagaaagtcagttgagaaccactgacctagatgtacctaagtagtcaagaat

SEQ ID NO: 5347 - DNA, 170 bp, Homo sapiens
ctcgtgccgaattcggcacgagttcattgctgagagttctgcgcttccaggtcttcttccagcatccacacaagtaccttctccactaactgggttccctccagaactggcttaaccgccttcagcgggcaggccgggagtttacttttttcagcttacccaagggcagc

SEQ ID NO: 5348 - DNA, 118 bp, Homo sapiens
ctaatgttgatgatcagctgtgatttctaagctaaaagaatgacaaagggattgggtttcttttgtttccatggcactattacggtgtgctggggtattggcttacattttcagagat

SEQ ID NO: 5349 - DNA, 185 bp, Homo sapiens
ctcgtgccgaattcggcacgagaattgtgaattgggagtgtgagtctttctgtagggtagaaagaagccttctacccagcaaaccagtaggcccaaaagttgaaaaaaacttatgacaggcaacaaggattaaggtggcatatattgatgtcaatttgggtcttttttccagaaggcttatacag

SEQ ID NO: 5350 - DNA, 120 bp, Homo sapiens
ggacactgaggatggcagtgcctggaagcaagatcccttccaggagagcggccttcaccttgagccccacggcggccgaggccaaggagaaggcttgagccattcgagtcaacaagcgcg

SEQ ID NO: 5351 - DNA, 185 bp, Homo sapiens
cacggctgacttcaagaccatcaaccagataggcaagaagttgcagaagaagatctgtgttgaggaagacccctgttccttccagtcccttggtgaaattccaagccaaagttggaggggcttcttcaagcccttaccaggaaacttggaagctttttaagtaagccgcttggcccatcctggga

SEQ ID NO: 5352 - DNA, 144 bp, Homo sapiens
ggcctccgggccccccttggagttccaggcatcgatggcatcgacggtgaccgaggttcctaagggccccccgggcccccccgggttcctgcaggtgaaccgggaaagccaaggagcttccaggcgaaggcttggaaaacttgg

SEQ ID NO: 5353 - DNA, 122 bp, Homo sapiens
cctagaggagagcaaacgactcagaggaacaaacagatagccatgggaaggaagaaattcaacatggatcccaaaaagggaattcagtttcttatagaaaatgaccttctacaaggttccca

SEQ ID NO: 5354 - DNA, 210 bp, Homo sapiens
ggagagcaggatttctctgcctcttccaacttttctcctgaacctgagggaaactaatctggattcactccctctggttgatacccactcaaaaaggacaattctgattaagacggttgaaactagagatggacaagttatcaacggaacttctcagcatcacggtgacctgaataaaaattgcacacactcagtgcagcgctatatttc

SEQ ID NO: 5355 - DNA, 225 bp, Homo sapiens
ctttcctttgccttgaccctttgttaaataaatgacttgcgggagccattcattgtacagttgcaggattaagagtcatttaatgatgtggtacattgggaccatgttctaaaaccttgggtttctgagtctgctttttgagaagggaattttgaggttgaaaaccaggggccttaatctgggaaatacagcattttccagaggcttctttaaagggaatccggg

SEQ ID NO: 5356 - DNA, 140 bp, Homo sapiens
gtgggctcttatattagtagtccagtagtgatgatgaaattttaattaatgttgaataaaaggataacttataatgcaggccctctggacaaactatcagaaaaaaggggaagtagggaaattgggttaaattgaggtaa

SEQ ID NO: 5357 - DNA, 286 bp, Homo sapiens
gtttcctctactgtttgaatttctgtaaataataaatcttccctttcttctctctgggcctactaatgatggtgttgcctaagggtcaatccgggttgcaattaaggcaggtctaggaggcaaattcatagccttaaatccctacatcaaaaaggtcttaaagggccaaattggacaattctagggtcaaaccccagggacctggggaaccaggaccaacccaacttacccaaggcggagaagaggaattactaggtaggacagtctaatgaattggcaaccaccc

SEQ ID NO: 5358 - DNA, 260 bp, Homo sapiens
cgtttcctataagaattggcataaatctaagahgaaggcctttaccaggtactgccaagaaatggcaggatgaggatggcaagaagcagctggagaaggacttcaacagcatgaaggaggtactgccaagtcatcccggttcaattgccacaacccagatcgccttcttcccttttcgccaaaaggaaggcccaacttatggagatccaggttaaccggaggcaattggcccaaaagcttgacttgccccgcaaagcttt

SEQ ID NO: 5359 - DNA, 250 bp, Homo sapiens
cccttcagcaccctctactgaggaaaaaagggaattggctgtctgccagtttccaaggcaccttctttcaggacctacagaaattatgttctattgatcgtacttttggtgttacaaacattaggcccgtaattaaaacccttagttaaagggcccaattctgatccttaccagttaatttgatattaggttggatccattaggcctcttgaacttggaaaaccaggggaaaggttttataagtttgatc

SEQ ID NO: 5360 - DNA, 140 bp, Homo sapiens
accatcgtgtgcacagcaaggacggcggggcttggggaccgagcagcgggaggctttcctttccctcccagcctggaaggttttgcaaggtgttcatcaccttggaccaggccaacctgaccttaaggttcccaatgggt

SEQ ID NO: 5361 - DNA, 156 bp, Homo sapiens
atttgtctgtccaaagagaattaggagagaggttaatgttacttttttccattttggaaataattttaatcaagtaacctcaaatgtgacaaaatttatttttattttttgtggttaatatcccaacaacattaaaaaatactcggggcataaatg

SEQ ID NO: 5362 - DNA, 215 bp, Homo sapiens
gagatttgcctactatacagatgacctagctagtgcaccatctagcactttcccaccccttcagtttgggtcagaggacaccaaagttccaaggaggagacaggggacacaggggccaaaaatttgtattattttctcacccaggtggtcatgcaggcatttagtttgaaacctcaggccattaacccgtctgaactcgctaccctggtgctccc

SEQ ID NO: 5363 - DNA, 215 bp, Homo sapiens
tcgtgcgaatttcggcacgagccaattatctgtattaatgcttgaatattactggataaattgtatgaagatcctcctgcagaatcagccatgatttttcccaagggaataccatatgcaggttacttattaaggggcaaaccttaggtgcccttaaggtaatgcctgtaaaatatttggagggaaataggattaaaagggttaaggtgtttcta

SEQ ID NO: 5364 - DNA, 220 bp, Homo sapiens
gtgaatttgagaagagtatgtagccaccttgggtgttgaggttcatcccctagtgttccacaccaaccagagggccctattaaggtcaatgtatgggacaaaaccggccagagaaattcggtggactgagaaatgctatatatcccagcccatgtgccacataatgtttgatgtaacctagcgagttacttacaaggatgtgcccactggcatgagatcc

SEQ ID NO: 5365 - DNA, 284 bp, Homo sapiens
ggacacgctgttcctctgcttctgtgaggactggaaaggaatgacggctctcaggagcgaccctacttcatgtcgcccgagctgagagacatcctgtttgaaggggagtgcggaggaggggaagcgggcagaagccgaggagtagagattggaggacctggagaggaatgacggctcggccaggaggctttacttaatgttcttcaccctcaagaaactcttgaacaagagcaacaagaaggcagcggagtcctgaaggcccgtgctcccacctctcaaggagt

SEQ ID NO: 5366 - DNA, 220 bp, Homo sapiens
tcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaggaagtaagttggtccaaaggcaaagttcgggccaagctcaataacttagtcttgtttgtacaaagctacctatgtataaa

SEQ ID NO: 5367 - DNA, 180 bp, Homo sapiens
cgacgccacaatagtgcgcatgaatgtactggcagatgctctcaagagtatcaacaatgccgaaaagagaggcaaacgccaggtgcttattaggccgtgctccaaagtcatcgtccggtttctcactttgatgatgaagcatggttacattggggaatttgaaatcattgatgaccacag

SEQ ID NO: 5368 - DNA, 152 bp, Homo sapiens
aaacactgacaggaaaaggggatggacatgattcccagaatccttcaggctagctcctccgcgcatccacgttcaaccgaggctggtaattttggagcggccaccagggggcgccacgattcggttgcccgttcgccttggattgttgtaat

SEQ ID NO: 5369 - DNA, 139 bp, Homo sapiens
ctcgagtttttttttttgctgcgtttactgcgagaataagactattctcagcaatcagactgtcgacattccagaaaatgtcggcaatactttgaagggacggacagttattcgtggaagggccccagagggaaccctg

SEQ ID NO: 5370 - DNA, 211 bp, Homo sapiens
agatgacaaaatgaaagcccaaggggctgaaatgagttacccatagtcatagacctaattactgacaaagcacaaatttcctgactgccatcactatacctctgcccttacctggccaacccagggctggggtgggcaatgcaggagacaaggtaggcacaaggaaccctctagggggggtaggtcctaggccaaaggtcaaaataaatgt

SEQ ID NO: 5371 - DNA, 154 bp, Homo sapiens
cagcagcgcccgcagcacccaccccgcaccggcgactccatcttcatggccaccccctgcggtggacggttgaccaccagccaccacatcatcccagagctgagctcctccagcgggatgacggcgtccccaccacctccctttttttcttttt

SEQ ID NO: 5372 - DNA, 312 bp, Homo sapiens
gtgaaaagggagtactgcgtaatgcgtatggggattccttttaggatgatgaaaattggatgaattacagctggtctgatggtagtgggttatcagaacttattaacattagtgtcattaaagttggtatatagcccctcactgctaaatctggctcaaaaattaaaagagttattaaaatttgatgaattagtggtgatggttgcacaacattgtaaatataataaatgtcactgaattgtacactttaaggtgggtaaaatggcaaattttacaagtcttctgaaactactgtactcttttaatacacag

SEQ ID NO: 5373 - DNA, 222 bp, Homo sapiens
gaaaaacttaaatgggcgaaagatcacgatgaagaggccaaaaagatagcaaaagcaggacaagaatttgcaagaaataatctcatgggcgatgacatattctgttattatttcaaacttttccaggaatatgccaatttacaagtgagttagccccaaatccgagagggcatgaaaagggtagaaccacagactgtaggacgacctctttcccttgttact

SEQ ID NO: 5374 - DNA, 139 bp, Homo sapiens
ctcgtgccgaattcggcacgagcacaagtcttcactccttcctgcgagccctgaggaagccttctttccccagaacatggccaacaagggtccttcctatggcatgagccgcgagtgcagtccaaaatcgagaggaagt

SEQ ID NO: 5375 - DNA, 150 bp, Homo sapiens
ccaacatgggccgcgttcgcaccaaaaccgtgaaggaaggcggcccggtgcatcatgagaaaagtgactctacacgggcctggggcaacgactttccacacgaacaagcgcgtgttgcgaggagattcgccattattccccagcaaaaag

SEQ ID NO: 5376 - DNA, 196 bp, Homo sapiens
cctggactcaatcatggcttgtggtctggtcgccagcaacctgaatctcaaacctggagagtgccttcgagtgcgaggcgaggtgggctcctgacgctaagagcttcgtgctgaacctcgggcaaagacagcaacaacctcgttgcctctcactttaaccctccgttttaacgcccacggcggcgccacacaccat

SEQ ID NO: 5377 - DNA, 223 bp, Homo sapiens
agaggtggtgtctttagttgacagttcacaaacttgtgtaaaggtttgtgaaatgcatcttcttactgcatcagaccttccttaagaatgaaaccgaccacatggagggaaaaagaaaacaattcttttcttggcttggttttttgagaagtttactgacaaattactttttatcaaatctgaaatagtcacctcacagctcttcaaagagaacctttgaaag

SEQ ID NO: 5378 - DNA, 145 bp, Homo sapiens
cggcacgagttcatttttaatcctttagctattaccccattgaattaaaagagtaatgtgtggtagagtcatcaatgatgggcgagatttcagaatacggagaaaaaaaaaaaaaaaaacctcgccctcctccccaattcgcacg

SEQ ID NO: 5379 - DNA, 105 bp, Homo sapiens
gccagaagagaaattatcatgatgtttttgaggcagattaaaatttttctctatcctcatagagatgctttgctagcagtttcattttgtacaaatggcataccc

SEQ ID NO: 5380 - DNA, 140 bp, Homo sapiens
cccagactggttcttgaacagacagaaggatgtaaaggatggaaaatacagccaggtcctagccaattgtcttgacaacaagctccgtgaagacctcgagcgacttaagaagattcgggcccatagagggcttcgtcact

SEQ ID NO: 5381 - DNA, 145 bp, Homo sapiens
gtgggaaatgctttaccagtggtagaaaccttagagtacatcagagaattcatacttgtgagaaaccatatcaattgtgaaggatgttgggaaggcctttaggtcataggttcaaacctgttaaacatagttaaaattcatactt

SEQ ID NO: 5382 - DNA, 130 bp, Homo sapiens
ctccataaatttggtgattctctgctaggcctaagattttgagttaacatctcttgaagccaaacctccaccttctgtgcctttttgcttgggaataatgggagtttttctttaggaacaggtgccagga

SEQ ID NO: 5383 - DNA, 205 bp, Homo sapiens
ccaatattcagtgttataaatattactgcatcccttacccattgttaaaatattgatgtgcttccagacccattggtaaagagccccctccttggagtgaccccagctccctggatgcccctgtcccctctccaagatcccagggcctccctaagattccaccactagagagttaacagctgacaccagtgttcttccatgtcaa

SEQ ID NO: 5384 - DNA, 130 bp, Homo sapiens
cctccagtttttcatagacctgaggttccagtgtctcycagtaactgcgaaccttttcctgagggggaattcttgtgttaaaattacccttcaaaaaggaagtaggcaaaggcgttgccaaaccccaccc

SEQ ID NO: 5385 - DNA, 155 bp, Homo sapiens
ggcgcatgcaggagatgctgcagaggatgaagcagcagatgcaggaccagtgacgctcggcgcggacacaaccgttccgtcttccgggacggccttgcaccccttggacaaccagaaccggactttttcccgacccggagacgcgggggccacag

SEQ ID NO: 5386 - DNA, 190 bp, Homo sapiens
gcaaagtctctcgcgacaccctgtacgaggcggtgcgggaagtcctgcacgggaaccagcgcaaggcccgcaaggttccttgagaccggtggagtttcaggatcaacctttaaggacctattaatccccagaaggacaagcgcgttcttgggcacccgtcaggctttaagtcacatccccgcccctaagg

SEQ ID NO: 5387 - DNA, 211 bp, Homo sapiens
ctccttttatagcgcttctcaacggtagggagagctgaagggaaacattctgactgtgtggcagggtgattttcttccttatgaccacttacagtggatatttattgtacttgacccttttatgccctagaatgctgtgagggttaccatgttgaatttgtgcagaagctaaaagcaccagatgtgtcagagatgcaatttgtgtattatg

SEQ ID NO: 5388 - DNA, 212 bp, Homo sapiens
cgttgagggttggggggcggggggcctccttccttcctctcagcccccttccccaggggctgtgcttccatgcttctaggcttccaccttcgctcaggacatgttataacttaggctaaactgtgaaaattccggtggggatggccttggccgagctctcaggcaggcggccctgccccagccctgtcatcatttaagggggagctggccct

SEQ ID NO: 5389 - DNA, 219 bp, Homo sapiens
tatagaattgggccaagataaatctatgttgttttgcatggctattgttaagctccaaaggttcactgtgtttctgccgctgtcctggagttgtcaccactgacttggcaaggcttcttgggcatggatgtaggacttttgtccttttcccacttacagttatctttgactctcttgcctgttatgcttacaaaatggggatggcttatgggaggctgt

SEQ ID NO: 5390 - DNA, 240 bp, Homo sapiens
gtcattaaacaaaattacataccacctattcagtactaagatcacaggcatgctggggaggaaaacagccagaccactctcatgctggactagaattgggtgggtggggctggacaggaagggtgtttgagggtcggggaaggctcccagaggaagttaggtctaggctgaggtctgacaactgggtgaggactaaccaggtaaggagagaggagaagagggttcttcatgatgaagaca

SEQ ID NO: 5391 - DNA, 218 bp, Homo sapiens
ggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactctagacctcagggaccgacttttgacccctctggccacaaag

SEQ ID NO: 5392 - DNA, 236 bp, Homo sapiens
taatggcacaacctgtcacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagttgccaggaataaagtaatctaatatacaagctttgattaaaacttgaaacaaggaaaaaaaaaataaaaacttcggga

SEQ ID NO: 5393 - DNA, 145 bp, Homo sapiens
tcaggatagagataatctcctgaaaaacctgaatttcagagattcttagacttgctgccaaaggatgaagctagtaaaggagaaaaagcttaaattccatcttgagctcttggattgtgataatacaatgagttcattaagcttt

SEQ ID NO: 5394 - DNA, 150 bp, Homo sapiens
gagaaagcacataccaaggccaccacacaccacctgtccaaaaagggccttcgatacggggataattcctattttatttaccctcagaaggttttttttccttccgcagggattttttccttaaccctttttaccactttccaagcctgt

SEQ ID NO: 5395 - DNA, 204 bp, Homo sapiens
ggcaatagcaggttcacgtacactgccctaaggatggctgcacggaacataccagtaagtggggcaagactgttatcgagtaccggtcacagaagacctcacggcttcccatcattgacattgcacccatcgacataggcagggcccgagcaggaattccagtgtggacatagggccggtatgcttcttgttaaaacctgaacc

SEQ ID NO: 5396 - DNA, 240 bp, Homo sapiens
ggaccctgcagccgcagagatgttgatgcctaagaagaaccggattgccatttatgacctcctttttaaggagggagtaattggtggccaggaaggatgtccacatgcctaaggcacccggagctggcagacaggaatgtccccacccttaatgtacatgaggcccatgcagtcttttaggtcccaggggctacgtataggacacagttttcctgtgagacatttcttcttggcacctta

SEQ ID NO: 5397 - DNA, 246 bp, Homo sapiens
acgaggtcctatttcgatgaacacgacttcgagccgtcggaccctgagcaggagacgcgaaccaacatgctgctggagctcgcaaggtcacttttcaataggatggactttgaagacttgggggttggtagtagattgggaccacaactcctcaacagactgtcaagactatggttgagaaaccttcccaggacaaatcatcaaagagctctcaaggctgagctcaagtgcccccctgtgtccttt

SEQ ID NO: 5398 - DNA, 240 bp, Homo sapiens
aaaatactgaattcctgggtaaggagatattttgttttaaaaataatgtgttttgatacgaatcagtgtattaactgataactaaaaagtactcttttttctatatatacatattttttgggagactcatatttcacaatcaacatattcaatcagtgagttatagtctcattcctagctaccacaaattctcgggcacttttaaacactaaacatttcatttatccccgaagctaaaat

SEQ ID NO: 5399 - DNA, 220 bp, Homo sapiens
cgtgccgaattcggcacgaggaaaaggccaaaactgtccattaataatgacattcaagcaaaggcaaaattctagagttagtaaaccaatcggtggctgctacttatgcagggttgaagcacagagggaattaaaaggataggtaaggccttttctgaaggtacccacaaggtgggatccatgactctatccatttgtaaaaccccacagatctatatag

SEQ ID NO: 5400 - DNA, 226 bp, Homo sapiens
ctcgtgccgagcttctcagactatccacctttgggtcgctttgctgttcgtgatatgagacagacagttgccggtgggtgtcatcaaagcagtggacaagaaggcttcttgagcttgcaaggtcaccaagtcttcccagaaagcttagaaggcttaaatgaatattatccctaatacctgccaacccaatctttaacctaaggtggtggaggacggctctagactc

SEQ ID NO: 5401 - DNA, 185 bp, Homo sapiens
gtactccagaggcagcagcccaggtggtgcagtgggtgagctttgctgattccgatatagtgccccccagccagtacctgggggtttccccaccttggggatcaagcaacaaaaccaaacaggcacttaggaattcaaaggagggaagttagggcgatttttggggcttcttggttcttacattt

SEQ ID NO: 5402 - DNA, 140 bp, Homo sapiens
cgggtatgaagatcgggcggattgaggatgtcacccccatcccctctgacagcactcgcaggaaggggggtcgccgttgtcgccgtcttttaacaagattctctaaaatattttctgttaataaatttgccttcaatgtt

SEQ ID NO: 5403 - DNA, 158 bp, Homo sapiens
cctgaggtccaggcttcctggcagaagatggtgactggagtcgccagtcccctgtcctccagataccaattagcttaatccccatgatggagagctttcaaggataggctttattttcaagcaatgcaaattattaatctattcttctaagagatcac

SEQ ID NO: 5404 - DNA, 248 bp, Homo sapiens
aagatgggcctccagaacttctgtttattcatggaggacacactgctaagatttcagattttagctggaaccccaatgagccttgggtcatttgctcagtgtctgaggataacatcatgcaggtatggcaaatggctgaaaatatttacaatgatggaagggtcagatgtcacggcatccgaactggagggacaaggtctcaaacccaagttcgggaaatgttccgttgaatgtaatagtacactgat

SEQ ID NO: 5405 - DNA, 120 bp, Homo sapiens
tggagcggtttgcattacggctgtaaatgtattcatcttaattatgtagggtttttttggtcgggaatctggatctttgaggggatgccaccaattttggtttctcctgttatgtgggac

SEQ ID NO: 5406 - DNA, 255 bp, Homo sapiens
aaactactgaacctgttacctaggttaacaaccctgttgagtatttgctgtttgtccagttaaggaatttttgttttgttttgtctatatgtgcggcttttcagaggaaatttaatcagtgtgacagaaaaaaaaattgttttatggtagcttttacttgcattgaaaaaaaatttatttgccttttaaattcttttccccaatccccctccaaagtgtttgtagcagcgttaatttggggttaaaccggggaaa

SEQ ID NO: 5407 - DNA, 220 bp, Homo sapiens
cacctctgtacagagaatacacctgcccctgtatatccttttttcccctcccctccctcccagtggtacttctactaaattgttgtcttgttttttattttttaaataaactgacaaatgacaaaatggtagcttatgatgtttacataaaagttctataagctgtgtatacagttttttatgtaaattattaaaaggcctatgatgatgccatttataa

SEQ ID NO: 5408 - DNA, 248 bp, Homo sapiens
aaagattggttaaaagctttggtttctagtaaaggttagtgtgtgtggtttttttaagaagctgttttgctaaattatttttacttgggatgtttcaaacagatttcaggctgcaaacttgttttataatcgtttgcttctccaagtgaagctcagaaatacctaaaaatagctgttacgttcgcgttaggaaagatgggtttattccagttgcattttatggggattaaatcctttccatgtgacct

SEQ ID NO: 5409 - DNA, 305 bp, Homo sapiens
tggcggaggtgcaggtcctggtgcttgatggtcgaggccatctcctgggccgcctggcgccaattcgtggctaaacaggtactgctgggccggaaggtggtggtcgtacgctgtgaaggcatcaacatttctggcaatttctacagaaacaagttgaagtacctcggctttccctccgcaagcggatgaacaccaacccttcccgagggccctatcactttccgggccccagacgcatattttggcggaccccgcgaggtatttctcccacaaaaacaagcgaggcacagcgctctggaaccctc

SEQ ID NO: 5410 - DNA, 215 bp, Homo sapiens
gtattgttatttttattatttttaatttaaacctgatgacttgcacagcatctttcccaccgggaagagcgggccttctgccttccctcctgcggggttggggttgggacagaccccagtgggggcccagggccacaattgagcgcagtttgggctggaccccctctttgctccaagggcttgcccgttttcgggggccgccggtttcaccactt

SEQ ID NO: 5411 - DNA, 285 bp, Homo sapiens
ctcgtgccgaattcggcacgagcgggcgcaaccttactcctgctgagctgcctgccaagcagcgagaacagcttcttgggatctgtgatgcagccctctgccggcaggtgcagctgctggggggtgcggctggtggtgggagttgggcgacttgcagagcagcgggcacgacgggctctggcaggccttatgccagaggtccacgttgaagggctcctgcatatctcttcccgtaacccacaaggccaacaagggctctggaggcagttgcacaggaaagattta

SEQ ID NO: 5412 - DNA, 271 bp, Homo sapiens
gccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagaccttacccgctttgtgaaattgccccgctatatcaggttgcagcggcagagagccatcctctatatgcggcttaaggtctcctgcgatttaccagttcacacagggctctgacgccaaacagct

SEQ ID NO: 5413 - DNA, 306 bp, Homo sapiens
gctggcaacaacttcatcatcactcccgctgcccactgcaagggcagcctccaagccatgggcccccgtccctgccatctcaggcctctgcctaccttctactggccttgtcaacatcaacaggggcttggcgatgactgtacctgggtgacaggatttaccctaggggcctccgggcgagcccggatgaatgcaaccttggggatggcaaagccaaggtttgtgaaattttgggataaggtaagggggaccccttgagaacacatatcaaggagaaggggtttttttcgggccctcggtggcacc

SEQ ID NO: 5414 - DNA, 128 bp, Homo sapiens
aaattcttctatattggctggtaaattgccatggccctgagccactgagtatgttcattgccacccctgtccctcccctgggaacccctaactttccctgatcctgaattaaaggggtaatgtgtggg

SEQ ID NO: 5415 - DNA, 168 bp, Homo sapiens
gccagagcttctcccaggcacaggtgttgcaccagggacttctgcttcaagttttggggtaaagacacctggatcagactccaagggctgccctgagtctggggacttctgcctccatggctggtcatgagagcaaccctagtccccttcgagacagcgccttccaga

SEQ ID NO: 5416 - DNA, 130 bp, Homo sapiens
atccctgagctgaacgggaagctcactggcatggccttccgtgtccccactgccaacgtgtcagtggtggacctgacctgccgtctggaaaaacctgccaaatatgatgacatcaggagggtgggaaggc

SEQ ID NO: 5417 - DNA, 132 bp, Homo sapiens
ggaagtttgccgttttcgtccatgccaagatggctgagctgcaggtgcgggacctgagcctgaagctgcagggcatccccggccacgggttcctcctccagttcctccaggggcagcacatgaaggaccagt

SEQ ID NO: 5418 - DNA, 167 bp, Homo sapiens
ctcgtgccgaattcggcacgaggacctacgcacacgagaacatgcctctcgcaaaggatctccttcatccctttccagaagaggggaagggggaaacacaagaaaggaacccgcctggttccagggccccaattccttctttatggtttttaaattcccccggtttb

SEQ ID NO: 5419 - DNA, 304 bp, Homo sapiens
gggaattttgtagattttgaaaaaacagatattttttatgagtcttcctattcataaaaatagtatgtctccatttactaatgtctttaagtgttatttcagtaaagctttctttcttttccacattggtcagctcctcttttttattggatttatcccctagcatttcatattttctgtcgctgttgtaaagggtaattttcacatttttatctatcactgatatagagagttgtaatatattccacatatagatctagtttaaggcagcatgctgagtactcaattctatatgcctataaac

SEQ ID NO: 5420 - DNA, 431 bp, Homo sapiens
gcgccccacaaccctgctcccccgacgtccaccgtgatccacatccgcagcgagacctccgtgcccgaccattgtcgtcttggtcccttgttaaccaccctcttaatgacccccttgcttgccttgggcttaatgggcatttggccttctccgttgaggttttggggacaggaagatgggttggcgacggtaccgggggcccaggcctattccctcaccgccaggacccataacactgtggccccatattttttgggcatcataaaaacactcttcataatgaaaatccagtccttaatcttccaggccctatggagtagtatcaggaggcatcactaaggccaggagctctcccatgacctatatccacgtactccaactccatcctggcctgccccggagccgagtctgtataagcctttatctaaagg

SEQ ID NO: 5421 - DNA, 162 bp, Homo sapiens
gctgtcttcgccttagtactcgtgtgaagttggcagggacggttcctgtcatcttcttgggcttatttggtgtgctgttgaaggggggagactagagaaatggcagggaaccccttatcccgggcaagtaggccccttttggacttggggcctcttgcgtgc

SEQ ID NO: 5422 - DNA, 168 bp, Homo sapiens
tcaagtaaaatgtctggttgtgccagacatttcacaagtgtgaaaggagataggagaagctcaacttgagggcgtgtagtaagttgtagaaggctcgaggggacgtggacttatttgccttgggtttcaatacccccaaataatgagtttgaaaagaacaaattaaat

SEQ ID NO: 5423 - DNA, 131 bp, Homo sapiens
ggcagaatatttaaactttatttttgtttgcccaatttattgttttaccgagttataaatgtttgctattttaggcaaatgttgctttggtttttaaaggaaattcttcctttggggaaaaaaaggattcc

SEQ ID NO: 5424 - DNA, 124 bp, Homo sapiens
cttcaaattttgggcccatgaagggaggaaattttggaggcagaagctcttggcccctattggcggttggaggccaattacttttcaaaaaccaggaaaccaaggggggttatgcgggttccca

SEQ ID NO: 5425 - DNA, 119 bp, Homo sapiens
tcgtgccaaaaaacccttacaatgttttcttgttaaaggccgtctgacagtcctgagaataattaatggtagggattaaaaaattttcacagatgctctcggtgaggaactctaggggt

SEQ ID NO: 5426 - DNA, 114 bp, Homo sapiens
aacaactagaggtctgaataggtagttgaatctagttatgatcatcagtgttggatggcagagatgcctgggatttctctttatgttaaattttagattaaggaaagtttccct

SEQ ID NO: 5427 - DNA, 108 bp, Homo sapiens
ctcgtgccgaattcggcacgagcttaaagttaaggcagtttttatggcgttttgtagtaaattctgtaaaatactttggtttaatttttgactttttttgtaagaaat

SEQ ID NO: 5428 - DNA, 356 bp, Homo sapiens
tggcacaaatcttgttcattatcagagccagtgcatactagcgtcttgtttgttgcccattgcctatacttttcacctgagatgtgtgagttggggccttttaaaaactactgaattgtctgagccttgaggacatttccagggagaggagataatctctcatttcacccacaggctggtctaatcataacctagttaaagatgtcctcgtttaagaaccccattatttatttttagttttaatataaattaacacgtgggcattatatttctcctcaaatgaggaattttaaatttattgacctacctctgagctttaaaaaggagaagagggtaggggtgggaactggcatact

SEQ ID NO: 5429 - DNA, 263 bp, Homo sapiens
cgatgactgctacacctcagcccggggctgcactgccaccctgggcaacttcgccaaggccacctttgatgccatttctaagacctacagctacctgacccccgacccttggaaggagcctttattcaccaaggctccctatcaggagttcactgaccacctcgtcaaggccccaccagagtttcccggcagcgggctcagggtccaactgtggctacaacataggggttttatacaagagaaataaagtgagttaacgtgta

SEQ ID NO: 5430 - DNA, 157 bp, Homo sapiens
gggacccgctattgggccttccttccggaaaattggtaaaggaaaatttaaatcagccagcacgccaagtacaattgctttttctttggggcaaaaccaaggttaaggaacggcctttggggatcctggcactttggttcccgcattaaggcaatgg

SEQ ID NO: 5431 - DNA, 163 bp, Homo sapiens
cctcaatatgagtttcgattggtaacgtgtttttgtttgggaagtaattttgtttgaaaatgctctaacaaacaggaattagggcctagattgtaagctcttgcagcagtcaaatttgttcccgggctttggggttatttctaaatttttgagggccttccta

SEQ ID NO: 5432 - DNA, 248 bp, Homo sapiens
gagagttgagacccctagactaatacttgaatcttatttagaatcttagaatgggggagccagaaagagccttctaagtctaatctgggatttctcatgttctgaagattattgtttcaggggatattattagggtattctcagaaaagggttccttagccaaatgtgtctggaaactttagcatgtgcctatatccggctctttggaaattcactgtgctttttagaactttaaggctctcagaagg

SEQ ID NO: 5433 - DNA, 272 bp, Homo sapiens
aacgccagatgcgtgaaatggaagagaactttgccgttgaagctgctaactaccaagacactattggccgcctgcaggatgagattcagaatatgaaggaggaaatggctcgtcaccttcgtgaataccaaggcctgcctcaatgttaagatggcccttgacattgagagttgccacctacaggaagctccctgggaaggcgaggagagcaaggtttctctccccctttccaacttttccccccgtaaccctaggggaactcaactcgggty

SEQ ID NO: 5434 - DNA, 263 bp, Homo sapiens
aggagaaaagaggggcctgggaagggaagaaaacagcagggaagaggagggctgaagacagagcaggaggaaggctgagtggctttagctctttggcctaacccagaccagtcagagttcactctgggcacctcccagtggcagccacttgatttgcaggcaaagagcttggagaacccgctctccaaattcagccttatccatgtccacataggggataggccccggaaagcactcaacaaatatgcactataatgggtggs

SEQ ID NO: 5435 - DNA, 167 bp, Homo sapiens
gcctagcccactggctccctggaagagatcaagccatcggagctgctagagttctgtctggactttccagagaccagtattcccttttgctgcctctaaaaggcctttcccttcagccatgagagacagcaggtctcatgggggttacaagctttttttttttttyt

SEQ ID NO: 5436 - DNA, 316 bp, Homo sapiens
aagccgtacccaaagtctcgcttctgccgaggtgtccctgatgccaagattcgcatttttgacctggggcggaaaaaggcaaaagtggatgagtttccgttttgtggccacatggtgtcagatgattatgagcagctgtcctcttgaagccctggaggttgcccgatttgtgccaataagtacatggtaaaaagttgtggcaaagatggtttccatatccgggtgcggttccaccctttccacgtcatccggatcaacaagatgttgttcccgtgcttgggctgacaggtccaacaggaatgcgaggtgcctttgr

SEQ ID NO: 5437 - DNA, 332 bp, Homo sapiens
cgaggtcgcacgcgtgagacttctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctcctggtggggctgtagccgtctctgctgccccaggctctacagaccctgctgctggttctgccctcttgcagcagaggagaagagagatg

SEQ ID NO: 5438 - DNA, 329 bp, Homo sapiens
gaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagtttggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgcccctgagtgac

SEQ ID NO: 5439 - DNA, 331 bp, Homo sapiens
tttggctgtccggacggtgcagcggcgaggccggccgcgaagatgccagtggcggtgatggcggaaagcgcctttagtttcaaaaagttgcttgatcagtgcgagaaccaggagctcgaggcccctggaggaattgctacacccccagtgtatggtcagcttctagctttatatttgctccataatgacatgaataatgcaagatatctttggaaagaataccacctgctataaaatctgcaaattctgaacttgggggaatttggtcagtaggacaaagaatctggcagagagatttccctgggatctatacaaccatcaacgctcacca

SEQ ID NO: 5440 - DNA, 332 bp, Homo sapiens
cagcagcaaggtcagcggcgtcctgaagaagctggcacagagccgcagaaccgcgcttgccacctcccccatcaccgtcggggacctgggcatcgtgcggcggaggtttcgggacgtcccggagagcccccagcatgcggccgacacccccaagtctggggaaccgcgggtaccagaggaggctgcccaggaccggcccatgtcccccggagactttccttcggaaacaactgagacccccaagtgcagcagcccgaggggcaggaagggagccgtcaggacaagccctttcgccagcaggcttctcccaggaggcagtgacacccccgaca

SEQ ID NO: 5441 - DNA, 141 bp, Homo sapiens
ctcgtgccgaattcggcacgaggttcagcaggctgatgaataagatctaagagttacctggctacagaaagaagatgccagatgacacttaagacctacttgtgatatttaaatgatgcaataaaagacctattgatttgg

SEQ ID NO: 5442 - DNA, 331 bp, Homo sapiens
taagctcttctcttgactgattcattctgagtttccagatgatatcagccctaatatcacctcctgtcatgagagctcttccccagtcactctgttacactcccctgttcatttccttcacagcagttaccacggtccgcagttgtggtatttctgtgttatttgactatcattcccatcagaattaattcctactttgtttcctctcaaattgccagcacctaaatttgttaatcaactgaattttaaagggagagttttcggggtctgagacaggagggacacttaggcccgagttcgagagcacgtgttggcaacacatggagaccca

SEQ ID NO: 5443 - DNA, 270 bp, Homo sapiens
aataccatgaacattaatgcttccatttatgatgagattcagcaggaaatgaagcgtgctaaagtgtctcaagcactgtttgcaaaggttgcagcaaccaaaagccagggatggttgtgcgagctgttacgttggaaagaagatccttctccagaaacagaaccctgtgggagaacctcttccatgatccgaaggttcctcagtctttctcagccagaacgtgatgccatttatgaacaggagagcaacgcggtgcattcaccattgcga

SEQ ID NO: 5444 - DNA, 310 bp, Homo sapiens
tcgccatacttgcggacggttcgctggggccccagctgtacggagtcttcccagagggccggctggaacagtacatcccaagtcggccattgaaaactcaagagcttcgagagccagttttgtcagcagccattgccacgaagatggcgcaatttcatggcatggagatgcctttcaccaaggagccccactggcctgtttgggaccattgagccgtacctaaacaggtccgggcctgccccaacttggcttcctagagttgaaccctctgagattatcagcttaaggatgagatatggaacctagagga

SEQ ID NO: 5445 - DNA, 165 bp, Homo sapiens
catcagcagcatggagctgaagaccgagccctttgatgacttcctgttcccagcatcatccaggcccagtggctctgagacagcccgctccgtgccagacatggacctatctgggtccttctatgcagcagactggggagcctctgcacagtaggctcccttggg

SEQ ID NO: 5446 - DNA, 220 bp, Homo sapiens
ggagcagctctgtgcttggacatcagtgggccaaggttcttgtccctggttcactgtgatttggctttccggttctttcctgggatgcctttttggggttccttgggtttgggttggaagaggccatttccctaatttaacctctaggttttccgaggcccttgggcctggttttttttagctttggacagtgtgcccctttttccttctggtttgcctc

SEQ ID NO: 5447 - DNA, 101 bp, Homo sapiens
aatatgctgacagttggagataggaaaaggcaatttacttatgctggcccaaaaagggttaattttcatttgtggctttaaaagggttttgtttttctcaa

SEQ ID NO: 5448 - DNA, 100 bp, Homo sapiens
caatgtaatagcaatgcaaattaaactttaatgggtattctggccacctggtgggtggctaaggtaaggttcttaacactttaaagtgctgtcatcgggg

SEQ ID NO: 5449 - DNA, 101 bp, Homo sapiens
tccgaatttcggcacgaggaaaagtcccaatgtacggccccgggtttaaggaaggaaaattaataggctagtccctttcatttaaatttggaaaagttgga

SEQ ID NO: 5450 - DNA, 110 bp, Homo sapiens
tcgtgccgaattcggcacgagctacgccgagtgacagagacgctcaggctgtgttctcaggatgaccgagttgggagaacagcagcaccagcggtggcagagaccccaga

SEQ ID NO: 5451 - DNA, 222 bp, Homo sapiens
agctgcaatctcatcactggaatgttccagcgactggacaagctgaggaggatttgccttcgccagtgtacatcctttttggaaccaacaatttggcagctccatttcctggacgtttgggttttccaaggccaggagcttgccttttccggttaagttcagattggcaggtggactacgagtaataaaaatggcggaaattggatcctggcagcgaggaga

SEQ ID NO: 5452 - DNA, 146 bp, Homo sapiens
acaattcggggtttcggcttgtcgggagtcaataagtacgaacagtgctctgctacattgtagagtttctgtagagatcaaatttgactccactttaggggttccaaagcaaattgtccatgtttaagatgattatttaacttgcw

SEQ ID NO: 5453 - DNA, 178 bp, Homo sapiens
tgatgttacagaagtctcgctccagacatggtcctcggcttctcctcggagcgcaagccaggcatcgtgggaggtgagagcttcctaggatgaccgtccagccgctccacctacagccttcctggatacaggctggcatgactacatcgtccggaagtcgacagccgggatccaaggt

SEQ ID NO: 5454 - DNA, 108 bp, Homo sapiens
ggacatgatttcattctttttatggctgtgtagtatttcataggttcataggtgtatatggtgccacatttttcctcatccctgacaaccattatggcatctaggtta

SEQ ID NO: 5455 - DNA, 142 bp, Homo sapiens
gtttactttgttccaggccctattctaagcactttacatgtgttaattcatggaatcctctcaatatactataattaaccccacctgaaaaatgagaaaactaaagaacagagaaggtaaataattatgtgtccgaggtcct

SEQ ID NO: 5456 - DNA, 160 bp, Homo sapiens
caacccatctgaggctgcggcgtacacaatataggcaagggactgctggcaacggtacgggtgttggccatgaattctttggagatcttttgaggtggcaccacagcacatcggcagcctcaccatcgcagagatgccctgctggcgcaagtgggtctca

SEQ ID NO: 5457 - DNA, 168 bp, Homo sapiens
cagaagcggcgcacggcaccctcggaggagccgccccagcacagcccactgagaggagcttccaggacggacccaggccgctgagcccaggagcctgccaggctgacgtgcatcccacccagacggtgtcctcttcttgtcgctttttgtcatataaggatcccatta

SEQ ID NO: 5458 - DNA, 101 bp, Homo sapiens
ataggagccttccatctccaggatattctctatggggctgcccgttccaaaccgtacgaacatcctagagagcagatcggaagcagcaatgtagaggctga

SEQ ID NO: 5459 - DNA, 316 bp, Homo sapiens
atttggctcaggaatccataaaatccgaattaagtggaccaagctaacttcggattacctcaaggaagtggatgtttttgtttccatgggataccacaaaaaaacctatggaggctaccagggtagagtgtttctgaagggaggcagtgatagtgatgcttctctggtcatcacagacctcactctggaagattatgggagatataagtgtgaggtgattgaaggattagaagatgatactgttgtggtagcactggacttacaaggtgtggtattccttactttccacgactggggcgctacaatctcaattttc

SEQ ID NO: 5460 - DNA, 269 bp, Homo sapiens
caggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgactgggcagactgcaaaataaaatctcgggtttctatttatttattgtcttcctgtag

SEQ ID NO: 5461 - DNA, 285 bp, Homo sapiens
aggaataagcaagtgtgaaggccataaagtatgaaagagttcagtggattcaaactatagaaagaaggccagagaagatggaatgtgactagcccagggcaagatggtggatgacatgagctaatattggagagctaggaaggggtaagctcacaactggctttaaagatggtagtaggaatatggaattctatgatatagactccactgataggttacaagcaggatagcgatgtgatgtatacagtcatacagtcacatgctgccaattatgttttagttgat

SEQ ID NO: 5462 - DNA, 284 bp, Homo sapiens
cctctatggacagtgagtttgttttaatagatgtgctgtatccactgtgtgtgtgtctgggttttcaaaggcatattcacttgttgtaataggtttaattacctgtccaagggtggccaaattcaattataccttggtatatcttgtaaggcaaattacaattgtatcttgctgcaaccatatacaccatgtcacttgctgctctagcagtctgacctctcatcacataatcatgccacctttatcttcccactaataattccctctgactcttttaaattaaa

SEQ ID NO: 5463 - DNA, 225 bp, Homo sapiens
tctgccacagacctttgggctgccttatattgtgtgtgtgtgtgggtgtgtgtgttttttgacaacaaaacaatgcaagcattgtttcaacccatatttcctctgccatctctctgggggtgaagggaggctacctggggggggatcgccccactgacagacctaatctaattactgcctgtggctagagagtttgaggattgctttttaaaagagacagcacac

SEQ ID NO: 5464 - DNA, 180 bp, Homo sapiens
gttctctcctttccagtcggagacctctgccgcaaacatgctccgccagatcatcggtcaggccaagaagcatcccgagcttgatccccctctttggtatttaatgggaacttggagctactgggggccacatgtatcctctggcgtcttggcatggtcaattccaaagttttgttgggg

SEQ ID NO: 5465 - DNA, 280 bp, Homo sapiens
aaaacctggatgaggaagggtttgaaagtggagactgcggtgatgatgaagatgagtgcattggaggctctggtgatggaattataaaaggtaaggaatcagcttccgctttccttgcaggaccttggcctatgatcctggatgtggatgatgcgcctggaaacagtcagcaggcacctccgagggcaccgggataggcacctttcacaccctcgggaacgttcattcccgctgaggcttctcaccagcatgccatctcggtgtgtgctctcttcctggt

SEQ ID NO: 5466 - DNA, 195 bp, Homo sapiens
gacaagttggataccttagttgattttcctatcactgacttggatatgtcggaattcttaattaatccaaatgcaggtcccttgccgctattatctgatgcttgttccaacccactatggagggatgggagggaggcaattatacttttttgccaaaaattaaggtgagggaaaatggacctattttgaggacag

SEQ ID NO: 5467 - DNA, 140 bp, Homo sapiens
cggaaatccatatgagcttggaggtagaggagttggtggtgttggatttggttgttggttggttctgattgttcaacctagtaggtctcttaagtaagaggtgctgttggttggttaccttaagaagtttggagaacttg

SEQ ID NO: 5468 - DNA, 105 bp, Homo sapiens
ggcggttgaaatagtcccacatgtggtcatcagaaaataagccatttcctcataccaatataggatcagcttccttgaccctctagggtcaggagttcttcccat

SEQ ID NO: 5469 - DNA, 290 bp, Homo sapiens
cggcacgagttggatcgacatgacaatacagttataactgcagttaataacatgactctgaaaggttgggattcttacaattggcaactaattcatgttcctgatgggtcatgaggttaaggtattgttctttgacccaaccgttcgattctagagagttctctttcgtctcgggcaataaggaaaacggtagagtgtgggtatctgcgcaagaggatacaatatcggatcttaatctcatataggggtatgtacactctctcattatatacatctagaggatgagggcg

SEQ ID NO: 5470 - DNA, 160 bp, Homo sapiens
gaactatctcgcgttttttttttatttattgtcttcctgtaagaccttcgggtamaaggcagaggcaggaaactaacttggtgtgaggtcaaatggccccttaagttacttcccccagcccaaggccaagaggccttcctttaagggtcccggcaaagaa

SEQ ID NO: 5471 - DNA, 160 bp, Homo sapiens
tgttagggttctttgtttttggggtttggcagagatgtgtttaagtgctgtggccagaagcggggggagggggggttttggtgaaatttttttgttattatgtctgtgtgaagcggcttttcagacattcaattgttattattatgtcctacaagcattt

SEQ ID NO: 5472 - DNA, 165 bp, Homo sapiens
gaaagaacctgagctcttcctaagtagatccacgcctgtcgcaggcaaggccaagcaggcccatctcacaacccttaaggacatacaagcaaccctgtgtggaggagtttggagagaggattctgagatatagagattatattttcccaaaggtatagacttagt

SEQ ID NO: 5473 - DNA, 132 bp, Homo sapiens
acagtcaactcaggattttggtactcagaaaaaatattctcaggatgacaggagatcatgacaatcttaagttaagggaggattaggggatttttccaagaaggcttacccagaagggattgatctaaggga

SEQ ID NO: 5474 - DNA, 267 bp, Homo sapiens
  misc_feature 251: n = A,T,C or G
cttttttttagcttcaccgatgacaacagaggaggagggactgggatttggtaagtctcctcactgtttaccaaatcctaagtaataaatatgtgtccagaccctagaggagaccggctgactccttttaaggtgtggcacataggatctcagattttccctgagacagagagaggatcttgtgtatttttccccatatccactgatatatgacctaattgtattgtatatatgtcaccacacatatgatngccatccaccatttgt

SEQ ID NO: 5475 - DNA, 150 bp, Homo sapiens
agtaggaacctgttaaacgttaattttccctgccttcctcaggtttccctaatgttgggaaagtcctcgttgatctaattggcttggttgggccggaaaagtctgttaggttctctcaagacccccgggcccaacccccgatacttttaa

SEQ ID NO: 5476 - DNA, 250 bp, Homo sapiens
gcggcgcacagttccagtccgttgctttactttttgctcacgacatagtcattattccgaaggggaaggtttccaggggattacaaggggccaaaggtgggttccaaagtaactaaccgggagcccacaaggcgtgttcccaaatttttcaaccgaaccttttyccaccaaaaccctgacccmaamccrgggaraahatyttytaagaragacctgggagcaaagtttagcagaagcttctaaagggaag

SEQ ID NO: 5477 - DNA, 285 bp, Homo sapiens
aatattttttgtcattattacattaaggaaatttattatccaggtgacagtacatactagagtttttggaggaggtaggagccttgacctaaaaaggttgttttttcctgccaagaggcaaatttaaccaaggtgtgtcccagttaggtaaacccgagtatattgagagagggagagatctttgaacacgagatgatgcacttgcaaatgtgtgcaaggctttttcctgtaatgcaaatagggtgtcttctgtagaaatgtaaaggcactgagcctaagcatgag

SEQ ID NO: 5478 - DNA, 170 bp, Homo sapiens
aagcagcttcacctctctaccttagccatcagttaacaggctgagaaccacactaataggtcatggcaataacaatacaatgtcccattaattaggtatggaaatacacacacacacatttccctaatctattcccttttcaggatacaccatttacacatattctcact

SEQ ID NO: 5479 - DNA, 358 bp, Homo sapiens
gggaagaagttcagaggaaccgttggaaacgacgttaggcattttaccttttcagtaacattttatacatctacttgtcaatgtatttgagacattcacagccaaaagcctgggactctttgtgaaggtcctcctcacctctatctttctttctctctctctcaaactttccttaaagttctcattgcctttgcactgcttctgtgaacagtctttgtctcctccccacctttgggaaaggtgcggggcagtcctggtcagacactcatgccctggcaatgtggctgccagagaatgttgttgctacccaccagtttcttgttgatttggagaggtcaggccaggccccactcgcttg

SEQ ID NO: 5480 - DNA, 359 bp, Homo sapiens
ctcagacccaaggactatgaagttgatgctactctgaagtctctcaacaaccagattgagacccttcttactcctgaaggctctagaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatccagccaagaactggtataggagctccaaggacaagaaacacgtctggctaggagaaactatcaatgctggcagccagtttgatatattgtagaggagtacttccagg

SEQ ID NO: 5481 - DNA, 352 bp, Homo sapiens
aaacagtaagaagggataatcattaagatagtaaaacaggcaaagcagaatcacatgtgcacacacacatacacatgtaaacattggaatgcataagttttaatattttagcgctatcagtttctaaatgcattattactactgccctctccaagattcatttagttcaaacagtatccgtaaactaggatatgccacatgcattcatgggatcttttaagtactcttcagtttgttccaggaaatgtgcctactgaaatcaaattaatttgtattcaatgtgtacttcaaggctctaattgtttcatctgaagcctacaatgaatcattgttcaccttgaaaataaatttg

SEQ ID NO: 5482 - DNA, 348 bp, Homo sapiens; identical to SEQ ID NO: 3634

SEQ ID NO: 5483 - DNA, 310 bp, Homo sapiens
aggatgcctgcgtgtggtttaggtgttagccttcttacatggatgtcaggagagctgctgccctcttggcgtgagttgcgtattcaggctgcttttgctgcctttggccagagagctggttgaagatgtttgtaatcgttttcagtctcctgcagggtttctgtgcccctgtggtggaagagggcacgacacagcccgcaggttcttgggctcctcaggtcgcagggttggatgtgagtcaatgcggattatccactcgccacagttatcagctgccattgctccctgctgtttcccactctctaatttg

SEQ ID NO: 5484 - DNA, 299 bp, Homo sapiens
cattgacattgcacccatggacataggagggcccgagcaggaattcggtgtggacatagggccggtctgcttcttgtaaaaacctgaacccagaaaacaacacaatccgttgcaaacccaaaggacccaagtactttccaatctcagtcactctaggactctgcactgaatggctgacctgacctgatgtccattcatcccaccctctcacagttcggacttttctcccctctcttcctaagagacctgaactgggcaagcttgcaaaattaaatctcggtgtcttattaattaattgg

SEQ ID NO: 5485 - DNA, 209 bp, Homo sapiens
gtcaaaaccagggtaacctcctacatgggtcatgactctgggtcctgggtctgtgaccttgggtaagtcgcgcctgacccaggctgctaagagggcaaggagaaggaagtaccctggggagggaagggacagaggaagctattcctagggcttttccactccaacccaggccacctttgtctctgccccagagttggagaaaaaatctt

SEQ ID NO: 5486 - DNA, 202 bp, Homo sapiens
ctgttcttaagtgcttgaaagacgtaaaccaaagtgcactttatctcatttatcttatggtggagacacaggaacaaattctctaagagactgtgtttctttagttgagaagaacttcattgagtagctgtgatatgttcgatactaaggaaaactaaacagatcacctttgacatgcgttgtagagtgggatagagagggc

SEQ ID NO: 5487 - DNA, 215 bp, Homo sapiens
tttacattaaagttaaaatcgatcttgtgtttcttcaaccttcaaaactatctcatctgtcagatttttaaaactccaccacaggttttggcatctttgtgctgtatcttttaagtgcatgtgaaatttgtaaaatagagataagtacagtatgtatattttgtaaatctcccatttttgtaagagaatatatattgtatttatacatttttact

SEQ ID NO: 5488 - DNA, 336 bp, Homo sapiens
ttaactgatgactctgctgtcttccctccaagggaaaggaaagagaacttactgaatagcaccgctcttctatatgtgattgtcaagtaggacttctgtaatcatactgaaggtaatacattgtaatcatgctgaaggtaatcatctttgccccagctctcggatggtgtttctcacccaggctccttcaccaggcgtggttcatgcagacagccatgcagcagtaggctttcaagggtcaggcctttgttaaatgctcgctgacagcctgcatggtgcaggaggctggctcacagaaaccgggaagccaggaggtccgggggtcaggcactcagg

SEQ ID NO: 5489 - DNA, 207 bp, Homo sapiens
cttgaatgtaggtaatttaaatttccaaatgaaagatagatactggctaaatgaattaaaaaaataaacccaattacatgctgcctataagagactgacttcacctgtaaagccacccatagactgtaagggaatggatagagagagatatttcacacaaacagacaccaaaagcatgcaggagtagacagacacaaatactgagtc

SEQ ID NO: 5490 - DNA, 265 bp, Homo sapiens
gaaccatccaggccaaataagcgccggctatgccctgtattggattgccacacggctcacattgcatgcaagtttgctgagctgaaggaaaggattgatcgccgttctggtaaaaagctggaagatggccctaaattcttgaagtcttgtgatgctgccattgttgatatggttctggcagcccatgtgtgttgagagctctcagactatccacctttgggtcgctttgctgttcgtgatatgagacagacagttgcggtgggtg

SEQ ID NO: 5491 - DNA, 331 bp, Homo sapiens
cagagatggggtggaagccctgcctgggaataggacctcgttcttccctgcccggtgggtgggagtagtggcaggaccttgtcaccaggctctgatgaaggcagggaccagcttcttgggatctttcaatcccaaactcttgcccttcactcatcgcagttctccccacggctactccaggtcctcttgaaatccgtcctctccatggactcccacatcctctctgctctaggtttgattaacagaggttgtaaatgaaaccagcatctccgggggcagccatgtctactgacagatggcaggttactttgtacctgctaattttgttttt

SEQ ID NO: 5492 - DNA, 303 bp, Homo sapiens
aaaaaaacgagaagacatactgaaggcatgcaagcagatgcagatgataatattcttgattactcggatggaatggaagaaatatttggttcctcaattccctgaaacaagacattgagatatgaaatttccatgggtactcagacaatccagcccgaacttgtaagactgcactcagccatctgactcccagatggtgatattggattgatctaaccaggttgctcaggagattccttcaaagttactgtatttcacatctggggggggctgcattatcagcaaaatctgagggggagattc

SEQ ID NO: 5493 - DNA, 374 bp, Homo sapiens
gagagagaactagtcttgagttttttttagcacaagaatatttttagcctaacattattaataagaaatgtgtcaaatttttaacattggtaaaatatgttatgtgcattttgaaaacagaaaacaaattgcgttggcatgtacgtgggtgggaagaaaaagaaaattaacaggatttacacaattataatcaccagcagtgtgagtttaaaaaacttcgttgtttttacaccaaattaaaattttcatgtcaaacttcaaagccagaaggctgctaaatacgtgtctggcaggtaaagctggaaattacttaaacaggaaagtgtcattaaaaaacttgagcacacaacatattttttcttaaatgtcacgta

SEQ ID NO: 5494 - DNA, 407 bp, Homo sapiens
gccaagaatgttttcattaatcaagaacgaaagtcggaggttcgaagacgatcagataccgtcgtagttccgaccataaacgatgccgaccggcgatgcggcggcgttattccatgacccgccggcagcttccgggaaaccaaagtctttgggttccggggggagtatggttgcaaagctgaaacttaaaggaattgacggaagggcaccaccaggagtggatgtttttcagtggcctttaggagtagcaacatacaggaattttctgtggtggaggcaagttggtcaatgctgcatgatgagaggccatatttatgtaatttcttaggacgtttatgaaattcatccagacaggcactaatgacattttgaaaaggatggacgttagcttgttgggtttcagcagg

SEQ ID NO: 5495 - DNA, 396 bp, Homo sapiens
gctgcaggttgctcagaggcgccgcggccagcgcttttcttgaatgggtctctggtagggcaggctggcgtcctgccttgcctagagttgccgacttatgccgctgcttgtgcgctggtgaacagtcgctactcatgcctggtggccgggccgcaccaaaggcacatcgcgctgtcgccccgctaccttaacaggaaacgcaccggcattcgagaacagcttgatgcggagttccttcgctattctgagagccttttaggtgtcctattgcatatgataacatcaaagttgtggagagcttggagatatttatgatgatcaggacacattcatcttaacattgagcgattttgttatttctgcctgaccaggcagagctatgggttagttataagt

SEQ ID NO: 5496 - DNA, 218 bp, Homo sapiens
gaggccgcacgttttggcccgggagtggagggccagtcctacccctggcagtagggggcgttttgaagcttcggctctgtgagcttgtggctactgctactggggtctagtttgacggcagatttttgccagacgaggagacgtagcttatcacgagtacgtgaacctcacattgagctgcggggcgacgtcattcccgaggtcttacttgcgttcat

SEQ ID NO: 5497 - DNA, 302 bp, Homo sapiens
tccagactgaggaagacccggaaacttaggggccacgtgagccacggccacggcccaataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagcacgggtgattgctgctaaaacaagactggggctgtccctatcattgatgtgt

SEQ ID NO: 5498 - DNA, 245 bp, Homo sapiens
ctttagctgtttctctgtggtcattctggagtcaaattcaatatgaatgccttgtgagaaatgcttttattgactataaaatcagcagtctgaagagaaggtcatttctgatacagtattatagtcatttctgcacaccaatgccaattagagactatagatatgtacagcagtaagtaaggtcctcagtgatcatgctgatcactgaatcatatccaaaaatcgagcccagtatttccaggcct

SEQ ID NO: 5499 - DNA, 205 bp, Homo sapiens
ggagcaaccagctgttctcttgcacagatcgagagtgagggtatttgtgacattacacagcatcaggagcctggtgcctcatcaggtgtaagttcttataaccactcttggcaatttattaaggcagggtacaagtcatctgtaactcatggtggctctacggttacttggattccacaatccctaacccatctgtcctggcaga

SEQ ID NO: 5500 - DNA, 279 bp, Homo sapiens
gtgaaaaaaaaggtcttggtgaggtgccgcatttatctgtcatattctctgcgcctttcgagagcttccagcagcggtatgtgggcagagcatccgagttcacacctctgtggtcgtagagccactatgaggaggcccctgggagatttgccatttcagtggaaacagtggtcgttactagctaagatgtgtttgtactttggatctgcatttgctacacccttcctagtagtagacaccactgcttaaacataggatgtttcagttctacattacagt

SEQ ID NO: 5501 - DNA, 123 bp, Homo sapiens
ctcgtgccgaattcggcacgagggtcgatggagtcgaagcgctgaagggaatagggcggctttccttccagcggagcatcattcggctgtttacccaaaacaaacatcttaatttccaccttt

SEQ ID NO: 5502 - DNA, 170 bp, Homo sapiens
gtttttttttggtggggcggggggcggtaatagggtctcgctctttcaccaggctggagtacagtaatgacttctaactgcagcctccacctcctgggctaaaagtgatcctccaacgtaaagcctctcgagtagctaggactacaggcacatgccaccaccaaagccca

SEQ ID NO: 5503 - DNA, 170 bp, Homo sapiens
ttttgctttctaaagaagaatatatacaaattatggtttaaaaggagcagttggagccgggtgcggtggctcttggactgtaatcccaacactttggggggccgaggctgggtgggatcaccttcatgtcaggagtttcgggaccagcctgggcccaacatggccaaaac

SEQ ID NO: 5504 - DNA, 215 bp, Homo sapiens
cgccgcgccgccatcatggacacagccgtgtgcagcctatcaagctggccagggtcaccaaggtcctgggcaggaccggttctcagggacagtgcacgcaggtcgcgtggaattcatggacgacacgagccgatccatcatccgcaatgtaaaaggccccgtgcgcgagggcgacgtgctcacccttttggagtcaagagcgagaagcccggagg

SEQ ID NO: 5505 - DNA, 130 bp, Homo sapiens
gggagagatccctgcagaacccaccaaccagaacgtggtttgcctgaggctgtaactgagagaaagattctggggctgtgttatgaaaatataggcaatctcacataaggccaggtcatcaccatttcct

SEQ ID NO: 5506 - DNA, 141 bp, Homo sapiens
agggtattgcctcccacccctgcctctgcctcgcagagacagccaccttacactcctaaaccagctgctgcagggtttgcggcaggacctcaggcaaagccaggaagcaagcaacacagcttccacaaagcttaaaccaac

SEQ ID NO: 5507 - DNA, 135 bp, Homo sapiens
  misc_feature 97: n = A,T,C or G
cggcacgagctcgtgccaaattcggcacgagaagatactaaaaactataaaaattagatagcagtgcttgcttctttatagatacattagaaatacngttccaaataacatacttgaatatcatctttgaagtaa

SEQ ID NO: 5508 - DNA, 188 bp, Homo sapiens
cagcagtctcctggaggagcagttccagcagggcaagcttcttgcgtgcatcgcttcaaggccgggacagttttggcccagcagattgctattttctagagggcaaagagttggagttctatcttagggaaatcaaggcccccaaggcaaataaattcctgttttgtcttcaaccatgtaataaaggg

SEQ ID NO: 5509 - DNA, 133 bp, Homo sapiens
aaaaaacacacaaacctgttagtttcaaaaatgacattgcttgcttaaaggtctgaagtaaaggcttgttaaggttctcttaggtttgatttgagggcatcccgtaaaggtggtaggttgccaggattcccaa

SEQ ID NO: 5510 - DNA, 116 bp, Homo sapiens
cactgatttgatctgtgaacccagaaaatctgagacacagtctcagtttatatagagagtttattttggccaagggttggaggccgttgcctgttacaacagcctcaaggaggtcc

SEQ ID NO: 5511 - DNA, 125 bp, Homo sapiens
gtcacctttgctccagtcaacgttacaacggaagtcaaatctctcgaatacacatgaagcttttagtgaactcttccctgggcaccattttggcttcaatttcaaaaattttttctttcaaagat

SEQ ID NO: 5512 - DNA, 137 bp, Homo sapiens
cgagcttttaagctaacccgggatgctattgagttaaatgcagccaattatacagtgtggcatttccggagagttcttttgaagtcacttcagaaggatctacatgaggaaatgaactacatacactgcaataattg

SEQ ID NO: 5513 - DNA, 131 bp, Homo sapiens
tgtcaagtgaagacatttcattttttagcataggctagtgggcaggtccgcacagtcgaagccacacctggtctgttttctgtgcactgtagccttagtgtcacctttcttcttgtgtctcctaatggtac

SEQ ID NO: 5514 - DNA, 164 bp, Homo sapiens
ggctgcagataatcagagggaagaggctgcagataatcagagggcaggggccccagctgaggagggggcagaggctgcagataaccagcgggaagaaggctgcagataatcagagggcagaggccccaactgaccagagggtcacaggggcacagactatctac

SEQ ID NO: 5515 - DNA, 251 bp, Homo sapiens
tttaggtgaagtgttctctctcatgcaacagtaaaattaatataatattttccccacaaaagggacacttaacagaggcaaggtgcaatttataaatttatatctaaagggggatcatgattataagtcctccagcccttggactctaaattggaggggattaaaaggaatttaaaataattttgaccgaatttattttccccccagtttttgagggcattaaaaagggcattatatcaggcatatcatgt

SEQ ID NO: 5516 - DNA, 265 bp, Homo sapiens
tcgtgccgaaattcggcacgaggagattattaccaaaagcagcagggctatgctgcttgccaaacaaccaagaaggtgttcccgattagagtgcagaggtgggtgtgcaggagggcagtgctgtggaccgctgaggagcaagcggcggaaatattctttcgaatgcactgacggctcctactttgtggacgaggttgagaaagtggtgaagtgcggctgtacgaggtgtgtgtcctaaacacactcccggcagctctgtctttgg

SEQ ID NO: 5517 - DNA, 195 bp, Homo sapiens
gtttggtagaagagctggaggctgacgagtggcggtttaagcccatcgagcagcttctgggattcaccccctcttcaggttgatacttccctgatggtaacctcttgtgcgcagaagtgcaaagccagttggggactttctcacaacttacatagccatcccgaggtccacaactacgtcacttaatttttaatg

SEQ ID NO: 5518 - DNA, 240 bp, Homo sapiens
ggctattctacttactgcttagggtgtttgaaacaggatatatttactggatgaaaaaatgggctatattgagctgtctggcgttatgtaacgtgctttgggtatctgtgggactgctcccatgaggttattttcattggggttaatcagagaaccactctgggaaatgtgttggacccaccaagatcataaaatgagcttaatgattactcacacagcttcaagcgcgagtggagagag

SEQ ID NO: 5519 - DNA, 205 bp, Homo sapiens
ggacactaggaaaaaaccttgtagagagagtaaaaaatttaacaccatagtaggcctaaaagcagccaccaattaagaaagcgttcaagctcaacaccactacctaaaaaattccaaacatataacttaactctctcacaaccaattgggccaatctatcaccctatagaagaactaatattagtatatagtaacatagaaacat

SEQ ID NO: 5520 - DNA, 170 bp, Homo sapiens
cggcacgaggtaacaacttggagggcctctaatadgtggcaataccttcccaccacccaaagaattgcgagaaataattcagattaggtaatgaccaacttccaagggggtggacccttcttgccaacaaagaaacatattgtcccaaagtcaccaaagtcccccctctt

SEQ ID NO: 5521 - DNA, 180 bp, Homo sapiens
gagaggattcgtatggaaacattcttagcggaaaccctctcttaatctcactggcccatcccagcctcaggccaacttcaaagttaaaaggagggtgggatgatgacgttgtcttcaaggacctttccaaaaggtgtagatgacccagaggagagarcaaaaggatttgtaaatgacaca

SEQ ID NO: 5522 - DNA, 295 bp, Homo sapiens
caaacccactccaccttactaccagacaaccttagccaaaccatttacccaaataaagtataggcgatagaaattgaaaccttgcgcaatagatatagtaccgcaaggaaagatgaaaaattataaccagcataatatagcaaggactaacccctataccttctgcataatgagttaactagagataactttgcaaggagagccaaagctaagacccccgaaaccagacgagctacctcagagcagctaaaagagcacacccctctatgtagcagaatagtggggagcattatag

SEQ ID NO: 5523 - DNA, 285 bp, Homo sapiens
ctcgtgccgaattcggcacgagcctttttggcctggcttgtttgcaaaggccctggccaacgtcaacattgggagcctcatctgcaatgtaggggctggtgggacctgcttccagcagctggtgctgcaccagcaggaggtcctgccccctccactgttgctgctccagctgaggagaagaagtggaagcaaagaaagaagattcgaggagtcttatgatgacataggctttggtctttttgactaaacctcttttataacatgttcaataaaaagctgaacttt

SEQ ID NO: 5524 - DNA, 280 bp, Homo sapiens
gcttcctggtgagagaggaagcaactctccttctggttgtctgcctcccctcagattcyctgataggctgatggcatgtggctgtgactttgactttaatcattgctgaacaacatctctttgaatcaaagggttgattttcccagagggttctgggtcaggcatttctattagggggttgggagcaaaattgggtcactggcactctatgaagggtgtcccttcgtgctctgcgtgtgccctcagagtttttatcccgggcacatagtggaagtgtctc

SEQ ID NO: 5525 - DNA, 140 bp, Homo sapiens
gtgaatcggttgttctttcctcacatttggatgattgtcataaggtgtttagcatgttcctccttttccttcaaccctcccctttttttctcttattaatcaaggggaaccttcaaaggttaatgggaatggtcggtatc

SEQ ID NO: 5526 - DNA, 295 bp, Homo sapiens
gccacaattccatacattgatgaggatgctgcttttctgactaggagaatttttgttcatctaagaacatctcccctgggagagttagagcccaagtcggctcttgccttaaattcatgatccgattttatgaggggtcaccccggacccctcttgcccttaacatcgaggcctaggggaggcctggttccttcaggggggagagagtgggctcgcccccccctgggtgggtgtagacctcagagctcgcgggttgtttgtgagacccgcgagactctcgtgagttgggtcgttc

SEQ ID NO: 5527 - DNA, 250 bp, Homo sapiens
ggcaggttggagccgctgccgtcgccatgaaccgcggtaaccagcgtgagtcgcccgccagaaggaatatgaaaaagcagagcgactcggttaagggaaagcgccgagatgacgggctttcttctgccgcccgcaagcagagggacttggagatcatgcagcagaagcagaaaaaggcaaacgagaagaaggaggaacccagtagctttttgggcttgtgtccaaccctctttcccttcgcctctgtttc

SEQ ID NO: 5528 - DNA, 185 bp, Homo sapiens
ctgtgtccaagtgttcttattgttcaattcccacccatgagttagaacatgtggtgtttgggtttctgtccttgtgatagtttgctgagaatgatggttgccagcttcatccatgtccgtgcaaaggacatgaactcatcgtttttttatggctgcatagtactccatggtgtatctgtgccaca

SEQ ID NO: 5529 - DNA, 295 bp, Homo sapiens
ggatgtcttcctgaagcatgtacgtcttctgtcccgtaaacagttccagctgagggcactaatgcaaaaagcaagaaagactgccggtctcagtgacctctactgacttctctgataccagctggaggttgagctcttcttaaagtattcttctcttcctcttatcagtaggggcccagaataagttattgcagtttatcattcaagtgtaaaatattttgaatcactaatatattattctgtgttctcttggtgaagactcggctttaattaatggcactctctattcctctgt

SEQ ID NO: 5530 - DNA, 188 bp, Homo sapiens
cgatgggcatctctcgggacaactggcacaagcgccgcaaaaccgggggcaagagaaagccctaccacaagaagcggaagctattagtttgggcgcccagctttccaacaaccaagaatttgccccccgccgcaattcacacagatccgtgttgcggggaagggtacaagaaaattccgttcccctag

SEQ ID NO: 5531 - DNA, 210 bp, Homo sapiens
cggtggatcacaaggtcaggagttcgagactagcctggccaacatggtaaaactccatctcttgctaaaatacaaaaattagccaggcgttggttgtattttcctttaatcccagcaacttagggaagcttaggcagaagattcgtttagcccttgaggcggaggtttcaggtagccaaggtttgtccattgcacttcagccttgggatt

SEQ ID NO: 5532 - DNA, 260 bp, Homo sapiens
gatgatggtatgtgtgagcttgggtttataactaaatttgaaagttgttcactttctgagggaaatcaattgtggttcctttaaataatgctctttcccaagggtgtctaattgtcgggcctattaccaaaacctggtccattgattggttaataaccattgatgtgaccagattttgggtttaaaccaaaattctcttaacctgagcgcacatgagaggtatcatgacataggtacctcattcacacttaataaattcg

SEQ ID NO: 5533 - DNA, 200 bp, Homo sapiens
cgacgacgcgcgtgttccgggagcttggagctggagctggaccggctgcgcgccgaggaacctccagcttccttacccaggaccggacttcaccggcagccaggagccagccccggtttccaaggtttgggggcttggcttgaactttttttgggggaagggggccaaggggactttttacaagttatggaatttaacat

SEQ ID NO: 5534 - DNA, 205 bp, Homo sapiens
actaccatcagagtgaacaggcaacctacagaataggagaaaatttttgcaatctactcatctgacaaagggctaatatccaggattctacaaaggacctaagccaaatttacaaggaaaaaacaaccccaccaaaaaggtgggcaaaaggatttgaccagacatttctaaaaggaggacaatttatgcagcccacgagacacat

SEQ ID NO: 5535 - DNA, 205 bp, Homo sapiens
atcaaattctttcagctcctttgtttcatacggactcagatcctgagtaatccttttagagcccgaagaggtcaaaacccttaatgttccctcctgcttttcctgccccatgtcaacaatttccaggctaagggttgccccaggcccagggctttaaccttggtatcgggcaggcccaggaggcaggacagcagttttctccctc

SEQ ID NO: 5536 - DNA, 160 bp, Homo sapiens
tctggagctctattaggagaaaagtaatcattttaggtcttaaagacttcaagaaaatacaggttatcaatttaattttaaatctcattgttttccagtttagccaatatcatacctatttaaagctgtttaatttaacaaaattcaaatcaaaaagggc

SEQ ID NO: 5537 - DNA, 175 bp, Homo sapiens
cctaccacaagaagcggaagtatgagttcgggcgccagctgccaacaacaagattggcccccgccgaattcacaaagtccctgttccgggaggtaacaaggaatatcccgtcccttagggttggacggtgggaattttttctggggcttagagtgttttgaactcgtaaaccagg

SEQ ID NO: 5538 - DNA, 200 bp, Homo sapiens
caccaaagaagcaagagggctttcttttgtttctggggacaataactaactttaatttgctcttcaaggaaggaggaagcttggtatatagggggaaattgcaggaggtcttgaggttaacccttaggggcaatggctttaaggacaatcttgaaggagcaacacacattcattcatggggaagggcctctaattaggca

SEQ ID NO: 5539 - DNA, 165 bp, Homo sapiens
cgccgccgcttgtgctgcagccatgtctctagtgatccctgaaaagttccagcatattttgcgagtactcaacaaccaacatcgatgggcggcggaaaatagcctttgccatcactgccattaagggtgtgggccgaaggattgctcaagtgggtcttgaggaag

SEQ ID NO: 5540 - DNA, 215 bp, Homo sapiens
gaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactcgacgccacaagggcaagagggtggttttcctcaagcagctcgctagtggct

SEQ ID NO: 5541 - DNA, 205 bp, Homo sapiens
ggaagcaggggtctggcttagggaatcagttagaaggattccttcttctccacttcttttgtgacaagggagaattaaaaaatcacctcttcaccttttcactattaccatgtacgtcagatatttttagttcttcaggtgaatttttaaggtgatttagaattaggtcctttttttcctgttttgagcagcactagagcacaat

SEQ ID NO: 5542 - DNA, 195 bp, Homo sapiens
ggaaaatggtagcgatggcggctgggcgagtgggtgtctggtgccggcgtttgggctacggttgttgttggcgactgtccttaaagcggtgtctgcttttggggcagagttttcatcggaggcatgcagagagttaggcttttctagcaacttctttcaagactcttgtgatctttctcggacagattcaacctc

SEQ ID NO: 5543 - DNA, 214 bp, Homo sapiens
gattatttactttgcagactgtaaagctgccctatcttttccagcagaatttacttttccattcttaattcttttttgaaatatcttaaataatttaacattcctttataactttttaacagtgtcaaaactggggtaggagggattttattttttcccaaaagggttccatctttgctatctgttgatcagccttagagaatctaagtgatga

SEQ ID NO: 5544 - DNA, 186 bp, Homo sapiens
aaaaaacaatcctacaatgtagacagaaccacaaaagaatcagaatagcgaaagccatttttaagaaaaataaacttgaggaatcatagtatttgactttaaatgatactacagagctacagtaattaaaacagcatgagactgatcagttaacagtagagaggattcagagcatatcacatattt

SEQ ID NO: 5545 - DNA, 174 bp, Homo sapiens
ccaattcggcagagcaagccttgcgcctcctctcaggatgtctacaaattggtggtattggtactgttcctgttgggccaagtggagactggtgttctcaaacccagtatggtagtcacctttgctccagtcaacgttacaacggaagtaaaatactgtcgaatagaaccatga

SEQ ID NO: 5546 - DNA, 150 bp, Homo sapiens
ctcgtgccgaattcggcacgagccaaacttccaaaggattaaactacctcaaaacactttcccatgaggtgtgatccacattgttagggctgacctagacagaggatgaactcaggtgccttgttttcgttttcgttcataataacaaag

SEQ ID NO: 5547 - DNA, 265 bp, Homo sapiens
cttatggcttcttttccagtatcattttgtctcataggaaaagttgactgagagcctcatttgaatgaattcgccacctctcgtacttgttactagaaccgaaatcgattgaggtagaagaaaacaaacttggattttttaaaagggccatatcgattagaaccaagaagcatttttttttaagattcctaatcagaagagatgagcccattacaatcagttcttcatgaataagataccttcattattctatgacccctcttga

SEQ ID NO: 5548 - DNA, 100 bp, Homo sapiens
atcccttccctcgcagttcccctatcctgaggggagccccgccacgggcaagcgcggcggcggccgcaggagggaagaagttgaagcggttagctcgcgc

SEQ ID NO: 5549 - DNA, 170 bp, Homo sapiens
cggcactctgtggctccccacccccaggtctgtggtggtttctttgttttttcctggttctttttgctgtgctgatgaaacaatgaccctcaatacccatgtgtatacccacccctctgcccactgggtattgaggaagggtggctgatcctccctcctctcctactctg

SEQ ID NO: 5550 - DNA, 320 bp, Homo sapiens
ggtcaccagagcctgaccatactgacgctccagggggaagacgcagaggccgggaagagacaccccctcccaaacacataaaacttgccccttcctagcctcggctcccctcactggggccttgggcaggaccgacccgcatccaactaggcctaaggggtaggctctgagcctctcacccctaagaggcggagatgcgcccaaggcgggcgcccggcctgttcccagccctgcctggagccccgcagccactgcattttgtttaaacacagatagcacgcgcctctctcttattgctacagtgttttgtacacggttaa

SEQ ID NO: 5551 - DNA, 336 bp, Homo sapiens
aaaaaacctggtcaccaaaaatatcttctctgctaattcagcaattcttgggctccagttaggggagctggggcctcactttctcccagaattgttgggcttcactggaagttaagggttcaggaattacttggactttccaccccagccctgcctgccttttggttttggccagggaggcaagccattagggtccctggcacatgcacaaattgatcctttgcgtgacagtcttgtatggaacagatgctgacagatttgtagactaccatgccacacacaaggctaaatatctctccaatgggttccagtcagtttgagtcatcaaattttgta

SEQ ID NO: 5552 - DNA, 255 bp, Homo sapiens
ctcgtgccgctttttttcttcatctgttggtacgcatgcaatcttcttgggtttgtttttttgtttttttttttgaagaattaagggagctaaggatttacaaaaggcttttagtctttttatggaatcaatggcttcaatgtggcttacttattttaaaaatttctatggaaccttaaatggggaccgtaagttgcactcaattccaaatttacccggggtttaatgggaccctcaatttttacggcactaatt

SEQ ID NO: 5553 - DNA, 356 bp, Homo sapiens
gacactagtggatccaaagaattcggcacgaggcagcccaccaggctcaggtcggccagcatgcgcacctggctgttgttggccaggttgtacggacagtccatgaacttcctgtagcgtgcagcccgaccagtccgtgcccttgtagcagggcggcagttcctaaggcgttggcgttcgccatcacacatgtccacgacgtcctccacgtgcacccttttgcacatccgccactcgttaggtagcggacacgggtctcgtggcagggtgatgtagtagacttcctggcgtcgcagaggcggagtcgcgcgctcagcacgcgggcacgagttggtgagctcgctcagtcgcgtgca

SEQ ID NO: 5554 - DNA, 315 bp, Homo sapiens
taggtgaaagtacgtagttgtctttcgtaagttaaaatgataattgggccgaaacttactgccttacctaaaaggcagcgcagtcaggatattggtaggtcgggggccgcctttggaaacccttaagtttacaaggcatgccgcggactttaagtgctcattaggtcgccgggcgtccacgtcagccctggaccttgaaccccggcgtgcgttggcccttggccctcggggaaagttccgtgcactcggggactccggtgaggctgtcagccgtctgttaatgtggccatcttgagtctactctgcgctctgtgc

SEQ ID NO: 5555 - DNA, 338 bp, Homo sapiens
ggagtggggaggtgagaaagaggaagtaagtaaataaagctgctactctgtgctccaaaactactgagtagctgacatctgccatttgcattgaaaactgagaaagaggagtttggtttggtttttgattccacaagatgatgtggaagggcaaattgtttgggttctatgtgataaactttgagtacctcctgtgtgcctgcatactatgatggatacatatgcctagggtaaagggatgagagacacagatcatgtctttgagacgtttagcttgagtcacatttgctgagactgaggtggggcttgcatttgaaagctagcattttgggatgcac

SEQ ID NO: 5556 - DNA, 319 bp, Homo sapiens
ctgacttagtgtaacctaggagattttatagttttattttaatgaaaccctgattgacgcacagcagtggggagaacagcgtcttttacccttcaccgaagccaggaagcccggttttgtaaggcgtgttttgtgggtgccttattgtacatcctccagtggcgttctttttactctaatgttcctttgggtttcccccttcagaggattcatgaatttgcacagcacctaatttttggttactcttgtcttatgatggattgaaatgaagatttataggcaagcagatctgtgtcctcattatattgcaattggattg

SEQ ID NO: 5557 - DNA, 342 bp, Homo sapiens
atggtgagaaggaaaaaacggaacgagacaagaatcagagcagtagcaagagaaaggcttgttgtccctggacccggcagagcatccccttgcagttacaacttacacttttttgggtactccaggagaaccccccggccgttccaaggagcttcacagagctaatgaccagattatcaaacagattggcacctttccctctgtggagcagttctggaggttttatagccacatggtacgctctggggacctacaggccacagtgacttccatctcttcagagaaggagttaacccatgtggggggatgatgcaataaaatggtggcaagtggattattcgg

SEQ ID NO: 5558 - DNA, 160 bp, Homo sapiens
gcagttcagagaatgatttcttatgatgataaaaatcgaatgggatcagacgatgtttgcaattttttaatacttgaataggacaacctaaggtttgaggattcaatttctttttaggacacacatcacacaggtttaatccggtgattccctttgtcac

SEQ ID NO: 5559 - DNA, 319 bp, Homo sapiens
cagggacggggacaagttctggcggatgcccgagtgctacatccgcggcagcaccatcaagtaccttcgcattcccgacgggatcatcgacattgtcaaggaggaggttgttgccaaggtccgcgccgcggaggccttcagcagcagaagcagcagagagggcgcggcatatggcggcgctcgcccggtgtgtgtttgtgtgcccgggccccgatgtggtcatccggcacacacagagacacacagagaggaggactctcagcacagaggcgcaacagcagtgcgccaccacgaccactgttgtgcccctctgcaacat

SEQ ID NO: 5560 - DNA, 160 bp, Homo sapiens
cggcacgagattccattagtctccattcaattccattaatctcattccattccattctwcttcaacttgattccaatacattctatttccttccattacatttcattccatatcataggcatatcatatcattacataccaatccatataggtgcacatc

SEQ ID NO: 5561 - DNA, 180 bp, Homo sapiens
aactgacccaggtaatgaaatggagcccttccctggaactaaccagtccttgatgttgtgtgactaagtaaaggtgataaaccccatcttcttgggggtgtcaattcacaattggcaatcaatgtgaaagctttcactatcccttggccaattcctctttccctctcttccaaacccata

SEQ ID NO: 5562 - DNA, 211 bp, Homo sapiens
ctcgtgcgaattcggcacgagaacacaacacgcccagctggcggcagcagctgatatcgatgaagaaccagtcagttaagcaaaaccaagtccgagttaaaaggaggcacggaaggctctattccaaacctggggtttcggcaaggttacacagggtttctctgagtctacactatccgagatctctagagtataccctctgtcatatcac

SEQ ID NO: 5563 - DNA, 320 bp, Homo sapiens
cgcggacggggttgtgcctggaggttgaggggaagattgtcagtaggacagaaggtaacatttatgacttgcttattggttggaaattccttcccttgagggcccccagggcgcaaggtaccccaaagagacagtaatcactctgtgttcgcgtatatttcatatgacccttacctctcacggaacacatttcacacaagagagctctacgggtgcatcatcagagttcatcatgatctctctcaggggagacttcttggagcagcagaccaccagcgaagtagtaacctcctatgatgatcaggctgctgcagcagcag

SEQ ID NO: 5564 - DNA, 260 bp, Homo sapiens
gcaaagcgaaatttggtcattctcgctaacatctgcccagctttgagtggcataatattgaacttggcacagcatgcggaaaatactacagaggtgtgtcacacatggctatcatttgattccggttactctcgacatacaattagaagcatagccacacacacacttgtgaaagagtaaacctctttcacatcacacaatatcacctctcacacctctaaaccccccacaatttttctcttatataatttgcttctttt

SEQ ID NO: 5565 - DNA, 104 bp, Homo sapiens
ttcaccttcaaaatgttctatttaacaactgggtcatgtgcatctggtgtaggaagttttttctaccattagtgacaaccaataaatgtttgttatttacactg

SEQ ID NO: 5566 - DNA, 310 bp, Homo sapiens
cccaggcctaccaggtaaactgggttctctgggtagccctggcctccctggcttgcctgggccccctggacttcctggaatgaaaggtgacaagggtgtagtcggtgaaccgggtccaaagggtgaacaaggtgcctcttgtgaagaaggtgaagcaagagaaaggggggaactttgagatataggattacctcggcccaagggatctccagataatactcgggaacctctctttagagacctcaggaagttgcgggcttcctcgagtagaagaaccacgaggaccacactacacccggtgtgcagcaag

SEQ ID NO: 5567 - DNA, 322 bp, Homo sapiens
aggcgctctgctggcagtgctgaggacgggtactccagctccaaggcctggagaggcttcccagcaacacctgcaagtccagcccccctcttctaggatgagccactgtagatcattaaagttcctccttgagaggctgagccgtagccaaggattggggagagcccttgtctctggtcaaccctcggagcattgggatcgtgggaaagaggagggggcccaggcccaggcaggggtcagaggcccaggccctgacttcggcttcccagagatctctccgccttagttaagagcatgtgtcgggaaatcctcagagtctcag

SEQ ID NO: 5568 - DNA, 200 bp, Homo sapiens
gaaaatgtgggttctgtgtgtggcactgatttatcaagacaagagggacatgcttcccctttgtccacctttgcagccttttttctgtcatgtaggttcaacatgtgctacctttgagtgttaaactaagggtagactactttggggattgagaacaatgcaaaatcaggaaaggctgttggaaggagatatccgtctac

SEQ ID NO: 5569 - DNA, 131 bp, Homo sapiens
taaaagagcatccggttttggtatggggatgatccaggattatgttgtgactgatacataattagttacttgtgcttttattttttttttatgggggtttttgaaaggggtaawatctmaarkgtgavggg

SEQ ID NO: 5570 - DNA, 100 bp, Homo sapiens
gcacatgccgtgacttgagactcagccacccagagttgagcagtggttactactggatttaccctaacccaggattcactattggaggtttataaaaggg

SEQ ID NO: 5571 - DNA, 140 bp, Homo sapiens
agcaggagctttttgcttagcactgaaaattctggataatggtgaatggacaacaactctacaacattaactgtcatatactgaaggatttcttcttccagttatgaaagaaccttggcttaggaatgtcaggaatggga

SEQ ID NO: 5572 - DNA, 310 bp, Homo sapiens
ctggagcccagcaagattacaaagtttgagaatgctttcttgtctcatgtcgtcagccaagcaccaagccttgttggggcactatcaagggctgatggaaggttctcaagaacaatcaagatgcaaagctgaaagaggatttttaaccaaatttcttggctgggatttgaagcttaaactcctttggtgttcaaaacaaataccaattcagttttgtcattgttctagtaaaattagatacccttgtgaaaaggggtactctcatactccctatgtacagaaatcacaagaaaaataaaggtttcctatg

SEQ ID NO: 5573 - DNA, 140 bp, Homo sapiens
caagggacttgcaggaactgcagaagaagctgtctcttctgatagacttcttccagaataacttcaaaggtcagttttccaattcactatgttataatgggaaaatccccaatataacactaggcataaacacaggtaga

SEQ ID NO: 5574 - DNA, 315 bp, Homo sapiens
gtcgaagcgaggacgtggtgggtcctctggtgcgaaattccggatttccttgggtcttccggtaggaggctgtaatcaattgtgctgacaacacaggagccaaaaacctgtatatcatctccgtgaaggggatcaaggggacggctgaacagacttcccgctgctggtgttgggtgacattggtgatggggcacagtcaagagaggcaacccagagctcagagaaaaggtacatacagcagtggtaattcgacagcgaagtaataccgatagagaagattgcgtgtttctctatttttgatgataaattcaggag

SEQ ID NO: 5575 - DNA, 141 bp, Homo sapiens
ggagatcaaggaagagcttctgcattctgagaagcttaagacatactttgaagacaaccctaagggaccttcaagctgctgcggcaatgaacctaccttttgcaaccccgcagtaggtgaaggccccaccttgggccaatg

SEQ ID NO: 5576 - DNA, 140 bp, Homo sapiens
ggaggctctcagcccctcttacccagcgcctgccccagctgatggcacccaccccacccggcctcaggaacttctttgaacagagcaagtttcccaaaggccgacctttgtagcccccaaggatcacaagctgttaccca

SEQ ID NO: 5577 - DNA, 205 bp, Homo sapiens
ataaaatctcggtgttctatttatttattgtcttcctgtaagaccttcgggtcaaggcagaggcaggaaactaacttgtgtgagtcaaatgccccctgagtgactgcccccagcccaggccagaagaccttccttcaggtgccgggcgcaggaactgtgtgtgttctacacaattgtgctattctgtgtcaaacaacctctgtat

SEQ ID NO: 5578 - DNA, 196 bp, Homo sapiens
aaaaatgtaaaacttggttgcattatttgtggaggctcaaacttgtgaaggttaataccataatttttccatttgttctgcattttgattctgaaaagaaagctggctttgcccatttcttattaaaaaaccttgttgtaaatccagttgtctaatgggatctatatggagttagccatgtctgtatgccctctcc

SEQ ID NO: 5579 - DNA, 166 bp, Homo sapiens
cacccatgtctcattttgctaaagttatgtgactttataatacttaactaaatattgagtgagtgaaatccacggaggcactgttcatggctgtaggaaatcatatgtaataaccgctacatgcaaggtacctagggcaatggttattgggatgaccaatcattgt

SEQ ID NO: 5580 - DNA, 210 bp, Homo sapiens
ttggaatggtgacaacatgctggagccaagtgctaacatgccttggttcaagggatggaaagtcacccgtaaggatggcaatgccagtggaaccacgctgcttgaggctctggactgcatcctaccaccaacttggtccaacctgacaaggcccttgcggcctgcctctccaaggatgtctacaaaattgggtggtatttggtactgttc

SEQ ID NO: 5581 - DNA, 212 bp, Homo sapiens
ctcgtgccgaattcggcacgagaagaaatactcctgtattgagttgtatcgtgtggtgtattttttaaaaaatttgatttagcattcatattttgcatcttattcccaattaaaagtatgcagattatttgcccaaatcttcttcagattcagcatttgttctttgccagtctcattttcatcgtcttccattggttcccagaagctttgtt

SEQ ID NO: 5582 - DNA, 226 bp, Homo sapiens
gagccacggccacggccgcataggcaagcaccggaagcaccccggcggccgcggtaatgcttgtggtcttcatcaccacccgatcaacttcgacaaataccacccaggctacttttgggaagtttgtattaagcattaccacttaaagaggaaccagagcttctgtccaactgtcaaccttgacaaattgttgacttttgtcagtgtacagacacagggtaatgct

SEQ ID NO: 5583 - DNA, 153 bp, Homo sapiens
gcactttgggaggccaaggcaggtggatcacctgaggtcaggagttcaagaccaaccttgccaacatggtaaaaccccatctctgcttaaaataaaaaaattatcttggcgttgtggttggtgcctgtaattccagctactcgggaggcttag

SEQ ID NO: 5584 - DNA, 170 bp, Homo sapiens
aggaaaccatctcccccaggaccttctgtctgggactcaggagtcctaaggaaaaggaattctaaaacaatggggaaggggaggtagagcacttatgggtgaaaaagttgaggccaacacacagggcaagttgggtcgatggagtcgaagcgcttaaggaataaggccgc

SEQ ID NO: 5585 - DNA, 192 bp, Homo sapiens
gcaggttggagccgctgccgtcgccatgacccgcggtaaccagcgtgagtcgcccgccagaagaatatgaaaaagcagagcgactcggttaagggaaagcgccgagatgacgggctttctgctgccgcccgcaagcagagggactcggagatcatgcagcagaagcagaaaaaggcaaacgaggaaggaggg

SEQ ID NO: 5586 - DNA, 290 bp, Homo sapiens
gtagtggggtgttgcaggggcctgagtgcagggccacagccatccctgccctgctctggccaacctgcacctttccttaactttgagtccactggaagctgtgagtaagcggctggccatcctggagaacacagttgtctaaggctgcctgtcaccactgtggcctctccaagcgygctgcacgtgtccgccgtagctttaccattttagtgagggaagccagcccggggtgggagggggtgtgtctgggggtgcctattgagagcgtgtaatggcgtttgggagctcgt

SEQ ID NO: 5587 - DNA, 122 bp, Homo sapiens
agcaacttagtgccttgtaatctaactttgtcactgtgactacattacctcttcagcgccagagggcacccgtgggcctcccggagcctttgcccatggcaggggttgagacccggaaccag

SEQ ID NO: 5588 - DNA, 250 bp, Homo sapiens
gttgaagggcctaaccagcctttgggagtattgactggtccttacctcttatggctaagtctttgactgtgttcatttaccaagttgacccagtttgtcttttaggttaagtaagactcgagagtaaaggcaagaaggggggccagccctcttaatgcggccacggatgccttcctgctgcaacccattccccagtcttccactgaacgtgaagtcctcttttagaatccaaacccaccattaactggtc

SEQ ID NO: 5589 - DNA, 180 bp, Homo sapiens
ctggtgctgatttatttcacacggactgtgcctgctttgcccagagtagagcaagaccaatttttcctttacaaatacatgatttaaactttcatcaaaaatttaactggtgctaaaaggcaggccaaaggcaaattcagcattttctacttactacatgtcagtaaggttcaaggattt

SEQ ID NO: 5590 - DNA, 290 bp, Homo sapiens
gctcccactgcgttcctccaatgacacgtgggaattgtgagaattacaattcaagatgagatttgggtgggggacacagccaagcaatatcaggtttttattgccagatacagttttctgagctgaatatgttttagggaagtgtattaacttttaaaactgaatcataggattagatgtttagatcctcgccttgaaaaactcaccaggtcatattacagagttccagaggacacatttctgactctaagcattattgaactatttggtaaatagagatacagatgatc

SEQ ID NO: 5591 - DNA, 300 bp, Homo sapiens
aaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaactttcgcaagatgggagcgcccgaatctggcttggcggaatatctctttgacaagcacaccctgggagacagtgataatgaaagctaagcctcgggctaatttccccatagccgtggggtgacttccctggtcaccagggcagtgcatgcatgtttgg

SEQ ID NO: 5592 - DNA, 142 bp, Homo sapiens
acagaccccacggccagtgcaaaggctcagaggtgggaacagctgggagtgttcaaggaggagcagaaggtgaaacggagggagggcttggtaagccattgcgtttggagagaagggttggttcacttccttggagaggctt

SEQ ID NO: 5593 - DNA, 190 bp, Homo sapiens
cgtgccgaattcggcacgaggtcatctctgctgagaaagcctaccatgaacagctttctgtagcagagatcaccaatgcttgctttgagccagccaaccagatgggtgaaatgtgaccctggccatggtaaatacaaggcttgctgcctgttgtaccctggtgacggggttcccaaaggtgtcaatgtgc

SEQ ID NO: 5594 - DNA, 150 bp, Homo sapiens
caatttaatgtaaagtatttggctttcaaatggtttctctgtgctattttttggaattctttcagattccagagatatcttacggtctttgattcaatttaaaatttgtacttattttcttttagaaataatgtattgtgtccgtgcaga

SEQ ID NO: 5595 - DNA, 309 bp, Homo sapiens
  misc_feature 278: n = A,T,C or G
ctacactctgtagaaatcctcttctctttctaggtcttttctgatccaggagaaattaactatggcatctttttagttatgattggagatgttaaccatctattctctctgtagtctgctacctaagaggctttttcctgcataataaggaccctggcctcaccattccttatctaaaccaggcatatttcctttgatccaagccttgggctaataacaacactctccaacaattcgccatcaaaaaaattctttgatctactgtgactggagccccnactttgtgtgtcgtgcattctggatcgacca

SEQ ID NO: 5596 - DNA, 312 bp, Homo sapiens
ctcaaagctcttcggaagaaggctcttgaaaaaaatccagatgaattctactacaaaatgactcggggttaaactccaggatggagtacatattattaaggagactaaggaagaaggtaaccccagaccacctaaagctgatgagacctcaggccgtcaaatatatagagatgaagagggttgcagaggctaagaaatcgaagactaaattcagagctccatctgctggatttccaggggaggcacacacaagcatgtgtctttttgacacaaaaggaagtgcacagttgatgtcgcactcactgcaaacag

SEQ ID NO: 5597 - DNA, 280 bp, Homo sapiens
ggcaaatgacaagcgataggctattgcaacctgagaaagagaactgctccttcatcgtaaatttagaagaccaagtagataatggaaccaaagttgttacttttttctagtagttatttttcccttttcctttttgtgtacctctacagagaccaaaactcattcttctaaagggatttaatggggctacttcagattaaaattaggcacattataagggagctcagagtaagggagtccatctcaaaaaaattgattgtatccactgcattgagagtat

SEQ ID NO: 5598 - DNA, 320 bp, Homo sapiens
cagataaccctaaagatgatactagaatgtttataaaattattgagaagattatttgtgttataaagcttaatttgtaccatagtaaaggatgttttttggttcctctcaatcctgggctaatccggtcaatacctgaggtccagtctttcccccttttcttaaccactctaacccttaattcccgtgtaccccatctcttctcggactctcctgagagtacagagtacccagacatgtgtccctgggatagccctctagagtctgtcaccaccgagattcccaactcgggataatgtgtcctaattctatcagctggta

SEQ ID NO: 5599 - DNA, 240 bp, Homo sapiens
ggctgactgcgtgccagagtggccacggcctttcaatctgtcccgcttctcctccgcctgcgacataggaggcttgcaccgattgcactggccgagagctggcccgtgagtaccctggtatgcagggtgactttgtttgacctcccagacatattggagctggccgcccatttccaaaccccgggaccgcggagagtcaggatcctttgcgagcgggtgtctttttcaggcccctctccc

SEQ ID NO: 5600 - DNA, 327 bp, Homo sapiens
ccgaagcgggagcggccaaaatgaagtttaatccctttgtgacttccgaccgaggaaggaatcgcaaaagggcatttcaattgaaccttccaacattcgagggaggattatgtcttcccctctttccaaggagctgagacagaggacaaccgtgcgtccatgcccatccgaaggttgttgaggtacaggttgagcgtggacactatagaggtaagcaaattgggcacagtagtccaggtttacagggagatatatgatatctacatagcacgggtagcagcgggaaaagttaatggcacactctccacgtaggcattcaccccagca

SEQ ID NO: 5601 - DNA, 290 bp, Homo sapiens
tgatgggtgactcagagtgcaggactgcctggccgtggggcagaggggtttgccttctcggagggtacctcctgttccctgtctgaggcatcctgcatggaggtaaagggaattccctttcttggtgacgactaaattttgggttccttcagccattgggttgcacccacacatatattaaatggcttcttcttaaggcccagagagagagtttttttaagagtctctcgccatatagctgagccaaaggtctgttcagattccacttttgggtattgtggcagttaaac

SEQ ID NO: 5602 - DNA, 155 bp, Homo sapiens
gacaagacgcatggagacccgcctgcctggtctttttgggctctttaaatatgcggcggccgcggagggagcccggggcaggggctacggggagcctggttccccgcaagacggggttaacttgcccagtaagggcgcgcttgaaaggagtgtcc

SEQ ID NO: 5603 - DNA, 101 bp, Homo sapiens
agtgccggctggtcgctgagactgcggatggagctgcggagaggcctgatggggcccaccatcccggacccaagtttttttcctttgcggggcttttggtt

SEQ ID NO: 5604 - DNA, 135 bp, Homo sapiens
gttggctgtatctttgcagagatgtttcgtcgaaagcctctcttctgttgaaactcttaagccgaccagtttgggcaaaatcttttgaccttatttgggcttcctccagagggatgtacttggcctttcggatgt

SEQ ID NO: 5605 - DNA, 141 bp, Homo sapiens
gccagaaatgttcggtgatcccgggactcactgctgcaggatggggaatttagcattggatcttcgtaccaaggggcaaccggttggggcccccaacttcaattttaattttacccaggcttacaaaagcggttagccctc

SEQ ID NO: 5606 - DNA, 131 bp, Homo sapiens
cccagacctcggcttgcagtagtgttagactgaagataaagtaagttcctgttttggcttaacaaggatcctcctttttgcagtcttccagcccaagggccgcttgatttccaacaacgcctttacccggc

SEQ ID NO: 5607 - DNA, 127 bp, Homo sapiens
caagaacagcattgcatacatggatgaggagacttgcaacctgaaaaaggctttcattcttaagggctttaatgatgttgaacttgttgctgagggcaacagcaggttcacttacactgttctttgt

SEQ ID NO: 5608 - DNA, 125 bp, Homo sapiens
cttggctagcctcccagcaagggcgcttggatgcagaggagcttggcagacaacttcgggaggccggccatgaaggccaagccgggtcttttcttcttgccgtgagggggacttaccaagccttc

SEQ ID NO: 5609 - DNA, 125 bp, Homo sapiens
agatcgccatcatgaacgacaccttaactatccccactagaaagttcatgaccaacccacttctttaggggaaacaaatggtcattatgtccctcaaccccgggaaggcgaacaattccttagac

SEQ ID NO: 5610 - DNA, 111 bp, Homo sapiens
cagccagagaggggtagggaacacagcaggtcagagagggggagataaaggacttggagagagttgtattccaaacaaggaccaactagttacctcttaagggtgttgtga

SEQ ID NO: 5611 - DNA, 116 bp, Homo sapiens
ctcgtgccgctgttctccagatggagaaacaggctctgagatttcacaggttttgcccaaactcattgattttgatgattaaaaaggataaacacagggtttcccgagtaggaggt

SEQ ID NO: 5612 - DNA, 110 bp, Homo sapiens
ctcctctctttcggttttggaagggatccatctccaggcagccaccctggtggggcttgtttcctgaaaccatgatgtactttttcatacaagagtctttcccgaggtgc

SEQ ID NO: 5613 - DNA, 129 bp, Homo sapiens
ccttgaccacatgctgaccggtgccttgggatttgactagagttgctggctcgaggcccagcacgaggacttaccctggggttttgttaggtttggaagcagctttccctagggggtaaagtccccccc

SEQ ID NO: 5614 - DNA, 173 bp, Homo sapiens
gcaaagaatatttctccaagcagaagtgagccctgggctgttttagtgccaggctgcggtgggcagccatgaagaaccaaaacctcttctgtaattttttttttccattggtgaaaaaaaaagactttaagatttaagccgcattttgggkgtttttaaaaggcaggccttty

SEQ ID NO: 5615 - DNA, 151 bp, Homo sapiens
gaccaggactgctgcctactgcaggtcaccaccctcaatttcatctttattccgattgtcatgggaatgatatttactctgtttactatcaatgtgagcacggccatccgggcatcatcgggtaagactggtttccaagattcccctttcc

SEQ ID NO: 5616 - DNA, 132 bp, Homo sapiens
ggtatctctccagtgggtcttaaaggagacccaggagccaccgagaaaggggccttccaggcctcccaggccagcccggcccccctggacaccctggccccccagggtatacctggtacggatggtgtcaga

SEQ ID NO: 5617 - DNA, 209 bp, Homo sapiens
cctctccccacttcagaggccacccactcagcaccaccggcctgccttgcctgcagactataaactataaccactagctcgcacacagttctgcagtccaggcgtttggggccgcctcccggctcggggaggccccggggcttggaacgccctttccttcctgcgccgaagccaacgcccccttttttccttccctgggcctttttccg

SEQ ID NO: 5618 - DNA, 187 bp, Homo sapiens
ccagccggcaaaggaaggaggtggaaaaaaaccgccaccgggctgactttcacctcccagtggtgagcagtgggggcccaaacccagttttccttctaatttttgttaggttctccctttcggcctccctatttttttagggaaggggaggtggggtccaagtaaaaacttggatgggagaagccat

SEQ ID NO: 5619 - DNA, 107 bp, Homo sapiens
tctgtccccagatgctctgcctcccgttccaaaacccactcatactcagcttgcacaaactggttgaacggcagggattgaaaaataaagagagattggcttttgtg

SEQ ID NO: 5620 - DNA, 123 bp, Homo sapiens
ggtaaaaatagctttcctattttcaggaagagccgtggtatatttaggaaaaatgtttctacttaattacggttacttctttcgtcgattggttaataattggaacgtttataaggttgcctt

SEQ ID NO: 5621 - DNA, 210 bp, Homo sapiens
attagtgttacccttgtgactttctgttgtacataatcctttttctaaatacatcattaatataattatttttttatcagcataagcttactgaagaggaaaaaaaatcttactgtgcccttactattttacagagcgtcacatgatatcacgttagtcagctgctgtcggctggtggtgccagacatcaaagggagattgggaaacttt

SEQ ID NO: 5622 - DNA, 171 bp, Homo sapiens
ctcgtgccgaattcggcacgagttgggaacacaaagtcttggatgaaagcacatctgtttgcagtatgtgcttacggagatattttttagcacacctgtttagaccctgtcttctttagaaaaaaagagttacttttcaaaaatatttactgcttatttgacaatgcacct

SEQ ID NO: 5623 - DNA, 212 bp, Homo sapiens
cgcacaggccggaaaaggcgcatctaacgcgtatctaggcttttgtaacttcggacaagttgcttttacccttatttgatgatacatttcattaaggttacagttatatatattttgttaatatttattaagtgactatagagatgcaactccatttaccagtaacttattttaaatatgcctagtaacacatatgtagtataatttctaga

SEQ ID NO: 5624 - DNA, 113 bp, Homo sapiens
cactcacaacaaaactaactaatactaacatctcagacggtcagggatatgggcaccgtctgaactattctgcccggcatcatcctagtcctctatacgcgcctcccatccct

SEQ ID NO: 5625 - DNA, 305 bp, Homo sapiens
gccatgagtatgctcaggcttcagaagaggctcgcctctagtgttctccgctgtcgcaagaagaaggtctttgttagaccccaatgagaccaatgaaatcggcaatgccaacttccgtcagcagatccggaagctcatcaaagatgggctgatcatccgcaagcctgtgacggtccattcccgggctcgatgccggaaaaacacttggccgccggaaggcaggcacatgggcatagggaagccggaagggtacagaccaattccccaatgtccaaagagggtcacatatgattaggagagtgagg

SEQ ID NO: 5626 - DNA, 175 bp, Homo sapiens
cgggggttgaggggggcgggcctggacctgggggagtgaaagcgaagccgggcgacttagccgggagaccagagatctagccgacttaagcagcatgtgccaagccgtgttgggtgcgcctgtagctgggaagcccgcaaacaggtgtgagtgtcttcagacagatatctttttc

SEQ ID NO: 5627 - DNA, 136 bp, Homo sapiens
gccatccagactgaggaagaccggaaacttaggggccacgtgagccacggccacggccgcataggcaagcacccgaagcaccccggcgggcgcggtaattcttgttgtctgcatcaccaccggatcaacttcgaca

SEQ ID NO: 5628 - DNA, 287 bp, Homo sapiens
cggccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtacatcaggaagacagcgggttaagctgataaagggaggaaaagtccacccc

SEQ ID NO: 5629 - DNA, 290 bp, Homo sapiens
caagaaccctgctcgcacctgcagagacctgaaactctgccacctgagtggagagtggagactacttggattgaccccaaccaaggctgcaccttggacgcatgaaggttttcttcaacattgagacttgcgagacttgcggctatcccaattcagcaaacggttccaagaggaccttggtggaccagcaaggaccaaggaggaggaaccaactttgttttggggaaccactaattggtgccttccattcagctattggatacatctggcctccaccacttccaacgacc

SEQ ID NO: 5630 - DNA, 200 bp, Homo sapiens
gctccccacagctttgcaccccttttcctccccatacacacacacaccattttatttttttgggccattaccccattaccccttattgctgccaaaaccacaatgggcttgggggccaagggcttggttggacaagcaacttcccctaccccattatcccttcccgtgttgtggttgggaaaacttttggtttttgtggg

SEQ ID NO: 5631 - DNA, 300 bp, Homo sapiens
agtactcaacaccaacatcgatgggcggcggaaaatagcctttgccatcactgccattaagggtgttggccgaaggtattgcttaatgtgggttttgaggaaagcagccatttgaccctaccaaggaggccgggagaaccttacttgaggattgaggttggaccggtttgatcaccattattgcaggatccacgcagttccaagatccaagcttggtctttgacaagcaagaggattttaaagatggaaattcaaccaaggccctagccaattgtcttggcacaagtccgtaaggcctgg

SEQ ID NO: 5632 - DNA, 300 bp, Homo sapiens
tgaatgacggcgtggaggacctccgctgcaaatacgtctccctcatctacaccaactatgaggcgggcaaggatgactaatgtaaggcacttgcccgggcaactgaaggcttttgagaccctcctgtccaagaccaagggaggcaagacctcaattgtgggagaccagatcttcttcggctgactacaacctgctggacttgctgctgatccatgaggtctaggccctggctgcctggatgcgtccccttgctctaagatatgtgggcgctaagtcccggccaagtaaggcttctggctc

SEQ ID NO: 5633 - DNA, 222 bp, Homo sapiens
gtttattctgggaaatgttttaatgccagggcctgctgagttgcttcttcttgtgggaggatttttttttaatctccctgaggttggtataaaaggttggtactgccatcctaggtttactgggataaaatttaaaaccaagtattgtggaaggcttaatccaaaactattcctaagccttcaaatggtatggtaaatgggaaatttccagtaaattctgtg

SEQ ID NO: 5634 - DNA, 145 bp, Homo sapiens
cccaaccccactgaacacaagcggggtgcaggtgatctgcatgaaggggaaggccaagtacaaggcccagcgagaattgccattggtgtgggaggattcaaggcgcattggcaaggcattgagggaattgcagattcaggcccag

SEQ ID NO: 5635 - DNA, 290 bp, Homo sapiens
gcaggaggcgccatcatgggagtggacatccgccataacaaggacgaaaggttcggcgcaaggagcccaagagccaggatatctacctgaggcttgttggtcaagttatacaggtttctggccagaggaaccaacttccacattcaaccaggttggttttgaaggagttgtttatgagtcgaccaaccggccgcctctgtccctttcccggatgatccggaagatgaaggcttcctggccgggaaaacaagacggccgtgttttggaacatactcatgatgtcggctcag

SEQ ID NO: 5636 - DNA, 127 bp, Homo sapiens
tgtgcgaattcggcacgagatatcttggcatgagcagaaatggtgaatggtagaaatgtgttcttttcttactctaggcacaagggagtttggaaaggcacatttttttccccacatttaaaattgc

SEQ ID NO: 5637 - DNA, 175 bp, Homo sapiens
cgaattcgcacggctcacttcccatcacgtgttatcaggagatgggtctcttgttgaaatccgaatttcttcggtgaaaaatacatcccgagggttcggatagaaccggtgttgctgttcagatccaaggccaggaggtggattaatcccgaagggaatgagacatagggttgtt

SEQ ID NO: 5638 - DNA, 266 bp, Homo sapiens
cttctgttacctcagggccttggtacctggatactgccacagaattggggcgggtgggggaggggcctatttttaaataaaataacttttcaaagttgggggttttttaaaaaattaagaaaaaggaagctattctgtattgcaccttttcacaatttaatacattttctctacattttcctgtgattttcgagactaaaccattgtgtgtcctgtagtgtcctcggttgagctgccgctcagcagctttctcggggggatttgga

SEQ ID NO: 5639 - DNA, 225 bp, Homo sapiens
gaaatctgtctcccttacaatgacttacctagctagcatcaagtaacttgtatcacctgctttaaatgtaagggatagaaaatactattttgtctacactgaaaaccattattattcattgataggtggtaataattataaaggtaccattctttaaggcaaccacattgagtaatattattccaggcagagccctggatttttaatgtatattccctgctgcag

SEQ ID NO: 5640 - DNA, 99 bp, Homo sapiens
ctcgtgccgaattcggcacgagattagagtccatcctactgacctcatcttaacttgtttatatctgcaaagtcctattttccaaataagtaacatcca

SEQ ID NO: 5641 - DNA, 214 bp, Homo sapiens
gctgtttgggctaacaggatctcctcttgcagtctgcagcccaggacgctgattccagcagcgccttaccgggcagcccgaagattcactatggtgaaaatcgccttcaatacccctaccgccgtgcaaaaggagggaggcgcggcaagacgtggaggccctcctgagccgcacggtcagatctcagatactgaaccgcaaggagctcctagtt

SEQ ID NO: 5642 - DNA, 301 bp, Homo sapiens
gtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggaccacggcgtctgttcgaaggcaacgccctgctgcggcggctggtccgcattggggtgctggatgaa

SEQ ID NO: 5643 - DNA, 240 bp, Homo sapiens
gacgcaccctgtctgactacaacatccagaaagagtccaccctgcacctggtgctccgtctcagaggtgggattgcaaatctttcgtgaagaccctgactgggtaagaccattcacccctcgaaggtgggagcccagtgacaccatcgagaatgttcaaggcaaagatccaagataagggaaggcatccctcctgatcagcagaggttgatctttgctgggaaacagctggaggatggac

SEQ ID NO: 5644 - DNA, 112 bp, Homo sapiens
agagcctgggcgctgcggtagcctcgaacttccgatgttgggatgagagtcggagccgaataccaagctcggatccctgaattttatccaggttctacaaaggtacaaagtt

SEQ ID NO: 5645 - DNA, 103 bp, Homo sapiens
gatgagatgttctccgacatctacaagatcccggagatcgcggacgggttgtgccttgaggttgggaggggaagattggtcaataggacaaaaggttacaatt

SEQ ID NO: 5646 - DNA, 185 bp, Homo sapiens
gacgtttttcagcagctcaacatgaacctttactcctacattcatgcattttcctccaaaaggcaggccctaagagaccttaatacttttttgaccccccaaaggaatttggattttccagctgagcaactagcaaaggtggattccttgaaagaccggattgttcaaaattcggggttttcaga

SEQ ID NO: 5647 - DNA, 113 bp, Homo sapiens
gaaatcataactgacagggttacagtaataatgaaatgctactatcacttattttaatatacaatataaaaggaggcaaatacccttttgctttttgggggggcctttttaac

SEQ ID NO: 5648 - DNA, 145 bp, Homo sapiens
ccgccatcatggacaccagccgtgtgcagcctatcaagctggacagggtcacaaggtccttggcaggacccggttcttaagggacagttcacggaggttccggcgttggaatttattggcggcaaggggccgttccttattccga

SEQ ID NO: 5649 - DNA, 138 bp, Homo sapiens
tgcatactgtgattagcataataattgtttctttgaggtcatctaaatattttttcctaaaggaataaagggtgagggaaggaaaatattaaaaaagctaatatttgatactgtgcttgctgtcaggatgccttacaa

SEQ ID NO: 5650 - DNA, 102 bp, Homo sapiens
cagggtgcccaggtgaagctggccttttttctaaaggaaatgattgccacaaggcaagaggatgcatctttcctcctgggtacaagcctttaaagaccttct

SEQ ID NO: 5651 - DNA, 138 bp, Homo sapiens
ctgggctcgaggcgtcccccggggagtcgcctcttagcggatgcagcaccgaggcttcctcctcctaaccctcctcgccctgctggcgctcacctccgcggtcgccaaaagaaagataaggtgaagaagggcggcccg

SEQ ID NO: 5652 - DNA, 156 bp, Homo sapiens
cccctgaccttcaaaaaatgttccaaggtaagcctcgtaaaggtcatcccaccatcaccaaagccttccgttttttaacaaccttccaacacgattccattttagagggccaaattgtccattttttcagggggccttccccattggggttaaagg

SEQ ID NO: 5653 - DNA, 116 bp, Homo sapiens
acccgaggactcaaaatatcttattcagcacagactatgaaaaactcatgaggttcattttccaaggtggggtgaaaaggtttgatttgtcaaaagggattttcttgaaagggttt

SEQ ID NO: 5654 - DNA, 420 bp, Homo sapiens
tgggaattcgtggccttccgggcattaaggggccccctggtgctctttggtttgagggggacctaaaggtgactttgggaaaaaaggggggagcgtggccctccaggaggaggtcccaacgttttccctggagctataggtctcccaggtgacccaggccctcccagctatggcagaaatggccgagacggtgagcgaggccccccaggggtgggcaggaattccctggagtgccttgacccccgggacctcctgggctcccggtttctgtgagcaagctcctccacatgcagactggtcagcgagcatttaacacgggtctcaccttgaaaggctaactgctgcatggctgtctgcatgaaaccacgcctggttaaggagcttgggtaagaacaccatccaagcttgggcaaagatatt

SEQ ID NO: 5655 - DNA, 122 bp, Homo sapiens
gttggcttacagaagtcatggtgttcataccagatgtgggtagccatcctgaatggtggcaattatatcacattgagacagaatttcagaaagggagccagccacccttgggcagttaaggt

SEQ ID NO: 5656 - DNA, 137 bp, Homo sapiens
cccaaacccactccaccttactaccagacaaccttagccaaaccatttacccaaataaagtataggcgatagaaattgaaacctggcgcaatagatattgtaccccaagggaaaggttgaaaaattattaccaagga

SEQ ID NO: 5657 - DNA, 103 bp, Homo sapiens
cggcacgagctgctcccctaggacgcggctaaactcttggccaaaaggcggtactcacgtggcggaagggaaacttcattaaaaaaagaacgaaagctccccg

SEQ ID NO: 5658 - DNA, 116 bp, Homo sapiens
ccttctggttggggcagacccgagaaattcatcgtgcaccgagacggatggcaggttccactggccttccttggggtttgggctcggggcccccagcccgttggcttacctttgtg

SEQ ID NO: 5659 - DNA, 113 bp, Homo sapiens
cctgccgaccaaagagaccattgagcaggagaagcggagtgaaatttcctaagattccttgaggattttcctaccccccgattccttttttggaggaacccaagttggttaat

SEQ ID NO: 5660 - DNA, 126 bp, Homo sapiens
gcctcacttccactttactagatgcccacctggaaggaacaggggcaggcatcactcaccccatttcacggacaaaggcactgaggcacacagaggctcagctttccttggcacggtggccgtggc

SEQ ID NO: 5661 - DNA, 287 bp, Homo sapiens
cggcacgaggaagatggcggtggccagggccggggtcttgggagtccagtggctgcaaagggcatcccggaacgtgatgccgctgggcgcacggacagcctcccacatgaccaaggacatgttcccggggccctattcctaggaccccagaagaacgggccgccgccgccaaggaagtattatattcggtttggaggactacgaaccttacccggatgatggcattgggtatgggccctatccgaaggttccttacccgtacaggattgagagatccatgggatatc

SEQ ID NO: 5662 - DNA, 155 bp, Homo sapiens
ctcgtgccgaattcggcacgagctggtccccagtgccctgctggagcaagcctatgctgtgcagatggacttcaacctgctagttggatgctgtcagccagaacggtgccttctggagcaaacttttttccagcaccatcaaacaggatgacttt

SEQ ID NO: 5663 - DNA, 285 bp, Homo sapiens
ttttgatttaattcttcagctaaaacagcggaagaggtgatttattatatggttgttacactcggccacaaataaacacaggaatagtccaggaatttcacaggtccagggccaagaggcccacatgggcattttggtttattagccaaggttgggtttaaggttatccgccgttcagaggccgttgaggttttagatccatagagacacgctctagacattcgcatacagtcccacatcttgtcccagcatccagagcgtctcgcatcacatgtctctgctcct

SEQ ID NO: 5664 - DNA, 115 bp, Homo sapiens
agctacttccaacctagtccgtccggtcagtttataaccaggtttctcagctagaccagggtttcccagtgttgatatggttttttccagattcagccgcatggaacctaggtgg

SEQ ID NO: 5665 - DNA, 292 bp, Homo sapiens
  misc_feature 232: n = A,T,C or G
ctgaaggtgaagggggaatgtgttcaaaaacaagcggattctcatggaacacatccacaagctgaaggcagacaaggccctcaagaagctcctggctgaccaggctgaggcccgcaggtcttaagaccaagggaggcacgcaagccccgtgaggagcgcctccaggccaggagggaggagatcatcaggactttatccaaggaggaagagaccaagatataaacctcccacntttgtctgtacatactggcctctgtgattacatagatcagccattaatataacacacgcc

SEQ ID NO: 5666 - DNA, 300 bp, Homo sapiens
cggcacgaggaggcagcagatcccctagcatctaaacttaacaaggtcacccaattgacaggtttctcagatcctgtatatgcaggagcttacggttcatggtcaacccatatgatattggtccgggatggaacttggtggtgaaccaaaccagtattactttgacagattgcacacatagagacctagtctcacactagggggtatctgaacacttgtggagaaagccgtctccttgtgcactctcgctcctcatgactgcgcatatattagagctagcgtcagaggtagcatcaacag

SEQ ID NO: 5667 - DNA, 291 bp, Homo sapiens
cgacaagcccctcgctgccttcaccatgttctccgcttcccgaacaagcagccatactgatgaccacagcaaccagctccacgggctgatgcagcccttccaggcctttcccgtaggggagtcctttctaagcaaagtgcccctcaaggccgggtctctcccgccaggcctgccccctttcccagagccctgtcacatccagagattgggccccagggtctccctatgagagagcctggggcacaggttgagcactatattcccgcagcagtccctgatggtgtcgcctcg

SEQ ID NO: 5668 - DNA, 299 bp, Homo sapiens
ccggccctctggggggaggtgcgcagttatgctgttactagtgattttagggctttgttatttaacttatttcaagggtgctgtgctcagccctgcccatggctggtgcagcttcctccgtgccttagatcttctgtaagcagttcaggacttactgttgtgttcctggcaaccccggcattggcttccaaggtggcttgtgagttccatattggaggattttctctccaaggactctctctctcccaaggtctccctgggaagagtgttatacgcacagaaaacagggctctgagctg

SEQ ID NO: 5669 - DNA, 190 bp, Homo sapiens
atctccaaacatgacctgggccatttcatgctgcgctgcctcaccaccgatgagtacgacggacacagcacctaccccttccaccagtaccagtagcactctgttcccatcttggagggttgcattcttggacaagaggagccaaggaagggggcaataaatgttgaagcaagaacttcaaattactctc

SEQ ID NO: 5670 - DNA, 249 bp, Homo sapiens
accgccgaggaaaaccgtgtactattagccatggtcaaccccaccgtgttcttcgacattgccgtcgacggcgagcccttgggccgcgttttctttgagctttttgcagacaaggtcccaaagacagcagaaatttttcggtgctcttagcacttgagagaaaggattttgttataagggtttcccctttcacagaattattccagggttattttttaagggggggaactcacacgcatattggcactg

SEQ ID NO: 5671 - DNA, 133 bp, Homo sapiens
ccccagcccccaccgtcgcgccaggacccgtggtgctggcgctcgtggtcgtcgcgctgagaaagttttctgcctcctgaagcgaataaaaggggccgcgcccggccggggcggggactttggcttcactcca

SEQ ID NO: 5672 - DNA, 228 bp, Homo sapiens
ccgccgcgccgccatcatggacaccagccgtgtgcagcctatcaagctggccagggtcaccaagggtccttgggcagggacccggtttcttaagggacaagttcacggagggttcgcgttggaatttattggacgacacgggccggatttcattattcccaaattttaaaagggccccctttcgaaaagggcaacgttcttaaaccctttttagggtaaaaacccaaa

SEQ ID NO: 5673 - DNA, 166 bp, Homo sapiens
ctcgtgccgaattcggcacgaggatctgccccaggagttgctgggaaaggaaggatttgatgccctggatccctttatttcccattccacggtttccaactataaacccaaagggattttkaaaggttgtatttcagtaattatttgggaaacaaatgggttcaaa

SEQ ID NO: 5674 - DNA, 152 bp, Homo sapiens
gtagaatctattgaatctatttcttaatttttacctcaattttcatcaccctagattagaccctaattgccaccatgatgaccaactgcaataaatttaccaatgaggtttattaaaaatttgaaggcttgcaatttttttggaaagttaaa

SEQ ID NO: 5675 - DNA, 176 bp, Homo sapiens
tgttggccaggatggtctcgatctacggacctcgtgatctgcccaactcagcctcccaaagtgctgggattacaggcgtgagccacccatgccgcgcctaaaatttttctttttttaatgtttgtttcaatatgggcaatcccccttagagggggccaaggcaaaaattggggttt

SEQ ID NO: 5676 - DNA, 210 bp, Homo sapiens
ctggcgcaatcccatcccccttccccgggccacggggcctttggtccctgcccttccacccaggttttggttccttccggggcccccactttggagataagaaggggatggaattggggaagaggaggagcaggaggcccttaatccttttcttccctgggggttggggcctaaaaccttttgagggccccaggaaggaggttgaaaacc

SEQ ID NO: 5677 - DNA, 94 bp, Homo sapiens
caggctactctcctcggcccctccatcgggctgaggaagcacagcagcatcttcaaacatgtacaaaatcgattggctttaaacacccttcaca

SEQ ID NO: 5678 - DNA, 355 bp, Homo sapiens
ggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacctacacccttatccccatactagttattatcgaaaccatcagcctactcattcaccaatagccctggccgtacgctaaccgctaacattactgcaggcactactcatgcacctaattggaagcgcacctagcatatcacatactctt

SEQ ID NO: 5679 - DNA, 374 bp, Homo sapiens
ctggcacgcagcgccctcccagaggcctaccttcaagcagctggtggaggcgctggacaaggtcctgctggccgtctctgaggagtacctcgacctccgcctgaccttcggaccctattccccctctggtggggacgcagcagcacctgctcctccagcgattctgtcttcagccacgaccccctgccattgggatccagctccttccccttccggtctggggtcagcatgagcaaggctcaaggctgtcaggcacataggctggtgcttggctttggggctcagcacagcctgacacagtgctcgacctgatagcatggggccctgccagagttgctgtccgtgtccaaggcgtcttgcccttgagctcgtct

SEQ ID NO: 5680 - DNA, 181 bp, Homo sapiens
gtcgatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacct

SEQ ID NO: 5681 - DNA, 279 bp, Homo sapiens
acagaatgagaaaacagagtagatataaggaatattgcagtacaattgagagaacttgatcgatttccaagactcataacatactctatgtgtgggcattcttcgttacaacaggacatatttcagtaaatgttttgccatggggggcctctttgaaatgactgcttaggccatgcccaaaatgcctataatttccagcaatttgggagtccaggcgggaggattgctggagaccagcagttcagaccagaccggacacacagcgagaccctatctcca

SEQ ID NO: 5682 - DNA, 109 bp, Homo sapiens
ggctcgtgcgtcgatgaagaacgcagctagctgcaggaattaatgtgaattgcaggacacattgatcatcgacacttcgaacgcactaaacggccccggggttcctccc

SEQ ID NO: 5683 - DNA, 250 bp, Homo sapiens
ggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagt

SEQ ID NO: 5684 - DNA, 230 bp, Homo sapiens
gtgaaggcaaagaagaatgctgctccattcagaagtgaagtctgctttgggaaagagggcctttggaaacttcttggaggttttcaggaaacttgcagcaaagcattcgggttggagtaattggtttccaaatgtggggaaaagcagcattatcaatagcttaaaacaagaacagatgtgtaatgttggtgtatccatggggcttacaaggagcatgcaagttgtccctt

SEQ ID NO: 5685 - DNA, 319 bp, Homo sapiens
gccgccgccgcctcccagaacctcttcgtgccctcgcgtgccaggcccgcggcggccgaaatccgcggttcacagcatgtccgcttcggcccctgctgcggagggggagggaaccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacattgcaca

SEQ ID NO: 5686 - DNA, 300 bp, Homo sapiens
gctggagccggggaatccagggtcctcaaggccccagaggtgacaaaggagaggctggagagcctggcgaggagaggcctgaagggacaccgtggcttcactggtctgcagggtctccccggccctccttggtccttctggagaccaaggtgcttctggtcctgctggtccttctggccctagaggtcctcctggccccgtcggtccctctggcaaagatggtgctaatggaatcctggcccattgctcctggtcccgtggacgatcaggcgaaacggcctgctggtcctctggaatctg

SEQ ID NO: 5687 - DNA, 226 bp, Homo sapiens
gtcaaagggtacaaagcctcagttaggaggaataagtgtgattttttttaaagatcacttggcacagcatgctaaatataggaataattgaatgtatattgcaatattgctaagagagtaaatttctaatgttctcataaaaaagttaaatatttgagatcatatgttaattagtgtaatcattccaccttatattcaaaattcataaaaccgtattgtacctata

SEQ ID NO: 5688 - DNA, 188 bp, Homo sapiens
gaaatcattagataggagccacctcagcctcctctgctaaaactactagccttggcacttaagcttctcctgccttctcatcacaatagaggagactggcaggacctgccatctggtcctagaacattgcaacaaatacccatctcagaacttacacatagcatatgtgtaatacttctaacctcact

SEQ ID NO: 5689 - DNA, 182 bp, Homo sapiens
ctgaggtgggcaggaaagaaatttgaggagatcccaattgcacacattaaagcatcccacaacaaagggatttcggaatgccaagaagggcacaggcatcgcagcacagacagcaggcatagcgcagcggcgaggagctaaacaaaagggcgtgatccacatccgagttgtggtgaaaggct

SEQ ID NO: 5690 - DNA, 189 bp, Homo sapiens
gggaatatcgagacaaagataaaaattatcagaaaattggccccataacacccttggagttttacagggaacatgtcaagccactcttcaatatggaagataagatttgtttagtgaatgaccctaggccccagcacaagtacaacaactttacacagtggaatacttaagcatatggttggagggaga

SEQ ID NO: 5691 - DNA, 222 bp, Homo sapiens
ctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggt

SEQ ID NO: 5692 - DNA, 294 bp, Homo sapiens
ctcatacctaatcgtctttgccagtccattcaaactcacggatttgcaaaattatgttaaagtcttttaaaaaatacatttgagtaggctttgtagtcatttagattttgattattaattttctcttgctatgctgcttagccataaaaaggaaaagagatagatgtgggttcttttagtggtgttaatttaaatactagatttatttattattaatgtttaacaaggcaattcttatatttctgttcacctcatatccacacagaatataggagcttcacccccagtacagta

SEQ ID NO: 5693 - DNA, 321 bp, Homo sapiens
gaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaacttatgaaggacagatac

SEQ ID NO: 5694 - DNA, 309 bp, Homo sapiens
  misc_feature 275: n = A,T,C or G
ggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgttgaggattacctcgcaagatcacccaggaggacagagtacaagcctgaaggccacgcgagagagctgcagctggcaacgagagatncgtccagatccgagcaaggccaggcggacgtttt

SEQ ID NO: 5695 - DNA, 317 bp, Homo sapiens
ctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctctcagcatagacttaactcccttaagcccagacatctgttgagacctgacccctagtcattggttaccagtgtgtcaggcaatctggactttccagtgatgccactgagatggcacctgtcaaaagagcagtggttccatttctagatt

SEQ ID NO: 5696 - DNA, 307 bp, Homo sapiens
ggaagctaaggctgcgttggggtgaggccctcacttcatccggcgactagcaccgcgtccggcagcgcagccctacactcgcccgcgccatggcctctgtctccgagctcgcctgcatctactcggccctcattctgcacgacgatgaggtgacagtcacggaggataagatcaatgccctcattaaagcagccggtgtaaatattgagcctttttggcctcgcttgtttgcaaaggccctggcaacgtcaacattgggagcctcatctgcaatgtaggggccggtggacctcctccagcagctggt

SEQ ID NO: 5697 - DNA, 316 bp, Homo sapiens
actgcctttgcagttggactctcagggattctgggcttggggtgtggggtggggtggagtcgcagaccagagctgtctgaactcacgtgtcagaagcctccaagcctgcctcccaaggtcctctcagttctctcccttcctctctccttatagacacttgctcccaacccattcactacaggtgaaggctctcacccccatccctggggcccttgggtgagtggcctgctaagctccctccttgcccagactacagggcttaggacttggtttgttatatcagggaaaaggagtagggagttcatctggagggtct

SEQ ID NO: 5698 - DNA, 311 bp, Homo sapiens
gtgacttccgcaagctgatggttgccctggcaaagggtagaagagcagaggatggctctgtcattgattatgaactgattgaccaagatgctcgggatctctatgacgctggagtgaagaggaaaggaactgatgttccaagtggatcagcatcatgaccgagcggggggccccccacctccagaaagtatttgataggtacaagagttacagcccttatgacatgttggaagcatcaggaaggaggtaaaggagactggaaatgctttctgaacctggttcagtgcattcgagacaggccctgtatttgc

SEQ ID NO: 5699 - DNA, 183 bp, Homo sapiens
cacacattgtgtaaattagccaggcgtgttggcgcatgctgttaatcccagctactcgggaagccgaggcaggagaatcacgtgaacccgggagcagaggttgcggtgagccaaggttgcaccattgcactccagcctgggcaagaagaatgaaactcgatctaaaaaaaaaaaaaaaaaaaa

SEQ ID NO: 5700 - DNA, 321 bp, Homo sapiens
tgctctaccagcagaggttgatctttgctgggaaacagctggaagatggacgcaccctgtctgactacaacatccagaagagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggacacagctggaagatggacgcaccctgtctgactacaacatacagaaagagtccactctg

SEQ ID NO: 5701 - DNA, 317 bp, Homo sapiens
gactaaaaaatcaaagttgaacaaattttccactcaatgggtgccaaaactgttgtgctaagattagctgcacacaagagctttcagtgaaaaattcaaacaattggcattgagatcctaaagcatttctcgaaagaattgtaacagcagatgaaacatggttttgccagtacagtcctgaagacaaagcacaatcaaagcaatggctaccaagaggggcacatggtgaagagcaaaagtcatggcaatagttttatgagatattcaaggcattttgcttgttaactttctggagggtcaaaagaaaataacatctg

SEQ ID NO: 5702 - DNA, 286 bp, Homo sapiens
gaaaagaataaaaggaatgaacaaagcctccaagaaatatgggactatgtgaaaagaccaaatctacgtctgattggtgtacctcaaagtgatggggagaatgcaaccaagttggaaaacactctgcaggatattatccaggagaactttcccaatctagtaaggcaggccaacattcagattcaggaaatacagagaccgcacaaagatactcctcgagagtacttctagagcggcccgagccatcgattttccacccggtgggtacaggtaagtgtaccaattc

SEQ ID NO: 5703 - DNA, 238 bp, Homo sapiens
cggagagggactcagtggagcggcgcatgggcacagcggtgggcaggagcgaggtctggttccgcttcaacgagggtgtctccaacgccgtgcgcgcaagctgttacatcagggacttgctctagttctctgagccgcggacatgccctcgcattgcttcccgcagagtgcagagacaggaagctggagatgtctttataaagtcacacctttacagactgtaaaaaaaaaaaaaaaa

SEQ ID NO: 5704 - DNA, 284 bp, Homo sapiens
gccaagtggctaacatgatgatcaacccaaattgtctggtaaatgcaccactttctgaatgcacatttcagggtaggtgaaggaatacatgtacctgacatggcccagtctgacacgtgtcacctcttctgtcttctccccaggctgctctgcgtagattcgctggggtctgccctgaaggcctccaggcctctgactgtcagcagttggtcagcctcggctgtgggactcttctactctgcagcacatggaggagagtttgtgtagtgagtgtgggcgagaga

SEQ ID NO: 5705 - DNA, 288 bp, Homo sapiens
cttgcccacaaagctgtgggtggtttctggtacttaaagcactaatattatgttgctgctctgcgaacagcccagtagtgccatttccttccacaccaaaaagtgttaaatcaagtatgcaaatgagagtccttacaactggagtttatgttgtcttgccctcttttttagcacacaaaaaattgtacttttttatgtcgaattgtttaaagactcattctttacttgttcttacgagaggatatagggagagagtgcagtaattgctgtacgtgtatcatcattcca

SEQ ID NO: 5706 - DNA, 288 bp, Homo sapiens
ctgcaacctccacctcctgggttcaaacaattctcctgcctcagcctcccgagtactgggaatataggtgcacgccaccacacccaacaaatttttgtacttttagtacagatgagggttcactatgttggccaggatggtctcgatctcttgacctcatgatccacccacctcggtctcccaaagtgctgggattacaggcttgagccaccgggtgaccgctttacagggatatttttaatccgttatggactctgtctccaggagagggtctatccaccctgctca

SEQ ID NO: 5707 - DNA, 289 bp, Homo sapiens
tggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctcctcctctagtacagaaggtgcagtacatctatgggcctggtgattccccttgcccatccagagaggaagcatttcaatctgctttcctgccttacatcaaggtgggcaggggatataattattgcaggctcaag

SEQ ID NO: 5708 - DNA, 283 bp, Homo sapiens
gttccttacaaggcaggaagaccggcagctcatcaacgctttgcatgacctatcagtatggtgctaatgtgtctgtggaccctcgctctctgtctccaggcagttctctcgaatactttgatatgtttgtgcttacagttagccactcctggtgtttatgtgacattcctatcaatccaaattccctctgtgagtgtcatgttatgcctgttgcaggcaaatgtaagtctagaaataatgcaatgtcacggcttactctatatactttgctggtcattttttg

SEQ ID NO: 5709 - DNA, 304 bp, Homo sapiens
cggcacgagggttcaggcagccatgactcttctaagtgatgcttctcatctgcctaaggcgggcggggtcttcacacctggagcagctttttccaaacacagttgattgacagactcaacaaacacggtattgagtttagtgttattagcagctctgaagtctaaacactgggagagttaactcaagtcatacgtgcgtgaattaacagctctctatttgatatttgaaattcttctgtaagcctgtctgagtgtatgtggagacgacttgtcaatctaaaatatctatatattaaaaagtagg

SEQ ID NO: 5710 - DNA, 196 bp, Homo sapiens
gttgtatatttagtatgaacttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaatttga

SEQ ID NO: 5711 - DNA, 163 bp, Homo sapiens
ccacggtttaaccggagattttgaggctagggtgtgtttctttcgaacttttcggaatgtctggaacatttcatttcctgttttgttactatgcctctgtaaatctactttgcaatttaagtaataatttatgaataaaatgggaaatgcttctaattcacat

SEQ ID NO: 5712 - DNA, 205 bp, Homo sapiens
cggaggcttgggtgcgttcaagattcagcttcacccgttaacccaccgccatgggccgagggaagggcaatttgctgcctgggaggtgtaatatgacggttaatactgtctttacacgaggttctgaaggactgcctcatccacggtggcctagcacagtaggattcgcgacgtgccaaagccttaacacgcagcaaagccatct

SEQ ID NO: 5713 - DNA, 304 bp, Homo sapiens
gcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccacgatgaagagacgacgctgctggggatctcgcactctggttcctgcatgaagacagtggctggcggtgctggacgtacaatacacttcgctgtcacggtaaagtccgccatcagagactgaggagttgaaagaccagtagacgctctctactctttgagc

SEQ ID NO: 5714 - DNA, 171 bp, Homo sapiens
attcatccatcggtccgtccatccatgtccccagttgaccgcccggcaccactagctggctgggtgcaccaccatcaacctggttgacctgtaatggccgcctgtgccctgcctcagtccaatcctacagtccccagggcgtgcggggctgtgagactggggtgcaggaat

SEQ ID NO: 5715 - DNA, 298 bp, Homo sapiens
cctgccaccaggcctcaccaaagcccactgccatggggccatctgggccattcagagactggagtgagatttgggtgtggaggggaggcgccaaggtggaggagcttccactccaggactgttgatgaaagggacagattgaggaggaagtgggctctcaggctgcagggctggaagtccttgcccacttcccactctcctccccaatctatctagtactcccaggcaaataggccctttgaggctcctgagtgcctcagatggtcaaacccagttttcctctggagcctaaacaggc

SEQ ID NO: 5716 - DNA, 293 bp, Homo sapiens
ttgatctttttccccttcatctttcagcagggtcaaggacaagcaaattgcattgatttcttctgtgacatgaatttacttcctatttacctttaccctgttggattaccctttggtgtgtgagctttgtggtgggatgtcattgttattatatactcttgtgagctcggtctaatatcctaggctggagacccatagagtcactcccatacatactacagggttttgtagagcattgtgtgagagcagctttcaatgcttgctctacaatgttcctgctttagtttgttctg

SEQ ID NO: 5717 - DNA, 299 bp, Homo sapiens
cccaggccagctcaatgctgacctgcggaagtggctgtgaacatggtcccgttttccccggctgcacttcttcatgcccggctttgcccactgaccagccggggcagccagcagtaccgggcgctgaccgtgcccgagctcacccagcagatgtttgatgcaaggacatgaatggctgcctgcgacccccgccatggctgctacctgacggttgccgcgtgttcaggggcgcatgtccatgaaggaggtggatgagcaaatgcttatgtccaaacaaaacagcagctatttgtgagtga

SEQ ID NO: 5718 - DNA, 219 bp, Homo sapiens
aggagcaaagagcaccatgattccaatcttgtgtgtgtttactaacccttccctgaggtttgtgtatgttggatattgtggtgttttagatcactgagtgtacagaagagagagattcacacacaatattgctgttcttcagttttgtttgtggagtgtgaaatcactcaaatttaaaataaattactggactgtggagataaaaaaaaaaaaaaaaaa

SEQ ID NO: 5719 - DNA, 213 bp, Homo sapiens
attacatagtagtatgcttaggctttactatgtattagcctcttgttggactgtgtatgtattttaccatatgggttttaatgataatggtgtatgactgctatacatgagtgcttatgcatccagatgttataataaagtagaatggtctctttaaaaaaaaaaaggaaagaaaagagaaagcaatgccaaaaaaaaaaaaaaaaaaaaaam

SEQ ID NO: 5720 - DNA, 315 bp, Homo sapiens
caatggccgggagggctcctgcgcttcagttcctggccattttctatccaagatgtggtacaacctcttaacctgcaagttcaggagagccctcgtctctgtgggtgagtgtgtgttgaacaagggaatctctgggcttgaaggggaaatttccaatccctggccctggcttaggcctcatctcatgccctcccctcagacggtgtcagatgcctctcggtctcagactctgtgtcactttcgtcctttcacggtgtatcagtaagtattactctctcacatttggtcgctgggagagctactcaggtcaaggat

SEQ ID NO: 5721 - DNA, 328 bp, Homo sapiens
ccgggaccgtcctgcgcgctctgggcgaaccatggcccgcgggctggcgctggcgtgctgctcttcggcctcctgggtgttctggtcgccgcccggatggtggtttcgattatccgatgccttcctgacatgaaacaagaacccactgccaatcccaagaacccagtcctggggatgactttgacttaagagatgctgatgttgatggagaaatgacgaccacgaccaccgacctcacccaaacgattgccaaatccaaccccaacgaccgtggtctcggtagctttcagatgctggacttgcggctgggtttcagagggaaggaaag

SEQ ID NO: 5722 - DNA, 313 bp, Homo sapiens
ctaccctacatgaaagctatttcctactgcttgtgaaagaaaaaaatatgaaataaacacttactattctgttacaaggtaacaatagagtgctaattgctgagtaaagtcatgtagccccaggattatgttgagggactccactataaatttgaagacaccataatccatgtaatcaggcagaaaatgatttgctgtgctgcacttctcctttaacagtttctattgaactaatttaattaaatggagtagagatagttattccctgagtccagatgtggagcacgtgtcgtgttttacgtgtcctgtgtag

SEQ ID NO: 5723 - DNA, 322 bp, Homo sapiens
cggggaggtaacaagacataccgtgccctgaggttggacgtgggggaatttctcctcggggctcagagtgttggtactcgtaaaacaaggatcatcgatgttgtctacaatgcatctaataacgagctggttcgtaccaagacctcgtgaagaattgcatcgtgctcatcgacagcacaccgtaccgacagtggtacgagtgccactatgcgctgcccctggccgcaagaagggagccaagctgactcctgaggaaggagagattttaacaaaaacgtctaaaaacttcagaggaatattgattgaaggaaaagattccaaa

SEQ ID NO: 5724 - DNA, 334 bp, Homo sapiens
tgttgaggaggcaagtgggtcaacagcaggtgggctgtcgagacgtctaatgaccattctccatatacctttcaacctaataagtaactgtgagatgtacagaaaggtgttcttacatgaagagggtgtgaaggctgaacaatcatggatttttctgatcaattgtgctttaggagattattgacagttttgcacaggttcttgaaaacgttatttatatgaatcacctaaactattttgctatagttcataggtgcataagacctaattcactagtagcgtgcccgacagcttatttgtaaaaaaaacacaccaaacaaggtttttcaagttt

SEQ ID NO: 5725 - DNA, 223 bp, Homo sapiens
gttggctggaagtaccaggcagtgacagccaccctggaggagaggaggaaagagaaagccaagatccactaccggaggaggagacagctcatgaggctacggaaacagaccgagaggacgtggagaggaaattgacaaatcaaagaggtcctcaagacccacggactcctggtcttgagcccaattaaagactgttaattcctaaaaaaaaaaaaaaaaaaaa

SEQ ID NO: 5726 - DNA, 300 bp, Homo sapiens
ctcacattgcatgcaagtttgctgagctgaaggaaaagattgatcgccgttctggtaaaaagctggaagatggccctaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaaggtcttcccagaagctagaggctaaatggatatatccta

SEQ ID NO: 5727 - DNA, 251 bp, Homo sapiens
caaaacatacaacagaccttggttttcctcgaagtgcccttccaccctcctgcccgtatactatggtgccattggaggactccaggccaccaggcagttggacagccctacctcagtggcatcagtggacgggcctgtgctaatgggatccacatgaataggggctgccctcgctgcagtggctaccgggcatgaggcccagcagcactgccaggcgagcttcagcagcagagtgacaccagcagcctgct

SEQ ID NO: 5728 - DNA, 150 bp, Homo sapiens
ccacgattcaaataattcccctcctaaaacaaaaaggagggaacgtcaactacattgcaattaattatatacatcttctatactctgaatatacgaccgcgcatacgatgactcgtagtacatctctttaacaaccacaaaccttaacgc

SEQ ID NO: 5729 - DNA, 304 bp, Homo sapiens
gaacattttgctgagatggctgccagtcttaagcgtccagactcaggtgccactgggcttcctggaaggcctggccctcctggtccccccggccctcctggagagaatggtttcccaggccagatgggaattcgtggccttccgggcattaaggggcccctcgtgctcttggtttgaggggactaaaggtgacttgggagaaagggggagcgtggccctccaggaagaggtcccaacgctttccttgagctatagtctccaggtgaccaggcctccagctatgcagaaattgccgagacgtaag

SEQ ID NO: 5730 - DNA, 265 bp, Homo sapiens
ctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgcttggggttggtgcgtgcttggcatggcctgtgccatcagttatcttaattgaaggacttggcagatgaacttcgctcttagttggatgctcatcgaaggcgc

SEQ ID NO: 5731 - DNA, 275 bp, Homo sapiens
ccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgactggctgcatctcctctcctgatgtgctccatc

SEQ ID NO: 5732 - DNA, 132 bp, Homo sapiens
cccatttagattaaagattgctttatccagcagtcaattaactctccagttatcagtactcccacaattggccagggcaacaataattggagttcatactgatgccctgaggcactggaaaaaaaaaaaaaa

SEQ ID NO: 5733 - DNA, 280 bp, Homo sapiens
ctcgtcccttcgtgccgaattcggcagttaaactatttgcatgacatttacatcggatattatgagtgatctagagttgatatgaagtatatgggaggatgtgcaaaggtgatgtgcaaatactatgtcattttatatcagggacttgagtatcctttgttaccctcaggagatcctggaaaccagtcccccatggatactgaggggctgatctgtgatagtcctatcctcagcggaacttgtcattcttatgtggggggaaggctgactataaacaaaa

SEQ ID NO: 5734 - DNA, 229 bp, Homo sapiens
cggaggtgcaggtcctggtgcttgatggtcgaggccatctcctgggccgcctggcatttcggtggctaaacaggtactgctgggccggaagtggtggtcgtacgctgtgaaggcatcaacatttctggcaatttctacagacacaagttgaggtaccttgctttcctcccaagcggatgaacaccacccttccggaggcccctaccacttccggcccccagccgaatct

SEQ ID NO: 5735 - DNA, 164 bp, Homo sapiens
gtttacaacagattttgtgaactcagccaagcacagttgttggcagggacttaggcttgcttacaaaggaggcatgtttttaggcaattattaattgttttatgggccaaaaaattcgagggacttttattttgtggtctctattgtttaaacaagtgtttttt

SEQ ID NO: 5736 - DNA, 237 bp, Homo sapiens
agagggcttgctctatctctgactctcccacacacaaggtggaggccattgttagcctattgagagagcatggccatcttcaagccagagaagaaagccctgactagagaaccaaaccctgtcaaaaccttatattctggacttccgaaccttcagaaactgtgagaaaactttatttcttttgttttagacacccagttctatgtgtattttgttgctgggcaacccagcagaact

SEQ ID NO: 5737 - DNA, 319 bp, Homo sapiens
ggcagtgcaaatatccaagaagaggaagtttgtcgctgatggcatcttcaaagctgaactgaatgagtttcttactcgggagctggctgaagatggctactcttgagttgaggtgcgagttacaccaaccaggacagaaatcattatcttagacaccagaacacagaatgttcttctgtgagaagggccggcggattcgggaactgacttctgtagttcagaagaggtttgctttccagaggcagtatagagctttatgctgaaaggtggcactagaggtctgtgtgccattgccaggcagagtctctcgatacaactc

SEQ ID NO: 5738 - DNA, 319 bp, Homo sapiens
aataaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaatttcataaacacatctcgtgtcatcacagccaaggttttaggtgctataccatggcttattaaatgaaatggcactaaaggttcttgagattctttatactctctgccttcagcaatcaattccattcatacatcagcactctgctggttctgttggaatatgttctgta

SEQ ID NO: 5739 - DNA, 218 bp, Homo sapiens
ctggactcagctcaacatgttccagaccttgaagtacctggccatcttggggcagtggtggacgtttctgggctggccaatcggatgctggccctagcaggcagtcaagagaacagcacattagttccagaagaagatggaaattctgaaaactgaatgtcaagaaaggagtcaaggacaattcacagtatgaggagaaaatggaaaaaaaaacttat

SEQ ID NO: 5740 - DNA, 320 bp, Homo sapiens
ctggtaatagaattgtttacctttataccaagaaggttgggaaagcaccaaaatctgcatgtggtgtgtgcccaggcagacttcgagggggttcgtgctgtaagacctaaagttcttatgagattgtccaaaacaaagaacatgtcagcagggcctatggtggttccatgtgtgctaaatgtgttcgtgacaggatcaggcgtgctttccttatcgaggagcagaaaatcgttgtgaaagtgttgagggcacacgcacagagtcagagagctatataaaaaaatgacactcttttgagtataaaaatgaaagacgctgta

SEQ ID NO: 5741 - DNA, 230 bp, Homo sapiens
cctgtttggaaaccccatgtacaattcccagttttttgtaagtgtcagtgcgagagacatttgactcttgtgtttgtatctcctttttatgattgctgtacctacccatgtctttttggggaggggtgaaaggagatttgaaataaaattgtttagagattaaaaaaaaaaaaaaaaacctcgggggtacttttggggcgcccggggcccattcgttttccacccggggg

SEQ ID NO: 5742 - DNA, 225 bp, Homo sapiens
aattaatgtcacaggcgcaagcccttgaacttagttgagatgcagaaaacaaacaaatgcaatgacatatctgagaagcatttatgtaactccggttaagtggtgaggagggtgtgtgaagacagtgtgcatgcatgagtgtgtattcatatatatgtgtatacatatgaatttcactgttattttccagggtctatggacactgtggcagtaagagtctatgat

SEQ ID NO: 5743 - DNA, 231 bp, Homo sapiens
gtcctctgacctgagagcgaagggggaaagcggcgagatgactgaccgctacaccatccatagccagctggagcacctgcagtccaagtacatcggcacgggccacggcgacaccaccaagtggggagtggctggtgaacccaccaccgcgactcgtactgctcctacatgggcccacttcgacctcctcacctacttcgccattgcggagagtgagagcaaagcgcgagt

SEQ ID NO: 5744 - DNA, 217 bp, Homo sapiens
cggcacgaggattcgttcaagctcacagccagcagccaagcgtcagaaactaaacccagctgatgcccccaatcctgtggtgtttgtggccacaaaggataccagggccctacggaaggctctgacccatctggaaatgcggcgagctgctcgcgaccaacttgcccctaagggtgaggccaaccgcttattgcagtgcggccccctgtcctctacc

SEQ ID NO: 5745 - DNA, 211 bp, Homo sapiens
aggtcgacactagtggatccaaagaattcggcacgagacattggcgaatttgaaatcattgatgaccacagagctgggaaaattgttgtgaacctcacaggcaggctaaacaagtgtggggtgatcagccccagatttgacgtgcaactcaaagaccttgaaaaattgcagaataatctctttccatccggcagtttggtttcattgtact

SEQ ID NO: 5746 - DNA, 288 bp, Homo sapiens
ctgcaacctaccctctctctgcctcagccttacacccaagcagtaggtctgtgctctccctgtctctaggtcgctgagagaggtgctttttcttcataaaacctttgggggtttggatttccccaggaagatggagaatggaatactcactcttgggtctaatctttccccttgaccagaactctctccccacaaaaatgcctttaaaaaccttctgagacttaagcattctgcccacttactaactggccagttctccagcactggaggtggggcagataacgcggc

SEQ ID NO: 5747 - DNA, 108 bp, Homo sapiens
ccaaaacacaggtagaaaatgacacagtagcccaatcgtctacttttgtgattgctaagaatttgtgtaattataccttcagaagtttgtttagaatttacatgattt

SEQ ID NO: 5748 - DNA, 280 bp, Homo sapiens
aaaagactgataagtacctttgttttgtttctgattttaaagacattatacctaatatttcattattaagtgtaatgtttctttattcttttggtatatctggttcagaactttctattcctagattcctagagtttttaatcataagtaagcagtgaattttaagaaagcctttttctgttactgagatacactttcccctctctatctattagttttgtggatatataatatatttgtcatgataaacattctgatttctgctactgcatgcatttga

SEQ ID NO: 5749 - DNA, 135 bp, Homo sapiens
gaaatccatatcttaaagaaacagctttcaagtgcctttctgcagtttttcaggagcgcaagatagatttggaataggaataagctttagtttttaacaacccacactcctacaagggtttagaaaaaagggttt

SEQ ID NO: 5750 - DNA, 137 bp, Homo sapiens
gtgaggttgtctagtccacgctcggagccatgccgtccaagggcccgctgcagtctgtgcagggtttcgggcggaaggaggcagccacaactttgggccgaactgcaaacggggcaattggtttaatcaagggtaac

SEQ ID NO: 5751 - DNA, 106 bp, Homo sapiens
ttctgagctttcctgtctttcctttttttctgagagatccaaagcctccacgactctgtttcccccgtcccttcctgaatttaattttgcaaataaggtcaatttg

SEQ ID NO: 5752 - DNA, 108 bp, Homo sapiens
ctctcccaagccccaggggacagtggggaggcaggggagggggtggctgtggtccagggacccaggccctgattcctgtccctgggggtttttccttgccccgcctgt

SEQ ID NO: 5753 - DNA, 115 bp, Homo sapiens
tccaggcggttctgaatgtgaagcactacacccagcagagtccccgtgccctctgttccccacttcccggcccagtgttctctctttccgagggcaccccagggattcgacaagg

SEQ ID NO: 5754 - DNA, 108 bp, Homo sapiens
gacaacattggctagagaaaaagatgttgttgggagagccaggggatttgttccttatattgggattgtgacggtcccatgaatgactatcctaaatttaagggatgc

SEQ ID NO: 5755 - DNA, 260 bp, Homo sapiens
aatggaggtaatatttacttcagaggctttctgagaggatgaattagggtatattgtgagataacataaaatttaccacttttaccatttttaagtatacagttctgtggctttaagtacattcatgttgctgttgtataaccattactaaagctatattttttaagtgctcaagactgtgcatgcagtaactgctcagagaatggcagctagaattattctcattaatgctatcttattccattttaaatttgtgtaaa

SEQ ID NO: 5756 - DNA, 322 bp, Homo sapiens
cttcgagatcatacacctgctcacaggcgagaaccctctgcaggtcctggtgaacgccatcatcaacagtggtccccgggaggactccacacggattgggcgcgccgggactttaagacgacaggctgtggatgtgtccccctgcgccgtgtgaaccaggccatctggctgctgtgcacaggcgctcgtgaggctgccttccggaacattaagaccattgctgagtgcctcgcagatgagctcatcaatgctgccaagggctcctcgaactcctatgccattaagaagaaggacgagctggagcgtgtggccaagtccaacc

SEQ ID NO: 5757 - DNA, 245 bp, Homo sapiens
  misc_feature 37: n = A,T,C or G
ctcgtgcgaattcggcacgaggaagggccaagcacgncaaagcaggaacatcggatttggggaacgcgtgtcaatcccttgttgccgaagggcttgggcgggagagacttttctgttccttgtgtaactgtgttgctgaaagactacctcgttcttgtcttgatgtgtcaccggggcaactgtctgggggcggggatgggggcagggtggaagcggctccccattttataccaaaggtgctacat

SEQ ID NO: 5758 - DNA, 216 bp, Homo sapiens
  misc_feature 64: n = A,T,C or G
ctcgtgccgaattcggcacgagtacaatcgtgtgctgactggaggagaagccttgagaccgtgngcaagcttgcccgggcatcaaggaactatgccaccgttatctcccacaaccctgagaccaagaagacccgtgtgaagctgccctccggctccaagaagggtatctcctcagaccaacagagactgttgtttgtgttgtggcttgaggtggcc

SEQ ID NO: 5759 - DNA, 186 bp, Homo sapiens
gggaccatcggcatttctgtggatccgaggaggcggaacaagtcacggagtccctgcaggccaacgtgcagcggctgaaggagtaccgctccaaacttatccatcttccccaggaagccctcggcccccaagaagggagacagttcttctgaagaacatgaaacttgccacccagctgaccaggac

SEQ ID NO: 5760 - DNA, 140 bp, Homo sapiens
cgcgcgcatcatggacaccagccgtgtgcagctatcaagctggcaggtcaccaaggttcttgggcaggaccgttctgcaagggacagttgcacggaggttcgcgttggaattcatgtggcggacacgggcccgattccat

SEQ ID NO: 5761 - DNA, 280 bp, Homo sapiens
cgagtttttcataattgctctttatattgtgtgttatctgacaagatagttatttaagaaacatgggaattgcagaaatgacttcagtgcagcagtaattatggtgcactttttcgctatttaagttggatatttctctacattcctgaaacaatttttaggttttttttgtactagaaaatgcaggcagtgttttcacaaaagtaaatgtacagtgatttggaaatacacataaatgaaggcaatgcatggccttcccataaaaaatatttgatggctg

SEQ ID NO: 5762 - DNA, 306 bp, Homo sapiens
atttccttctgactcaagctgtcaggacaggaaacctagccaagttcaaccaggtcctggatcagtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttgccacaggccatccgggatggtgtcattgaggccagcatcaaccacgagaagggctatgtcccatccaag

SEQ ID NO: 5763 - DNA, 230 bp, Homo sapiens
gttacccgttagagagctgagaccctcatttaaaactcacctcccaatcaccccaaacaaatggaagagaagagaaaggacatggcgtattttgtatttaaaagtaattgtattaattatttaaagtgttggaaagcaaaataacaaaaaagagaaacgccaacaaaaatcagcagatgttgaaggcaggggtctctgggggtgggctccggcaccacatcctggagtga

SEQ ID NO: 5764 - DNA, 167 bp, Homo sapiens
aagtgacatcgtctttaaaccctgcgtggcaatccctgacgcaccgccgtgatgcccagggaagacagggcgacctggaagtccaactacttcttaagatcatccaactattggatgattatccgaaatgtttcattggtgggggcagacaattgtgggcttccaag

SEQ ID NO: 5765 - DNA, 112 bp, Homo sapiens
ggctcggctgccggccacagactggattttctgacatcaagtccacgcgttctttccgcagcatagactgggacttcctggagaagagcagccgttccctccattccagcca

SEQ ID NO: 5766 - DNA, 268 bp, Homo sapiens
ggaactgactgctgtagttcagaagaggtttgcgctctacagagggcagtgtagagctttatgctgaaaaggtggccactagaggtctgtgtgccattgccaggcaagagtctctgcgttacaacctcctaggagggcttgctgtgcggagggcctcctatggtgtgctgcggttcatcatggagagtggggccacaggctgcgaggttgtggtgtctggcacactccgaggacagaggtctatatccatgaggtgtgtggagggcct

SEQ ID NO: 5767 - DNA, 160 bp, Homo sapiens
ctcgtgcgaaattcggcacggggcagcacccaccccgcaccggcgactccatcttcacgggccacccccttgcggcggacgggttgaccaccaggccaccacattcattcccaggagcttgaggctcctccagccgggattgacggccttccccaccaac

SEQ ID NO: 5768 - DNA, 145 bp, Homo sapiens
ggattgcttgagcccaggagtttgacaccagactcggcagtatagggagacttcttctctacaaaaaatttaaaccacctaggccaggaggcccaggtagggttgaatcaacttgagcctcagaggtttaggaccagcctggcca

SEQ ID NO: 5769 - DNA, 111 bp, Homo sapiens
cttcctggacctatgaatcctggctatgggagaaacagtaccatatattagatgctgattcagaacaaacacagccttcttggagaacctttgcttccagccctgcaaagg

SEQ ID NO: 5770 - DNA, 135 bp, Homo sapiens
cgtgcctgtagtctcagcctcccaaagtgctgggattacagggtgtgagccaccatggccggctttgccctggttgttttaatggtatttccagcttttatttgtggtttatggtgaccataggtccattagcct

SEQ ID NO: 5771 - DNA, 140 bp, Homo sapiens
caagcacgtgccccgggctgtgtttgtagactggaacccacagtcattggatgaaggtcgcactgggcaacctacccgccagctcttcccaccctgaggcagctcaatcaacaggcaagggaaggatgcttgcccattaa

SEQ ID NO: 5772 - DNA, 140 bp, Homo sapiens
gcaacgcggaggaaacgggagttaaccggagagcgtagtgaccatcatgagcctcctcaacaaggcccaagagtgagatgaccccagaggagctgcagaagccgagaagaggagggaatttaacaaccggtccacttctc

SEQ ID NO: 5773 - DNA, 181 bp, Homo sapiens
aactatgagatgctcaaggaggagcacgaggtggctgtgctgggggcgccccacaaccctgctcccccgacgttcaccgtgatccacattccgcagcgagaccttcgtgcccgaccatgtcgtctggtcctgttcaacaccctcttcatgaacccctgctgcctggcttataggattcgcc

SEQ ID NO: 5774 - DNA, 190 bp, Homo sapiens
ccggacggacgctcgtcttcgcccgccatggccgagagcgactgggacacggtgacggtgctgcgcaaggaaggggccctacgggccgcccaggccaaaatccaaggcagggctatcttaggcggcacagagaccgagggagaaggattgtggagacttcccaagaaatgggcctgctggccaagaacaa

SEQ ID NO: 5775 - DNA, 233 bp, Homo sapiens
aaaacggagagggaatgggagacttgatatttaagcagcttgaatggtttttcttttctttatttttaaagaaatgcacttgcctatgatactgtctctccagtgaaatgattactcctccattactctattgatacactattgtgcatgctagtgttgtatttctatacagtagctcgaaattgattaacttatactgtaggtgttatgtatccctatgacacaaaaaattg

SEQ ID NO: 5776 - DNA, 245 bp, Homo sapiens
ggaatttgatgggaagagcctggtctcagttaccaaggagggtctgggagctgcctgaggatgaggaggagaagaagaagatggaagagagcaaggcaaagtttgagaacctctgcaagctcatgaaagaaatcttagataagaaggttgagaaggtgacaatctccaataggacttgtgtcttcaccttgctgcattgtgaccagcacctacggctgggcagcaatatggagcggatcatgaaa

SEQ ID NO: 5777 - DNA, 216 bp, Homo sapiens
ccaacgccagcgccgcctctcgctcgccgagctccagccgaagagaaggggggtaagtaaggaggtctctgtaccatggctcgtacaaagcagactgcccgcaaatcgaccggtggtaaagcacccaggaagcaacttgctacaaaagccgctcgcaagagttccgccctctacttgaggggtgaagagaacctcatcgttacaaggccttgtact

SEQ ID NO: 5778 - DNA, 181 bp, Homo sapiens
ctagtaattcctttagttttattctatcttctttatgaagacacgggtttctatttttactggttttgtccttttaaaaagcttgtctttctttagtttttgtttttcttgctctttttgcccaagcttggggttcagttgtgccattcatagctcactgaaggctcaaattcctctggct

SEQ ID NO: 5779 - DNA, 142 bp, Homo sapiens
cagaattctatttgggcaagagatgcgcttatgtatataaagcaaagaacaacacagtcactcctggcggcaaaccaaacaaaaccagagtcatctggggaaaagtaactcgggcccattggaaacaagtggcattggttcg

SEQ ID NO: 5780 - DNA, 212 bp, Homo sapiens
taaaaaagccccaaaatattgaagttcatctgaaatgcaaggtgctttcatcaatgaaccttttcaaacttttctatgattgcagagaagctttttatatacccagcataacttgggaacaggtatctgacctattcttatttaggttaacaaaaggtttgattaatttggaattcctttaattccctaattggaattctaatgtgaatatg

SEQ ID NO: 5781 - DNA, 156 bp, Homo sapiens
gagagttgctattggaccatgtagaatgttgcaatattgtttacagggtcttttttcacccagcccggaaagtcagagatgtatattggaaaatttacaacttcatctacattggttcccaggacggttctcatagcacaattacccaaggaatct

SEQ ID NO: 5782 - DNA, 171 bp, Homo sapiens
catattcacttttctggctaccgaagtggagatgcagggggagatgatcaatcggattgagaagaacatcctgagctcagcggactacgtggaacgtggggcaggagcacgtcaagacggccctggagaaccagaagaaggcgaggaagaagaaagtcttgattgccatct

SEQ ID NO: 5783 - DNA, 175 bp, Homo sapiens
ggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctgggggacaatgtggggcttcaatgtcaagaatgt

SEQ ID NO: 5784 - DNA, 220 bp, Homo sapiens
tagatattgaagggaggttatttgtggtctctaatatcatgccaccattgtccccgtccccatcagtcataactttttcttttgccctcataaagctgagcctgccaagaataatatgtttatgtctttatatacagctgcctaaacccatttatcaactatttaagggtctttattacaattcaatttttgggccatttaattgtattggaattacaac

SEQ ID NO: 5785 - DNA, 214 bp, Homo sapiens
cccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctttgggaggagaatttattcaaccagtttcctcatacagggttca

SEQ ID NO: 5786 - DNA, 290 bp, Homo sapiens
ccaacatgccatccagactgaggaggacccggaaactaggggcacgtgagcaacggccacggccgattaggcaagcaccggaggcaccccggcggccgcggtaatgctggtggtctacattaccaccggataacttcgacatataccacccaggctactttgggaaagttggtatgaagcattaccacttaaagaggacccagagcttttgcccaactgtaaaccttaaaaatttgggactttgggcagtaacagcacgggtgaattctgcttaaaacaaggtctgggtg

SEQ ID NO: 5787 - DNA, 138 bp, Homo sapiens
agctgacaccccaagaccatctggtttgagctgccacaggccaggagctgcttatacaccatctgtttcctgttgagaaagcaggtgcctttggcattaggtggccaggcatcaattggaagggtgtccaggcccggg

SEQ ID NO: 5788 - DNA, 170 bp, Homo sapiens
gcaaaacgagggctacatgcgccgcggtggctaccgcagcagcagtctcagacggcctactgagctctccactctgtttcccggcctggccatccaacctttgaggtcctaaacacacaccttaagtaattaaagggctttgtttaaaggtggtccttggtggattgctt

SEQ ID NO: 5789 - DNA, 160 bp, Homo sapiens
catctctcacaacaaaaatagctggtgtagtgatgtgctctgtagtccagttactctggattctgaaatgggaggatcgtttgagcccaaaccagtcaaggttccagtaggttttgatggtaccacctccactccagccttggcaacagatgggattctt

SEQ ID NO: 5790 - DNA, 295 bp, Homo sapiens
attgactgtatatgaccttaatctttgtgcagcctgaaggatcagtgtagtaatgccaggaaagtgctttttacctaagacttccttctcagcttctcccataaaggggaccctaatatgcattttgatttgtaattggaaatgttacctttcactgaaaggttcatggtgatggttgcattacttttaactgccaatattaagggaaggtgtgcctttgacttcaatcagtaatccctctggtacacagagaaatgtctttaaaatgctctaaaaactttaaaatttaaaatgt

SEQ ID NO: 5791 - DNA, 274 bp, Homo sapiens
cagaaagtatttttgcttcaacgtttctttcttgatgtagtgctttggtattcctacagcaccccaccttccccaacagatgtacagtgttctgtctccattcgaaatctacaatgtaatatgagtgcattgtatgggtttgaaaccaaaggatgaatgaagcattcagagacttaatatttgaaaaaggaatagtcagtattttatattttattacaggtactgatatttataaatgtaataaactgtaccatgctgctgcatgttttcaagt

SEQ ID NO: 5792 - DNA, 163 bp, Homo sapiens
attgatcagagcattgtgcaatacagtttcattaactccttcccccgcttccccaaaaatttgaatttatttttcaacacttttacacctgttatgggaaatgtcaacctttgtagggaaaccaaattaaaaattggaaaataaaaccccttaaaaaaaaaaa

SEQ ID NO: 5793 - DNA, 125 bp, Homo sapiens
ggcacgaggtgaatcccagcggtgccccgactccgtgatatcgctggagccctaacctctcagagcctcagtgtcctcatctattagattgggacaatagtagacttatcttcattggctttggt

SEQ ID NO: 5794 - DNA, 254 bp, Homo sapiens
cccactgagacctatagaggaagctgctgaagagaaaggacagcagagatacaattgcctatgttgagagatgctcttgagtcccataacatacaacctaccagttttctgcaacccgaaagcccagggctggcactataatcttaactagtcactacataaggcttttgtttttatgatgtctatccatagttataagttcttcaattcccaagtgccggaaaacctgtgttatccttgagaatttgatatct

SEQ ID NO: 5795 - DNA, 269 bp, Homo sapiens
gccaggtgctccagggtcacctgggctccctggtcagattggcagagaaggacggcagggcttgccaggagtaagaggattgcctggtaccaaaggtgaaaaaggggacattggtattggcattgcaggagaaaatggtcttcccggccccccaggtcctcaaggtcctccaggctatggcaagatgggtgcaacaggaccaatgggccagcaaggcatccctggcatccctgggcccccgggtcccatgggccaaccaggcaaggctg

SEQ ID NO: 5796 - DNA, 305 bp, Homo sapiens
agtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgtctcatcaactgccgcaacaataagaaacttcttggccgcgtgaaggccttcgataggcacttcaacatggtgcttgagaacgtgtaaggagatgtgtgactctaggtaccccagagtgggcaagggcaagaagaggtgcacgccacttaaca

SEQ ID NO: 5797 - DNA, 241 bp, Homo sapiens
actttccaatctcagtcactctaggactctgcactgaatggctgacctgacctgatgtccattcatcccaccctctcacagtttggacttttcttccctctctttctaagagacctgaactgggcagacttcaaaataaaatctcggggttctatttatttattgtcttcccgtaagagccttcgggtcaaggcagagggcaggaaactaactctgtgtgagtgcaaatgtccccctgtag

SEQ ID NO: 5798 - DNA, 265 bp, Homo sapiens
aaaatctccaggggcaccattgaaatcctgagtgatgtgcagctgatcaagactggagacaaagtgggagccagcgaagcaacgctgctgaacatgctcaacatctcccccttctcctttgggctggtcatccagcaggtgttcgacaatggcagcatctacaaccctgaagtgcttgatatcacagagggaaactctgcattctcgcttcctcggagggtgtccgcaatgttgccagtgtctgtctgcagagttggctacccac

SEQ ID NO: 5799 - DNA, 262 bp, Homo sapiens
ggtcgacactagtggatccaaagaattcggcacgagcggcacgagctaagatgcgccgccggacctacagagctcatggtcggattaacccatacatgagctctcctgccacattgagatgatccttacggaaaaggaacagattgttcctaaaccagaggaggaggttgcccagaggaaaagatatcccagaggaaactgaggaaccaaaatcttatggcacgggagtaaattcagcattaaaatatatgtaattaaaagg

SEQ ID NO: 5800 - DNA, 278 bp, Homo sapiens
ttttactattaaccattgtatattatttaaaagccataagaatacgaaaaagcatgaccgcacaaattccagagaatttgttttttaatcaatccgatcaattttacacaccaaattatcattaggaacatagagatcatgtgaattgtattaaacctatgacatatgacactattatataggagaattttaactctaagagacaatatatttttttaaaagagagattaaatatatcacgtcttatgctaaatatatatagatatatatatatgatg

SEQ ID NO: 5801 - DNA, 318 bp, Homo sapiens
cctgcagagtactccatggaaacaattgccgagcacgtgctcgcaatttgccgagcacggtccggtttgaactcctagactaagactaggtaggtgatacataccttcttcccaccaagtactcacgatccaaactatgaattttagattcggatcaaacgaggattgatccgagggaccaacgttgtgataaatcttacgtcgtcttatatattaagtttttgtggaggatcggataagtctatagtgtttgtcacagatagtcccgtaccacaccccagaccataggagtcgctctccggaccgcggtctaatggg

SEQ ID NO: 5802 - DNA, 135 bp, Homo sapiens
cgtgcctgtaaccccagctacttgtgaggctgaggtgggaggatcgcttgagcctcgggaggcggaggttgcagtgagctgagattgtgccactgcactccagcctgagcaatagaccaggactccatctcaact

SEQ ID NO: 5803 - DNA, 285 bp, Homo sapiens
cgcggtcgtaagggctgaggatttttggtccgcacgctcctgctcctgactcaccgctgttcgctctcgccgaggaccacgtcggtcaggaagcccgcgcgcaaccagccatggcttttaaggatacccgaaaaaccacccgtggagccggaggtggcaattcaccgaattcgaatcaccctaacaggccgcaccgtaaaatccttgggaaaaggtgtgtcctgactggataagaggcgcaaaagaaaagaatctcacagtgaaaggcccagttcgaatgcctcc

SEQ ID NO: 5804 - DNA, 281 bp, Homo sapiens
  misc_feature 223: n = A,T,C or G
tgaggtctgtgtatgctcacttccacatcaacgttgttatccaggagaatgggtctctggttgaaatccgaaatttcttgggtgaaaaatacatccgcagggttcggatgagaccaggttttgcttgttcagtatctcaggcccagaaagatgatttaatccttgagggaaatgacattgagcttgtttcaaattcagcggctttgattcagcaggccacacncagttaaacacagggatatcaggaattttgggagggtatctatgtctctgaaaaggga

SEQ ID NO: 5805 - DNA, 230 bp, Homo sapiens
caccgtgtgtctaccgacttagtatgagtccgtgtgtcggactattactgtccgggactatgtaatgaatcggaccgtttggtgtcacaccccgatcccctggacgtacaggactctaccctgggtgaataggggtttgtgtcctgtggatacatggagtctctaatttgttccgaacacatggaccttttaaataattttctaaccctgcacctgtagagagttataga

SEQ ID NO: 5806 - DNA, 102 bp, Homo sapiens
agctgaggcaggagaatggcatgaacccgggagatggagcttgcagtagcgagatcgtgccacttcacttccagcctgggttacagagttggacttccattt

SEQ ID NO: 5807 - DNA, 268 bp, Homo sapiens
gttgttccagacattgatctttttcctctatgttgctaagctggtagaaggctggagttgctggcaaccatctttgcaaccatgcagggggacctactttggaaatgaggcaggacaaagaggagaccagataaagggggacacatgtttgactttgtacagctggagaccagcattgctggaaatgggcactgaaggcagtttaatggggtttgtcactcgtaaccaggtgccccatggcaggctcacagatttgtatgggcagatt

SEQ ID NO: 5808 - DNA, 103 bp, Homo sapiens
cggtaaagtccgccatcagaagactgaagggagttgaaagaccagtagacgctcctctactctttgagacatcactggcctataataaatggggttaatttta

SEQ ID NO: 5809 - DNA, 110 bp, Homo sapiens
gttggacttggtactgaagcaggctttttgggtaacagaaatgacatttaaggggtcactctatatcctgttttttagtttctctgcctctcagattctgttaactcagt

SEQ ID NO: 5810 - DNA, 138 bp, Homo sapiens
acacacatgtatgcacacacacatgccccgcacacatatccatgcacacacacacatatatacacatgcacatacacagattttttctggtggccaggtgggccaacctgggtttccctggctgggcaggaggagagg

SEQ ID NO: 5811 - DNA, 345 bp, Homo sapiens
ccgccacaatggtcgcgcatgaattgtcctgggcagatgctctcaggagtatcaacaatgccggaaagagaggcaaacgccaggtgcttattaggccgtgctccaaagtcatcgtccggtttctcactgtgatgatgaggcatggttacattggcgattttgaaatcattgatgcccacagagctgggaaaattgttgtgaacctcacaggcaggctaaacacgtgtggggtgatcagccccagatttgacgtgcactcaaagacctggaaaaatggcagaattaatctgcttccatcccgccagtttggtttcattgtactaacaacctcagctggcatcatgg

SEQ ID NO: 5812 - DNA, 138 bp, Homo sapiens
agttccaaacctgaaggctttcatgtcccgttttgaggctttagagagaatcgctgcctacttacagtctgatcagttctgcaggatgcccatcaacaccaggatggcccagtggggcaacaggcctgtatgttgagc

SEQ ID NO: 5813 - DNA, 142 bp, Homo sapiens
gtggcaagagagcctcacacctcactaggtgcagagagcccaggcctaatgtaaaatcatgcacttttaaaaggcaaaccttaaattctgcaaagacagcagcaggcttttatacggtcatctggattgatccctttgaaat

SEQ ID NO: 5814 - DNA, 109 bp, Homo sapiens
atcaaggtgaaaggagaacccatgcgggaacttcgcatccgcaaactctgtctcaacatctgttttggggagagtagagacagacttacgcgagcagccaaggtgttgg

SEQ ID NO: 5815 - DNA, 130 bp, Homo sapiens
tcgccgccctgctggccacctgcgtggtgctggcgctcgtggtcgtcgcgctgagaaagttttctgcctcctgaagcgaataaaggggccgcgcccggccgcggcgcgacttcggctgcaaaaaaaaaaa

SEQ ID NO: 5816 - DNA, 190 bp, Homo sapiens
cttgtatgtatgttatggatacataaaatgcacgcaagccattatctctccatggggaagctaagttataaaaataggtgcttggtgtacaaaactttttatatcaaaaggctttgcacatttctatatgagtgggtttactggtaaataatgttattttttacacctaattttgttacctctcagaatt

SEQ ID NO: 5817 - DNA, 165 bp, Homo sapiens
catgcccaacaagaggttctatacctctttaatgaattgactttcataaattggttatgttggtgggcaagttctttaagctggaaattgtaaattcctcctgaaatgtttttcatgcagttccatgacctattactacaataagggatggtcttgggtgtaaaa

SEQ ID NO: 5818 - DNA, 169 bp, Homo sapiens
gttgccagtgtctgtctgcagattggctacccaactgttgcatcagtaccccattctatcatcaacgggtacaaacgagtcctggccttgttctktggagagggattacaccttcccacttgctgaaaaggtcaaggcctcctgggctgatccatctgcctttgtggct

SEQ ID NO: 5819 - DNA, 251 bp, Homo sapiens
cgtgaggcggcttcggtgagagccggaaccgggcgggcagaggggcgctcgtagggttgggggacgcctgtggcttggctgcagcggccggcaagaccctggaagagaccctggctatggaaacggccaaggctgtcttgggaatgtcctgagcagccctccgagtcgagcctctccccccgagtttctgagtgacctgggttgatatagattgaccttgtgggcagcgagagtcacagacaggacagcaa

SEQ ID NO: 5820 - DNA, 241 bp, Homo sapiens
cgagccgacgccatcaacaccgagttcaagaacaaccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctggggggacctctacgaggaggagatgcgggactgcgccgccaggtggaccagctaaccaacgaca

SEQ ID NO: 5821 - DNA, 225 bp, Homo sapiens
ccaatttcaaattgtgaacccagagacactcccatccacccttctccatgctcatccccaaactggggccttggagcaaggcactctcaaatcttgaaccctggaccaagcttttccagaccccaccctaccttccacccaggtcaagacattgccaaatcttgaactcagaccccaggtgttccatgcccctgtgtggatggagtcgggtatcctgactgttgg

SEQ ID NO: 5822 - DNA, 155 bp, Homo sapiens
attagagctcaggagttcgagaccagcctgggcaacatggcaaaaccccatttctacaaaaagaacaataacaacaacaaaaaattaggcgtggtggtgcattctttcagtctcagctcctggggggcttaggcaagagggattctttaaccctg

SEQ ID NO: 5823 - DNA, 225 bp, Homo sapiens
cgcattggcgctcctacgctcagccacctcaccaggctgccctggtcagccatggctcctcgtggcctcttccacaagtacttcgcaggagggtgacaagcacaccttaagcaagaggagcttaaggagcttgatcagaaggagctcaccatttgctctaagcttcaggatgcttaaatttcaaggcttatggaggagttttacccaacaagggcacgaggggaw

SEQ ID NO: 5824 - DNA, 171 bp, Homo sapiens
gagatcgagaccatcctgggctaacaaggtgaaaccctggtctctgctgaaaatacaaaaaattagtcaggtggtggtgggtggggcgcctggtagttcccagctacttggggagggctgaaggcaaggggaaatgggcctgaaccccaggggggcaaggagctttccaag

SEQ ID NO: 5825 - DNA, 175 bp, Homo sapiens
gctacaccgggtcagcgggagagaaaggagagccgggccccccaggatctgaaggccttccagggcccccagggcccaggcgggtccccagaaggggagcccagggacccccaaggtaaacttcggtttagaagggggcacccccgggtttttaagggccaaggaagggtttttt

SEQ ID NO: 5826 - DNA, 181 bp, Homo sapiens
tcagttctacaattctggttaaaacccatgggcactggtcaattgcatgattaaatgtaggagatgggaagggtgataagttttagttaaatattatggggtttgtgctttctccccttctatgttggttagggctgtgcttctgggcacaataaattatggggccctttttctgggaatt

SEQ ID NO: 5827 - DNA, 140 bp, Homo sapiens
ttgtaaaaacctgaacccagaaacaacacaatccgttgcaaacccaaaggagccaagtactttgcaaacctctgtcacgtcttaggactctagcactcgacatgcgctcgagcctgaacctgagagtaccatcggagtac

SEQ ID NO: 5828 - DNA, 110 bp, Homo sapiens
gtctgagttatcaataagctcctagtccagacgccatgggtcatttcacagaggaggacaaggctactatcacaaagcctcttggggcaaaggtgaactttgggaagact

SEQ ID NO: 5829 - DNA, 172 bp, Homo sapiens
cagatcagtttggggtgcatgtatgattttgcagcgtcaaattggagtaaggggagatttcttgttatactttgctcgggagaaggaggaatgtttatagaaactgatttagggtgacttccaaaacttttgtttaaaaaccaattttagttttcagaaagataaacataca

SEQ ID NO: 5830 - DNA, 122 bp, Homo sapiens
ccccactctgtgaaaacttaacgctttttggaagacatttctgtagcatgtcagtttggagaaatgatgagctacgccttgatgaaagaaccctgttggtgcttgctaagtttagccattat

SEQ ID NO: 5831 - DNA, 287 bp, Homo sapiens
accaaacaaccttagccaaaccatttacccaaataaagtataggcgatagaaattgaaacctggcgcaatagatatagtaccgcaagggaaaagatgaaaaattataaccaagcataatatagcaaggactaacccctataccttctgcataatgaattaactagaaataactttgcaaggagagccaaagctaagaccccgaaaccagacgagctacctaaggaccagctaaaagagcacacccgtctatgtagcaaaatagtggggagatttataggtagaggcg

SEQ ID NO: 5832 - DNA, 288 bp, Homo sapiens
tggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctcttcagatgccccagctgctctctaccagacacattgaagagaatatttaaaatctctgtaagaagaagaagttgaatttatcattgtgtctctgccagagtgttgcagagagagatactctcaacacagtgca

SEQ ID NO: 5833 - DNA, 246 bp, Homo sapiens
cccaaacccactccaccttactaccagacaaccttagccaaaccatttacccaaataaagtataggcgatagaaattgaaaccttggcgcaatagatatggtaccgcaagggaaagatgaaaaattataaccaaggataatatatgcaaggcctaacccctatattcctctgcataatgtaattaactagagaatatctcttgcacaggagagaccacaggtcaagagcccccgcgaacacacgcg

SEQ ID NO: 5834 - DNA, 280 bp, Homo sapiens
tttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatagggtcaggccagttgagatgtaaagaaggcccttaagctctatatgggtcacatagtaaggtgaattcacaggctgtaagggtatagcacatttcacctacacagatctcgagagtagg

SEQ ID NO: 5835 - DNA, 280 bp, Homo sapiens
gacaagtttagtgatgaagaagacagcttctcacccaaggagctcggaggcagagcctagagaggaagggaattatatacacctactaccagcagcccactcctaagaccactgtggactcctcagcatgtctgtacggctaggtagggtcatccaccttctctcgcttggtgttcctccttacctctgcttctctggatcccactctcccacctcttcactctcccctcccactgtccctccatctctagagtgcccagaggctcccccctctgctgag

SEQ ID NO: 5836 - DNA, 295 bp, Homo sapiens
aaccgactttcccttcccatacccctcagggtggttccctaccagccaggcttactacttctagaagaaagcagagtgccagggagtgagattgcatccctgggcttagaagttacggagagaagacttgtttagtattttgccatcagcacacaggagaaaccaagagagagtcttccttcacagactctcgagaccttctgtctctgtatgtacagagaggttgatagagtctctccaactccagcatagctcgaactctcagagggtcttcagagctccatctccacatgtg

SEQ ID NO: 5837 - DNA, 304 bp, Homo sapiens
aagaacgtgagcaagcccaggcacagccgacgccgcgggcgtcttgaccaaacacaccaagttcgtgcgggacatgattcgggaggtgtgttgctttgccccgtacgagcggcgcggcatggagttacttaaggtcttcaaggacaaacgggcccttaaatttatcaagagaaagggtggggacgcacatatcgcgccacagagggaagcgcggagagagctctagcaacgtactctgccgccatataggagagctgctctccaagagagactctagccccttccctgtcctctctctcagata

SEQ ID NO: 5838 - DNA, 215 bp, Homo sapiens
tgcatgtttgtgttgtatatttagtatgaacttttttcagaatataatatttcttagttatcaaaagtagttggaaaacatttgcaagactattaacatagaattgctgcttttatattttaacttcagattgtgaatttcactgtccctatatatatttatttctgtaaacacaaagaggccattttttcaatataaactatctgtaaaatttg

SEQ ID NO: 5839 - DNA, 302 bp, Homo sapiens
tgactccaaaacaacttacatccacgtcttctgaaatgtggattccagaatgattgcttagggactgacaacaaagcggggtttgtaagggaagccaggtttgggaataggagctcttaaataatgtgtcacagtgcatgtgtggcctctgtgttggtttcaagttgaggttgatcttgtatctacacattgttggggaaaaggaagcgatgcagacacgcagaaaggaggggctcagactcttctgagacacactctctttgtgtgtacatcatgtcacgggctttcactcacagtgtctc

SEQ ID NO: 5840 - DNA, 290 bp, Homo sapiens
aggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgcgtacaacggactgattcaccgcaagactgttggcgtggagcccgcagaccgacggcaaaagagtgtcgtgggtgggtcatataagcggagatcccgccagacgaagccctgccacactcctatatgcggagcaccattaaccaa

SEQ ID NO: 5841 - DNA, 340 bp, Homo sapiens
gtgcgaattcggcacgaggccgaaatgggcaagttcatgaaacctgggaaaggtggtgcttgtcctggctggacgctactccggacgcaaagctgtcatcgtgaagaacattgatgatgggcacctcagatcgcccctacagccatgctctggtggctggaattgaccgctacccccgcaaagtgacatctgccatggcaagaggaggatcgccaggagatcaaagataaaatcttttgtgaaagtgtatatctccaatcacctaatgcccacaggatcctctgtggatatcccctgggacaaatctctcgtcaataaggatgtcttcagagatcctcct

SEQ ID NO: 5842 - DNA, 305 bp, Homo sapiens
attgaagacgtccagctagcagccaatatactttgtggatgccaaattatgctattttaaatatgattaacaacagcaaattagagaacacaaaccatctccaaagctccatcttacatacatttaaataattatttttgtgtgtggagagaccactattctgcaggtgtgcagatataaggcataattctttaccaccctctgtgtggtgattttaagagacacatctttctgatcattgattctccctccctatttctagagtaatattgagcctctacacttcttttaaggtgattcataag

SEQ ID NO: 5843 - DNA, 345 bp, Homo sapiens
gatctacttatggttgatggagcacattgatttggagtttcagatcttccaaagcactatttgttgtaataacttttctaaatatagtgcctttaaaggaaaaatgaccacagggaagtgactttgctacacataatgttgctgtgttaagtattcatattaaatacatgccttctatatggaccatggcagagagacttaaaattaacagttatttatttgtgtaattcagagtttcataccattcagtgttgacactcaaacattgcaaaagtggggtggcaatattcagtgcttaacacttttttagcgttggcacatcttagaaatgagtgctcaggtgga

SEQ ID NO: 5844 - DNA, 225 bp, Homo sapiens
gcgcagtggcccacacctgtaatcccaggactttgggaggccgaggcaggtagatcacgaggtcagcagttcgagaccagcctggccaacatggtgaaaccctgttctctactaaaatacacaaattaggctgggtttggtgcacacggctgtaatcccaggcaactcgggaaggctgaggcagggattcgcttaattccacggagcaagagtttcagtgagcca

SEQ ID NO: 5845 - DNA, 170 bp, Homo sapiens
gtttgccacatcaagattttagggaagggggttattattttttagtaggggattgccgtttgaaaaccagggcactcttccccttgagggattgggaaagggagctctccatttgtggaggattctaggccatatggtttaaggccagaccccctaaaggtgaccctttt

SEQ ID NO: 5846 - DNA, 105 bp, Homo sapiens
agggcctgcattggatgagactgcccagcaagctgcgctccctagggccccaggattccacctaactggcctaggaacctggtgccaccgtggctcctgccgcta

SEQ ID NO: 5847 - DNA, 320 bp, Homo sapiens
aggtcgacactagtggatccaaagaattcggcacgagtgggctcttagttcagctgctggcactcgcaggatcctgcagtgctgggcccagagcccttggacaggcctcaggagtggtcaggaccaccaagcccctcctctccccctccacacctctagacctcgggcctccggaacccccagcaggctgggcttatactagctcctgacttaggagagagcctcgtgtcacaccacgtgtccctacaggcaaagtgtcctggcatttaaaacccagattatccctgggtttgggctgcagtcacctggagacgctggta

SEQ ID NO: 5848 - DNA, 285 bp, Homo sapiens
acccactttttttagacattgataaagtcttcttcacgtggatattttatacaagaacacttcagatgtattagatgtgactgattttaacaaatcctattagatttgtatcaactagttacatgtcctattcatagtcttttgtgaatcattgcctctttggtttaaaagagatggcctattttagagcctctggtatagatacacacctctcttttgtgacacacgagaaatctctaaaattgtcccccacagagatatattggctatcagaggtatggtttg

SEQ ID NO: 5849 - DNA, 270 bp, Homo sapiens
atcccccccctttttttaaagatagggtctcactcttttgcccaggctggggtgttgtggcacgatcatagctcactgcagcctcgacctcctaggctcaggcattcctttcaccttagctcctcaaagcactgggactgtaggcatgagccactgtgcctggccccaaacggcccttttactcggcttttaggaggcaaacacagtgctaatctaaccccttctcgtgtatacaccctcaacccttgcgctggcctctctctggagact

SEQ ID NO: 5850 - DNA, 320 bp, Homo sapiens
ggcccgggcaagagtttaacatcttcggcctgcattcctacatcttgtgtctgtacacgttcttaagcagcgtgtcaggagagcaccctgttgtcttctggtaaatgtgtccagggtcatcctgtctcctgtacctcctgggaaaggggccgctgctgtctggtgccctgtgagctgtgattgattgcctttggtcagtaatgcgttcaggagtccacaccaggcacagatggggccttgaagcgctttgtcatgcttctacagtcccatggatttgaaatgaactcatcctcgctgtgagcatccaggagcccttgaga

SEQ ID NO: 5851 - DNA, 263 bp, Homo sapiens
ctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacaccttaaacccaagagggcagctgtttgcagcatccagttcatcttaagagtgtcaacggttagtcatgcaataaatgttctcgg

SEQ ID NO: 5852 - DNA, 262 bp, Homo sapiens
ctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacaccttaaacccaagagggcagctgtttgcagcatccagttcatcttaagagtgtcaacggttagtcatgcaataaatgttctcg

SEQ ID NO: 5853 - DNA, 238 bp, Homo sapiens
cggaggccgcacgatgcctggagttactgtaaaagacgtgaaccagcaggagttcgtcagagctctggcagccttcctcaaaaagtccgggaagctgaaagtccccgaatgggtggataccgtcaggctggccaagcacaaagagctttctccctacgatgagaactggttctacacgcgagctgcttcacagcgcggcacctgtaacctccggggtggcgctggggttggctccatg

SEQ ID NO: 5854 - DNA, 221 bp, Homo sapiens
tatgacccgccccctcctcctccgcctcccatggacccttctaactttgtcaccatgatgggcatgggggtggcgggcatgccgcccttcgggatgcctccagctcccccaccgcctccaccacagaaactagacttgttttttaaggaaatatatattatatatagagagaattggtctggtttaaacacgccgaacctcaccatatagagccagacatw

SEQ ID NO: 5855 - DNA, 223 bp, Homo sapiens
gtgtattagtgtgcgtgtgtgtgcatgtgtgtgcgtgtgctgtgcgtttgtgtgctgtgtgtgcatgtgtgtgctgtctcgtgccgaattcggcacgaggggaagttcttttaaatcattaaatattaagacggccatctcttctattaaattacagtacatgtatagaccattgaggatcaagcctttacttcctttgagagttttccaacaacaggtgatt

SEQ ID NO: 5856 - DNA, 226 bp, Homo sapiens
caggagttcgtcagagctctggcagccttcctcaaaaagtccgggaagctgaaagtccccgaatgggtgggataccgtcaagctggccaagcacaaagagcttgctccctacgatgagaactggttctacacgcgagctgcttccacagcgcggcacctgtacctccggggtggcactggggttggctcatgaccaagatctattggggacggcagaaaaacggcg

SEQ ID NO: 5857 - DNA, 185 bp, Homo sapiens
gctatgccttgccccatgccatcatgcgtctggatctggctggccgagatctcactgactacctcatgaagatcctgactgagcgtggctattccttcgttactactgctgagcgtgagattgtccgggacatcaaggagaaactgttgttatgagctctggactttgaaaatgagatggccact

SEQ ID NO: 5858 - DNA, 103 bp, Homo sapiens
gagagagagagagagagagagagagagagagagagagagagagagagagagagagagagagagagagagagagagaagagagagaggaggggaggagagagag

SEQ ID NO: 5859 - DNA, 188 bp, Homo sapiens
gagaaaaaaggaaggttctgtcaacacaaatcacaaaccaccccggagaactaaaccccacagggtaaagggccaaagtacaaatttgtggccctcctgtacattagcccatttaccaaaggacggggactaaaaggggagggggaaccacggaacaacctttttaagggataatggggaaaagggtg

SEQ ID NO: 5860 - DNA, 340 bp, Homo sapiens
ctgagctctatggcactggttgtttagagtgactgatgaagtgcaactttcaaaaacatttttgatgacatcaccagcctacttcagaagttcagggcaccagtaaacaccatgtattattgaagatgaatctgtttgtatgtatccttgtcaaatatattctataatgaaataaaatctgaaaagtggagttcttatttgacctatatttcatgagagcatatatattaaaatatttaaaattagatatgattcacactatattctgtttcatatgcagagtttattctcacctcgggcatttgcagatgagactctaggtttcagatgagactctagt

SEQ ID NO: 5861 - DNA, 208 bp, Homo sapiens
tgaaggttgacagtaagatgagtagggctcgcgttgaaaaggccagaggaggaaagcttctccagcactctaataagctaccagcttaattcttccacacttccttgttcctgcccttggcttgttcggtccagtctaccttggaggcagccttgccccagagcagaccacattgctctcttagaggaactctttggggcatgttctc

SEQ ID NO: 5862 - DNA, 297 bp, Homo sapiens
  misc_feature 37, 38: n = A,T,C or G
ccccaccctcagcccgctcctgcccgcccagcacccnngccctgggggaacctcggggttctcagactgccaaaggaggctttgccattttggcggctccattgggttttgcaacaacttccccttcgtttttgaggggggtcatgtccccggggagccaccagacccctcacttgggttcggaggagagtcaagaaggggccacagcacgagcacagcagagacatcggatttgggggagcgcgtgtcaaatccccagaccgctgctcactctacaccctctctccacctgtctct

SEQ ID NO: 5863 - DNA, 287 bp, Homo sapiens
aggtatagttttctatactctctaattttacagaagggaggcagcattctgagatatttgcatatttgtgtaagggtatggtgctaatgtaaggaattaatttggtaggatcataggcttccaggacttgaggggatatagagagagactctgttttcaccccttgtcagagtttgtctctcttttgagatttttaaagagcgctcatgaatttttagatacccactagagtgctctctataattctcttaatactctatacactcactttctatatattcacactr

SEQ ID NO: 5864 - DNA, 226 bp, Homo sapiens
gggctgttataggtaggaccagataagactgtaagatgttgtttttggggttaaaggggagaaacttaaagtgttttactctttttcttagggttgtggctttcttatgtaggatttttcgttgcatttttctattcaaacacattgttatctgggtaatgtgctagtactgtatacgctctgtgaaaacatatatgtgagagagtataagtgcgctctctctttg

SEQ ID NO: 5865 - DNA, 232 bp, Homo sapiens
gtcacatcattcaccaacacatcaaggtgtattcagttctcttcaaccccgcattgggccattttaatttactgttagggtaaactaatttgttacaacatcgaagggcaggcctggcctcagtaggactatgccaagctctcttgcatctcttcacagagcacttacacgcgatacacagggcagcgcgagaggaggcgttttttatctcgagcctctatatactctctca

SEQ ID NO: 5866 - DNA, 198 bp, Homo sapiens
ttataacatacttctccagtaatcataactcatatgattaacctygattgctttaataaggaagtatagagatgacaattacaggtggctttttactaaaatatttaaaggaaatacaattaggccctaatttttcttaaaagaggtatatacaggtctcatacttgccttatttgatttttaataaatcatcttttt

SEQ ID NO: 5867 - DNA, 160 bp, Homo sapiens
cagcaatggccaagatcaaggctcgagatcttcgcgggaagaagaagggaggagctgctgaaacaacttggacgacctgaaggtggagctgtcccaactgcgcgtcgccaaaagtttacaagcggtgcgggcttcaagctctttaagatccgagtcgttc

SEQ ID NO: 5868 - DNA, 215 bp, Homo sapiens
gttttgagcaaggggaagggttgccagagtgctcgggggccccagaggagcaggagtctgggagggccagagttcaacctctagtggatccaggaggagcagcacccagcccttgagttgcccaatacccttccaagaggccacagtcccagccaggacaaagtatgtcgggccatctctggtacgacaactctgggacaaatgtgtagcatagg

SEQ ID NO: 5869 - DNA, 232 bp, Homo sapiens
cacaggtccagcccgtgaggggggggcagtgggtgggcaagatggggagcaggcacccccacttcccatcaaggctcccctcccatcttctagcacgtctcagcccccactactgtccctgaagccccagggcgacttttcctcaactgcccctgagccaatactatttctgagatagtgcaagccctgctaggcgcgcttgtgtcccagcgcgtggggcccaggacaatcc

SEQ ID NO: 5870 - DNA, 400 bp, Homo sapiens
ccgccacaatggtgcgcatgaactgtcctggcagtatggtctcagagtatcaacaatgccggaaaagagaggcaaacgcaggtgcttattaggtcgtgcttcaaagtaatcgtgcggatttctcactgtgatgatgaagcatggttacattggcgagtttgaaatcattgatgacacagagctagggaaattgttgtgaacctcacaggcaggctaaacacgtttcgggtgatcagcccaagatttaacgtgcactcaaagacctcgaaaattgcagactatctgctttaagtccagccagtttgcttcattgtactgacaactcagctggcatcatggaccatgtggagcaagacgaaacaaacaggagggaaaatcttgggctcttttctagggggta

SEQ ID NO: 5871 - DNA, 300 bp, Homo sapiens
ttgagatcttactgcttgtcacttgaatcccgtgattgtcatacatctctggtataagcaacatttgattttttgaaggttgtaggccctctcttcatatttttcaaggtgtaatttttacatttctgcatttttaaaacagtttggccataatcctagatgcacgcttctaattcatgtatcccccacatgtgtagctctgtgtacagagatttgcatgtttatatgtgtgtactcgtaactctctggagatatactgctcatatctgtggagtcaggggactctgtgataaccactat

SEQ ID NO: 5872 - DNA, 194 bp, Homo sapiens
gtttatgtaaaaatgaaggtggcaccgtggtgagacctaatgagaaatagttactcagttgtaaaaattttgatttattctctttcttctgacctcctttgcctcttggtcttgaaccatagcaaaaggatactgcatctttccaatacttgtaggcctgagggtattgaaggtatacaaacacatctcagttt

SEQ ID NO: 5873 - DNA, 141 bp, Homo sapiens
cgtgagctcagcctaccgctggccctaccgttacccctccttgggcttatgcaaatacaatcagcccagtgcaaacgaaagaaaaacaaatgcagatgaaagccctgccaaaggactacttcaaaaggggaaagggcactt

SEQ ID NO: 5874 - DNA, 235 bp, Homo sapiens
ctttgggtgctgtagaaaacaaaaaaagaaaaatatatattcataaaaaatatggtgctcattctcatccatccaggatgtactaaaacagtgtgtttaataaattgtaattattttgtgtacaggtctatactggtatctgttgtcaatttcaaaacttgcacgggtcctgaaattcatctgactctaattttatgggagattcagagctctgataggcaatatatatatgtat

SEQ ID NO: 5875 - DNA, 140 bp, Homo sapiens
ctcacattgcatgcaagtttgctgagctgaaggaaaagattgatcgccgttctggtaaaaagcttggaagatgggccctaaattcttgaagtcttggtgatgcttcccattgttgatattggttcctgggcaagcccatt

SEQ ID NO: 5876 - DNA, 193 bp, Homo sapiens
cacgagcatcacctccctgcgctctcgctcctgttttactctgcttctcttcttaaaaaacaaacagtaaaagattttattttctgatgatttttctgtccttatctatgaacggagaagggaggtaggatggatattgttccttttagtaaacggagtctgtgcccaacctgtgtgcatagggaactcactc

SEQ ID NO: 5877 - DNA, 248 bp, Homo sapiens
agcaaactgccctttgtcctcaaagaaattgttgaaaagaaactttttaaagagattttttgcatattctctgccttgttcttatcaacttgaaatgttgggcattttctaaccttgttttgttggctacaataattcaggattcaagtgcaaaattgaagaaggcccctaaatgaatgtgtgtgaatttgataccctgcacacatctcttatattgagagagataatatgttaccccacactgggga

SEQ ID NO: 5878 - DNA, 166 bp, Homo sapiens
gacataggaggccgagcaggaatcggtgtgacatagggcggtcttcttcttgtaaaacctgaacccagaacaacaaaatccgttgcaaacccaaaggacccaagtactttccaatttcagtcactcttagggctctgcactgaatggctcgacccgactcgatttc

SEQ ID NO: 5879 - DNA, 142 bp, Homo sapiens
caggattgcaagctcatgtgtggaggcctggggcagggcaccagttaacaggcacaggtcccagggcccaagggggaggtgggaccatcccagttcctaaaagttgcttcttctaccctatcccatcccctgtaacggattt

SEQ ID NO: 5880 - DNA, 200 bp, Homo sapiens
cccactgcaacattgccattgtcactggagattggtgggcattgagctattagccttccctccaccagcaccctgccccttttccaacaattcttccagttcaaaattggacatggggaacagcaaacttaccccttcccttggtggcacttccacctgtgtgtaatgtgtacaaaggggcaataaagagcctctgtgca

SEQ ID NO: 5881 - DNA, 111 bp, Homo sapiens
cgcgctgtgcctgctcgtgttgcctacaatgttccttgctgttagaggcgcttcttcagcttgcaaccctttccttgtcttataaggagctctccttttgacccctctcta

SEQ ID NO: 5882 - DNA, 105 bp, Homo sapiens
gtcaaggcaaagatcccagacaagggaggcattccttcttatcagcagaggttgatcttttcttgggaaacaaacttgaagagttgagccgccccctttttagtt

SEQ ID NO: 5883 - DNA, 146 bp, Homo sapiens
ctcttccctgttaaccagttctgtcagcatccccctctacagcagcacttacatggagttgggtcttgagacttttgccgttaacacaccgctttcttcagtgtattttgttttttgggcttttttggtttaaaaaccccagaggt

SEQ ID NO: 5884 - DNA, 156 bp, Homo sapiens
agaagcgagattgcgaagggaaccgtcatcggttgggaaagcgtcgcaataaagacgcacacggtgttcccggcgggttttggcttttagggccttaccccacttcagagaggtgggcccctttgcamaatttgtggttttcctttcaaaggccca

SEQ ID NO: 5885 - DNA, 108 bp, Homo sapiens
ctcgtgcgaaattcggcacgagggtcgactgctatgttgtgttttgcagaacaggcttctcttggtatttgccttacttaattaaaaagcaagggctgttattacctt

SEQ ID NO: 5886 - DNA, 136 bp, Homo sapiens
cgccgcttgtgctgcagccatgtctctagtgatccctgaaaagttccagcatattttgcgaggacttaacaccaacatcgatgggcggcgggaaatagcccttgccattacttcccttaagggggtggggccccag

SEQ ID NO: 5887 - DNA, 141 bp, Homo sapiens
cacatgcctatcatatagtaaaacccagcccatgacccctaacaggggccctctcagcccttctaattaccttccggcctagccattgttattttacttttcacttcataaacggttctctatacttgggctttcttacca

SEQ ID NO: 5888 - DNA, 134 bp, Homo sapiens
ctttgtggtgcgggacgcccttgggaccgccagcagcagtgagaggctcctacatgagcagctctgaggaatttcccagctttggggctcaggtggctccaagaccctcccttggggccccaaacgttaatgtt

SEQ ID NO: 5889 - DNA, 135 bp, Homo sapiens
ctggagttggcaccctgcagcagttatgatccagatctatgttctgtgacggtcgtagacaagccaatttatttgcttaatctgtgaaaccacggatcaatccctccaaaacccgttgaaaaaaggataaattct

SEQ ID NO: 5890 - DNA, 145 bp, Homo sapiens
gcgagctgagccctggccgccgccacaatgggccgcgagttttggaatcttacgcggatgcggcatgtgatcagctacaacttgtcacccttcgagcagcgcgccctattcccacggcttcactaaaggaatcccccaatgttct

SEQ ID NO: 5891 - DNA, 105 bp, Homo sapiens
ccatgatccaatcaccttctaccagaccccacctccagcactgggaattacatttcaacatgagatttagggtggggacacggatcccaaccatagcactattta

SEQ ID NO: 5892 - DNA, 109 bp, Homo sapiens
tgaatcactcactcacagcacttacccagtgagcatgcaccaggacaaccacggctacatcttccttcttatttaggggggccacaaaagaaaggttcttgggtgggga

SEQ ID NO: 5893 - DNA, 130 bp, Homo sapiens
tgcgtgtatcggaaacaacgtgcccggctcgtgcggacggttcttcgggctaccagaagtgggaggcaccgaaagcccccagtaatcgcgtacacgtggyccggccatctcatggcctcggggggtccag

SEQ ID NO: 5894 - DNA, 263 bp, Homo sapiens
ctttagaaaaatggatgcccagaggactcccaaccctggcttggggtcaaagaaacagccagcaagagttaggggccttagggcactgggctgttgttccattgaggccgactctggccctggcccttacttgcttctctagctctctaggcctctccagtttgcacctgtccccaccctccactcagctgtcctgcagcaaacactccaccctccaccttccattttccccactactgcagcacctccaggccttttgcata

SEQ ID NO: 5895 - DNA, 155 bp, Homo sapiens
tctcacattggacatactcaaaattcacttataatcttcacaccaccaaaaacttacccatatcaaattataaacccacccacattacttaaaattttttacatttcccaataaaaaacccaaataaacaaaaacttccaatctccatttaaaat

SEQ ID NO: 5896 - DNA, 195 bp, Homo sapiens
gtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatcccaagatcggatcattacccttacagggacac

SEQ ID NO: 5897 - DNA, 184 bp, Homo sapiens
cactcttccattgtcttgatgaatagcattctagattccttctagacatactaatcaacccaaactttcattggtaacacccttggcgttttatcataaacacatttctctttctttaccaattggccagtctgagaatttgtcaaatccttaattttagcttcccttttgatgacaaattctg

SEQ ID NO: 5898 - DNA, 219 bp, Homo sapiens
cttgtgccgaattcggcacgaaggaagatcctggtgtcgccatgggccgccgcccgcccgttgttaccggtattgtaagaacaagccgtacccaaagtctcgcttctgccgaggtgtccctgatgccaaggttcgcattttttgaccttgggcggaaaaaggcaaaagtggatgagtttccccttttgttgccaaatagggtcagatgaatatatagca

SEQ ID NO: 5899 - DNA, 145 bp, Homo sapiens
ctaatgctgttactaacttttcagttataaattgatgaatatctttgtgcacaggctgtttcccaatgtcaagttattagggtagactccaggaggttggattcttcaactaaagaatatgaaaacctttgaggcttttactaca

SEQ ID NO: 5900 - DNA, 230 bp, Homo sapiens
ggttcctgctgccctcaaggtcgtgcgtctgaagctacaagaaagtttgcctatctggggcgcctggctcacgaggttggcttgaagtaccaagcagtcacagccaccctggaggagaagaggaaagagaaagccaagagtcccctacccggaggaggaacagctcatgaggctacggacacaggccgagaagagcgtggagaagagaatttacacatacacagagggac

SEQ ID NO: 5901 - DNA, 154 bp, Homo sapiens
ttaatctattaatcaataattactcttacatacattcgcataattctgtataagtctgaattcagtgaaaatctcgtaacacaaaagggtttcttttgacaataacatttagattatctctggaagatgctatttaaggcacattgagtatact

SEQ ID NO: 5902 - DNA, 163 bp, Homo sapiens
cctcacgtgagggcattgcccggaagatcaaggcgtgcgccttgcagcgcgccccttgaaggattaaggccactgctgggccaattccgggggggcgtgcccttactatcccttgaaagaagcaaaactcaattatttgaagggtaaatcccattgggccctt

SEQ ID NO: 5903 - DNA, 250 bp, Homo sapiens
cttgaatcctttcaaagagtggagcttctgaagaaagaaatcgataagttcaaagacaaaaaagaggtagcaattgtggtattaggaaacaaaatcgacctttctgagcagagacaagtggatgctgaagtggcacaacagttggcaaaaagtgagaaagtaagactgtgggaggtgactgttacagatcggaaaactctgattgaaccattcactttattagccagtaaactttcttaacccagagcaa

SEQ ID NO: 5904 - DNA, 300 bp, Homo sapiens
atcgtgtgctgcctggaggagaagcctggagaccgtggcaagctggcccgggcatcagggaactatgccaccgttatctcccacaaccctgagaccaagaagacccgtgktgaagctgccctccggctccaagaaggttatctcctcagccaacagagctgtggttggtgtggtggcttggaggtggccgaattgacaaacccatcttgaaggctggccgggcgtaccacaaatataaggcaaagaggactcctggccacgagtacggggtgtggccatgaattcctgttgagcatcctc

SEQ ID NO: 5905 - DNA, 276 bp, Homo sapiens
gtccctcaccttgccagagcctgtgttaatttccgagaccagcctgagtgccaagattgcctgtgtgctcctctcccagagctgcctgttcgaggagccagacctgacccagcgttgctgggaggtgattgatgcccagagctgagttagctctcaagtctgagggattctgtcgatattgacttccagcacactagaaaggtgattctccgtggggaaactctgtaatgccaaagaaaattgtggtttttgaggcagctctcaactgggctcagh

SEQ ID NO: 5906 - DNA, 295 bp, Homo sapiens
agatgcccagattacctgcagggtctgcgctaccaggaagcccctgatttgttttgaaatccacacttggccgggcgtggtggctcatacctgtaatcccagcactttgggaggccgaggcgggcggatcacaacgtcaggagatcgagaccattcctggctaacattggtgaaaccctgttctttacttaaaaatacaaaaattaggccgggcgtagttgcattcgcctgttaggtccagctacttgggaggcttaggcaggagaatctgctcttaaccttgggagcggaggtt

SEQ ID NO: 5907 - DNA, 250 bp, Homo sapiens
agtaactagagaaaagacttatttatataaaatgaagtatttatgaactgtgataaagcatcaaatcttgatgaaggattgtagatttttgctttttctttttgtttttaaaacttattccaattgctaaattggtagtttttcagtctttataaatacagggttaaaaatatatatacagttatatgaaatgtttatttctatgtgtgtgcatatagtccattataggcataaatttggtgttttactt

SEQ ID NO: 5908 - DNA, 217 bp, Homo sapiens
tgaggtcaggagttcgataacagcctgatcaatatggtgaaaccccgtctctactaaaaatacaaaaattagctgggtgttgtggtgtgcacctgtagtcccagctacttgggatgttgagacaggagaattgcttgaatctgggcggcataggttgcaatgagctgagatcgtgtcattgcactccagcctgggtgacggagtgaggctgtgtctc

SEQ ID NO: 5909 - DNA, 285 bp, Homo sapiens
ctgacatagagttggatctgtagcggtcctttggagagtgtgtgtggcgggagagtgaaaccttgggggaaaatgctaggagattcttttttctttttgttctacttttcgttcggaaagtttttaaatcctcatttggtgcatctgtattccagccaataggtgtgccagttttcatagtaatctttactggcccaacttggggagtgggggaaattgcttaaaaaaaaaagagaaagagaaaaaaaaagattattctaaataaagggagaaggggcttacact

SEQ ID NO: 5910 - DNA, 430 bp, Homo sapiens
cttatttttgaaggcagagcagaggatcttctgatggtatcagggaggtatgagagagaaaggtcaaaaaattgacttccaattttttcyttttccttttttctttttttgtttttttttaacccccgggccacctttaaaggtttgggttttcctttttttcccggggaaggtaaatttttytagggttttttattaaaaataatcttaaaatctaatcccacccccacatttgggggaaagttggcaaaaggcaagggtggaaacaaaacttttcttttttaaaggcccttttcaacaaattggcagcccctttttttggggcaattatccttttaagaagggtttgcatgttcttagccaaattcttaccctttttcaattattttcgggttaaccccaaccacttggcttgacggtttttttttcc

SEQ ID NO: 5911 - DNA, 143 bp, Homo sapiens
ggaaggtactttcttgaggagcgggccgcgggcccaatctcgattttttacaccccgggtgggggtaaccaaggtaaagtgtacccaatttcgcccctaataagtgaagtccataaaaacaaaacaaccaggaaaatagaaaa

SEQ ID NO: 5912 - DNA, 258 bp, Homo sapiens
cagacctcttgctgcccagcccagggtgggtggggcgcacacctgtctttgtgcatgcaaatctgatacacctggcgcatcctctggagagcacaacgcatggtaaggtctggaagctctgtgtagccattccttctgcagtcatcctacccaagtaaaagtaaccttggctatgttaccaccgttttggtcacccaggaggacatcttagcaagggtgcctccgagggagtgtgggacttggcctcatcctcgccgg

SEQ ID NO: 5913 - DNA, 262 bp, Homo sapiens
cggcatcccaccgccctacgacaagaaaaagcggatggtggttcctgctgccctcaaggtcgtgcgtctgaagcctacaagaaagtttgcctatcttggggcgcctggctcacgaggttggctggaagtaccacgcagtgacagccaccctcgaggagaagaggaaagagaaagccaagatccactaccggaagaagagacagctcatgaggctacggaaacaggccgagaagaacgtggagaagaaaattgacatatacac

SEQ ID NO: 5914 - DNA, 126 bp, Homo sapiens
tgaacgctacgcttacaaatattgtctctgtgctgctggtgtgacaaacgcaatgcaaaaacaatcctctttctctctcttgatgcatgatacaacataataatgggagttgcatcttgtgaatga

SEQ ID NO: 5915 - DNA, 141 bp, Homo sapiens
tgggagtacacagatatccacgttacagatatctaagatatatttatgtacagcaccactctgaaataatggtattattatgagatccaccccctgggctctgttattctttatatatgttatataagagaggacacatct

SEQ ID NO: 5916 - DNA, 292 bp, Homo sapiens
gttggggtggctggttctggggctgggattggacctgtgtttgggagcctcatcattggatatgccaggaccccttctctgaggcacacasctcttctcctacgccattctgggctttcctcctcgagaggccatggggctctcttgtctaatggtggcctctctacatcctctttcccatgtaagggagccgtctccacctccaatagttctcccgcgtctggttggcccgtgtgttcctcttcctatacctccacagacagccgtgggaaccgtggttggctaaggtttg

SEQ ID NO: 5917 - DNA, 181 bp, Homo sapiens
attttaaaattgattagcatcatatatcatctatcccattagagtatgcagatatttgccacagtgtctctctcagatcagcatatgtctctgccagcctcatttcatctcctccatggtccgcagagctttgttctggcagaagagaataaatgtacctctctgataatggagatgttaa

SEQ ID NO: 5918 - DNA, 156 bp, Homo sapiens
gtcgccagaggtggccgagagagcctgccgcatgatgattggcatgaggctaagtggccagcagagattaaccgttcgatttgatagagccgctaaaggacggttgcctctttaaaaacatcgatacgagaccctctgatttttgatattttttct

SEQ ID NO: 5919 - DNA, 220 bp, Homo sapiens
gtcgcmtggttgggcggtgctggttttcgctcgtcgactgcggctcttcctcgggcagcggaaggccgcggccggtcggagaagtggcctaaaacttcggcgttgggtgaaagaaaatagcccgcacccaagcagactgctcgtaagtccaccggtgggaaagcccccgcaaacaactggccacgaaagccgccagaaaaagctgctccctctaccgccg

SEQ ID NO: 5920 - DNA, 242 bp, Homo sapiens
cggcacgagaacaagctccatctgtcctacgacaaacagacctaaaatcgctcattgcatactcttcaatcagccacatagccctcgtagtaacagccattctcatccaaaccccctgaggcttcaccgccgcagtcattctcataatcgccccacggaccttacatcctcattactattctgcctagcaactcaactagacgcactcacagtcgcatcataatcctctctcagggcctcca

SEQ ID NO: 5921 - DNA, 186 bp, Homo sapiens
gtctcttcggaccaagggcccgcctcgagacattggcttcaaaggcatccaggccctcgggccaccctgcttgatgggaaaggaaggcatcgtcgggccctcggatcctgggacctccggactccggtccgaggtgacaaagcagcgtgggtctgggattacaaggtccgagggtctccgccccaa

SEQ ID NO: 5922 - DNA, 159 bp, Homo sapiens
gtggacgcctgtagtcccagctactcgggaggctgaggcaggagaatggcatgaacccaggaggtggagctttcagttgagccgaagccaagatcgaccactgcaactcaagcctgggcgacagagcgagactgcgtctaaaaaaaaaaaaaaaaaaaa

SEQ ID NO: 5923 - DNA, 200 bp, Homo sapiens
aagagcccaccgccgattcgtgaccaagaaggctctgtgcattcgggttttccaggagactcaaaagctgaagaagcgaagaagagccttaaaggctgcagcagcacccaaaaaacaagcaaagcggaggaacccagacagccctgccaaagccataccaagacactcaagacagccataattctgttcaatcatacaaa

SEQ ID NO: 5924 - DNA, 215 bp, Homo sapiens
ccagtgtgttgctgggtcccctcccagctgagctgtgactgctgagtactggaaggaggttgccagggtctctgctacctttgtctgcatccctcccttgctccctgctgggtggtcctcacccaggcctccaatgtggttggccctggggactcattacttctggtagctggctttctataaaaatgggtcaaacccaaaaaaaaaaaaaaaaa

SEQ ID NO: 5925 - DNA, 319 bp, Homo sapiens
ggcacgagcgccgccgcccgcccatcatggacaccagccgtgtgcagcctatcaagctggccagggtcaccaaggtcctgggcaggaccggttctcagggacagtgcacgcaggtcgccgttggaattcatggacgacacgagccgatccatcatccgcaatgtaaaaggccccgtgcgcgagggcgacgtgctcacccttttggagtcagagcgagagcccggagttgcgctgacttggcttctcgctgggtcttggatgtcgggttcgccacttggccgatggaatggtctttcacagctgctcctttttttgtccg

SEQ ID NO: 5926 - DNA, 255 bp, Homo sapiens
tccctcttcactccccctaaacccctgtcccatgcaggccctttgaagcctcagctacccactatccttcgtgaacatcccctcccatcattacccttccctgcactaaagccagcctgaccttccttcctgttcccgagctgtccccgtgttgcatgaaggagcagcattgactggtttacaggccctgctcctgcagcatggtccctgccttaggcctacctgatggagtaaagcctcacacaaaaaaaaaaa

SEQ ID NO: 5927 - DNA, 280 bp, Homo sapiens
agcccgtgggtgcctgggccttctacatgatgacagcagggtcagggcagggcacgggaatgaggggtgggcacagataactgaatgccccgagagcctttctttcctttagtctgccacagttggggtgggcgattaaaggaaagaaccctgaaaagtatataagctttgacaaccaggagatttggcttcaaatcctgcttctacaacttcttagctgtggcctttggcaattttatccaccccctgattgcccacttcctcaaccttaaattgcttt

SEQ ID NO: 5928 - DNA, 250 bp, Homo sapiens
gctggaggcaaagctggaaaggacagtgggaaggccaaggctaaggcagtatctcgctcacagagagctgggctacagtttcctgtggccgcatccacagacacttgaagactcgcaccacaagccatggaagggtgggtgccactgctgccgtgtacagtgctgcgattctggagtacctcactgcagaggtgctggagctggcaggtaattcttctaaggatctctaaggtaaagcgtattcaatccg

SEQ ID NO: 5929 - DNA, 240 bp, Homo sapiens
aggactccttcctccctggtgaagtgcccttgcagctccctagtgtccacgccatggatatttcctccacagaagtacaatgctgattatgatctgtcagctcggcaaggggcagacaccctggccttcatgtctctcctggaggagaagttgctcccggtgctggtacatactttttggatagacaccaagactacggggaggtacccgaagtgattcaagggttttccttttccctaa

SEQ ID NO: 5930 - DNA, 200 bp, Homo sapiens
gttaactccatgcatgttgtgaacagacccccggaactttctcatcttgtaattctgaagttctatacccaccgaacaactcctcttttccccttccccctgcctgccccagctcttggcaccattattctgctttctgttttcgaggagctgactacttaaggtacctcatacaaggggggtcttgggttacaattctt

SEQ ID NO: 5931 - DNA, 142 bp, Homo sapiens
cttccactgagggaagtttaaaacccaaacttccaaaggtttaaactacctcaaaacacttttccatgagtgtgattcacattgttagggtctgacctaggacagagatgaacttagggtcctgttttggtttggtcattat

SEQ ID NO: 5932 - DNA, 145 bp, Homo sapiens
gatgcttccatcccagcttctccggaatggaaacgtgaatcagaatcaactgctgcagaccaggaggtatgtgaggagggctggaacaagtaaccagggccactgttaaccgcaacttccggaaccggagaacctggttggaatg

SEQ ID NO: 5933 - DNA, 148 bp, Homo sapiens
gcagtgtggttcaagtttctttgaccgcactctatatgcattgctaatatgggagtttaagataccatacacagtctctcatggacctatctctattgtaggattatgacttatgtcttacttgggaaatttttctgaatgtgaccct

SEQ ID NO: 5934 - DNA, 140 bp, Homo sapiens
ctcaactatgggggagggccccaaagctcatattcgtaagctggctgagtgcatccgctggtcgtacggggccgggattgttctcaggctttgcaacatcgctcggtttggacttaattacttcgttcccattggatgta

SEQ ID NO: 5935 - DNA, 211 bp, Homo sapiens
tctgaagccctggaggctgcccgaatttgtgccaataagtacatggtaaaaagttgtggcaaagatggcttccatattccgggtgcggcttcaaccctttcacgttattcggatcaacaagatgtgtgtgtccgtgtctctgggctgtacaggctctcacaacagggcatgtcgcgggtgtctctttgagaagagcccaaggcactctgtg

SEQ ID NO: 5936 - DNA, 210 bp, Homo sapiens
gaaactatcaatgctggcagccagtttgaatataatgtagaaggagtgacttccaagggaatggctacccaacttgccttcatgcggcttcttggcaactattgctcttaggacatcaactaccactgcaaggacagcattgcatacatatgatgatgagactctgcaacctctaaaaagggctcgtcatatctacacaggctctctatg

SEQ ID NO: 5937 - DNA, 143 bp, Homo sapiens
gaggacttaaaagcagaaggaaaccgagatgcttcccgcagccgtggacgattcttcaggactctttttttaccttgagcacttgccttgtgaggcttcataggacagttgtttactgttccccccttcttaacttctctaat

SEQ ID NO: 5938 - DNA, 176 bp, Homo sapiens
ctcacttacacatatgaccacctgggagactcccccaaaattcttcaagacattgcttcgggaaggcatccatttagccaggtcctaaaggaagctaaaaaaccaatggttggtttaggcagttcttcacttcaaagagattatggagcagcaattcttgcagctcttttctagca

SEQ ID NO: 5939 - DNA, 222 bp, Homo sapiens
ccaacgtgcagcggctgaaggagtaccgctccaaactcatcctcttccccaggaagccctcggcccccaagaagggagacagttctgctgaaggactgaaactggccacccagctgaccggaccggtcatgcccgtccggaacgtctataagaaggagagaagctcgagtcatcactgaggaagagaagagtttcaaagccttcgctagtctccgtataggc

SEQ ID NO: 5940 - DNA, 150 bp, Homo sapiens
tgcctggttcacttggggctatcttggggactagatagtaaggccacctttacaaggcccagataaccattcccatctgggggttagggttttttggttaatggtttttcaatgtccaatggggagaagggagtaaaagatccctttttt

SEQ ID NO: 5941 - DNA, 410 bp, Homo sapiens
atttgatggcgtgatgtctcacagaaagttctccgctcccagacatgggtccctcggcttcctgcctcggaggcgcagagcaggcatcgtgggaggtgaggagcttcctagggatgacccatccaagccggtccacctcacagcctccctgggatacagggctggcatgtctcacatcgtgcgggaagtcgacaggccgggatccaaggtgaacacgaaggaggtggtggagcctgtcaccattgtagagacaccacccatggtggttgtgggcatagtgggctacgtggaaacccctcgaggcctccggaccttcaagcctgtctttgctgagcacatcagtgatgaatgcaagaggcgtttctataagaattggcataaatctaagaagaaggcctttaccaagtact

SEQ ID NO: 5942 - DNA, 405 bp, Homo sapiens
cgccgctccggctgcaccgcgctcgctccgagtttcaggctcgtgctaggctagcgccgtcgtcgtctcctttcagtcgccatcatgattatctaccgggacctcataagccacgatgagatgttttccgacatctacaggatccgggagatcgcggacgggttgtgcctggaggtggaggggaagatggtcagtaggacaaacggtaacattgatgactcgctcattggtggagatgcctccgctgaagggcccgagggcgaaggtaccgaaagcacagtaatcactggtgtcgatattgtcatgaaccatcacctgcaggaaacaagttacacaaaagaggcctacaggaggtacatcaaagattacatgaaatcaatcaaagggaaacttgagaacagagac

SEQ ID NO: 5943 - DNA, 112 bp, Homo sapiens
tctcaatcctaatttctcctccctttctttttcccttgcttcaggaaactccacatctgcctaaaaaccaaaggagggcttcctcttggaggccaaggggaaaggggggtgc

SEQ ID NO: 5944 - DNA, 135 bp, Homo sapiens
ctgactttggacaaggcccttcagccagaaagactgacaaagtcattccccgtcttcccagagcgtgcaattgtgatccctaaataaggtttaatttccggtttttccccctttggggttggaggggccaaggtt

SEQ ID NO: 5945 - DNA, 136 bp, Homo sapiens
agatgccaccgccgcaatcctcatattatatgagaagagccacgagcctccccaatgccaagataataacaattgcaaataggcggttccggtttccgaggccgccttttccacccttccttcctgggaaatggaa

SEQ ID NO: 5946 - DNA, 293 bp, Homo sapiens
tcacgcagcatggttaacgtactaaaaccgacggactttctgtaagaggtgtgacaggcaacaaccccgtaaagtgcacacagtacaggaggggacaggggttctactgttacgcaacagggaaggacggacgttgatgtacaggaaggacagagtggtttatggttgggacaaactaagaaccgtttttacggaaaaggggactaaaactaacaaggagggtttgttgactagggactttgttactttggaaccagactacgcgtctggggagtactgacttttaaggtgta

SEQ ID NO: 5947 - DNA, 295 bp, Homo sapiens
gccattggggcccaggggacaccggggatctgcgacacctcagcctgccaaggagccgtgttaggaggggtcggggagaaatcaggctctcgaagctcataaaattcaacgtgaggaagcaagttacaaggacgcccgaagcacagtggacggtcatgaaggagccgggggtgtcgcaggcgggtcacgtccaggagagggagcgcccttgctgcccctcggccgccgacttggacgcgcgggccttgccagcgagcaccctcatcgggctttcgctgacagcatacctcaaagg

SEQ ID NO: 5948 - DNA, 293 bp, Homo sapiens
tcttgacctcgtgatctgcccgcctcggcctcccaaagtgctgggattacaggcgtgtgccactgcgctcggcctcagattccatatttgaacaccagctgattgagagaaggggaatgagaagagctggatgagtttaaataactttcattgttcagattcctgaacaggagttgggataatggccatcttttctttcctatccttcccccctcactgtgaaaaataacagtccacccaagtcatacactggaccagtgcctgcggggacaggactctgggtttcttggtca

SEQ ID NO: 5949 - DNA, 298 bp, Homo sapiens
aagaagtgggcttttaaagagtattgaagattgaaagggtttttctttcttttttaaaaaagaaaaacaaactattgattgtagataatgaaaagctagggtttgccctcttcatgtctactctccttccaaatagttatatccaaaactgtttttccctctcccctaccttgtcccccctattaaaatagaaacagggattgattaatgtcccgctcctgaatacatgtaaaatttgtacaaaaatatcttctatgaaaatgatttgtagtctgtagacttgattacctgggagatg

SEQ ID NO: 5950 - DNA, 296 bp, Homo sapiens
ctcgtccaaatttcggccacgaaaaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgatataatgtagaggagttacttcc

SEQ ID NO: 5951 - DNA, 246 bp, Homo sapiens
aggacaccagaccccataatggaaaaaggaaactagagcatggcattataaaaatacacagcattacccctgcacagtttgcaaaattggacttattactccagagtatttcggttagacccaaatagaacatattgaaccgattttcaaggttgaaaatactgtacattcattcatctttgcaaatttgaccaccctgactgctgctgatggccaatgggctttccttttcctaggaacaggagg

SEQ ID NO: 5952 - DNA, 203 bp, Homo sapiens
ctcagtttgaacattgaccctgatgcaaaggtggaggaagagcccgaagaaagaacctgaagagacagcagaagacacaacagaagacacagagcaagacgaagatgaagaaattggatgtgggacagatgagaagaagaaacagcacaggaatttcagcttaaaagatgatttgtaattatctttaccctttgatctttatg

SEQ ID NO: 5953 - DNA, 117 bp, Homo sapiens
cacactcagattagccatatatgcctactgtccatggtcgttccccacttcaaggacacccaccaaaggattttcgttagtataatataccgattcctgacggatttttggaggtgg

SEQ ID NO: 5954 - DNA, 325 bp, Homo sapiens
aagactgttatcgagtaccggtcacagaagacctcacgcctccccatcattgacattgcacccatggacataggagggcccgagcaggaattcggtgtggacatagggccgctctgcttcttgtaaaaacctgacccagacacaacacaatccgttgcaaacccaaaggacccaggtactttccactctcagtcactctagggctctgcactgattggctgacctgacctgatgtcattcatccaccctctcaacagtgcggactctctccctctctttctagagacctgacctgggcagactgcaaaataaaatctcggtgtct

SEQ ID NO: 5955 - DNA, 321 bp, Homo sapiens
ctcgtcaatttcggcaggggggagtatgagttaagaaaaaacaacttctcagatactggaaactttggttttgggatccaggacacatcgatctgggtatcaaatatgacccaagcattggtatctacggcctcggacttctatgtggtgctgggagggcacggttcagcaatcgcagacaaggagcgcagacagctgcattgggccaaacaacagattcagcaaagaggaggccatgcgctggttccagcagaagtatgatgggatcatccttcctggcaaataaattccgtttctatccaacagagcaataaaaggttt

SEQ ID NO: 5956 - DNA, 142 bp, Homo sapiens
ctcgtccatttcggcggggcattatactatagttgctagttggcaatttcaggaaaggagatgttaaactctgcaagcaagggaggtagagcaaaagcaatgagtatgcatttaaaaggctgtatcgtaggagcagccaagc

SEQ ID NO: 5957 - DNA, 215 bp, Homo sapiens
aaagtatactgtgatttctctactggcgaaacctgtatccgggcccaacctgaaaacatcccagccaagaactggtataggagctccaaggacaagaaacacgtcttgctaggagaaactatcaatgcttgcagccagtttgaatataatgtagaaggagttacttccaaggaaattgctacccaacttgccttcattcggccttcttgccaact

SEQ ID NO: 5958 - DNA, 229 bp, Homo sapiens
gggcatttctgtggatccgaggaggcggaacaagtccacggagtccctgcaggccaacgtgcagcggcttaaggagtacccgttcaaacttattctcttccccaggaaggccttggcccccaagaagggagacaattcttctgaaggactgtaaacttggccaaccagactgtaaccggacccgttcaaatcccctcccggaagctctatataagaaggggagaagagt

SEQ ID NO: 5959 - DNA, 245 bp, Homo sapiens
  misc_feature 65: n = A,T,C or G
aagaagctctcctacatccgcattgctgataccaatatcaacagcatttctcaaggtcttctctnccttccttacggaattacatcttgatggccacaaaatcagcagaggttgtatgtcagactagagcctgtaaaggatctttaaatatattttggctaagatttgggattgagattttcaacagacatctctgtctgtttgcacaatgggctctctggcccacacacgcgctcatctgtagg

SEQ ID NO: 5960 - DNA, 260 bp, Homo sapiens
tctcactcatatgtgacagctgagaatcttgatctcacagaggtagaaagtagaatgatagttactagaggctgacaaaggtaggaaggagggatgatgaagaggaggcttgttagccgttgcaaaaatacagttagaaagaataagttctagtgttttgatggcatatgtagagtgaccatagttaacagtgaatttgttgtatatatcacaacagctagaagataagatttgtgaatatatcccaacccaaagagaat

SEQ ID NO: 5961 - DNA, 150 bp, Homo sapiens
ctgctgccctcaaggtcgtgcgtctgtaagtctacaagagagtgtgtctatctcgggcggcttgctcacggagtttcgcttggaagtacccagcagttacaaccacccttgaagagaagagaggaagagaaagccaagatccactaccgg

SEQ ID NO: 5962 - DNA, 140 bp, Homo sapiens
  misc_feature 140: n = A,T,C or G
acaagttgaaccttcacagcaaccctgtctggtgggcgccactccacccattttatagatgggaagacccaggcaaggagaagtaactcaacactagtcccttgagccagtaggtgtgtaaaattgagatgttgccccan

SEQ ID NO: 5963 - DNA, 323 bp, Homo sapiens
cggcacgagagaaattttgcctgccattttcagaatcatcttttgaagctttctgttgatgttaactgagctactagagatattcttatttcactaaatgtaaaatttggagtaaatatatatgtcaatatttagtaaagcttctctctttttaatttcccggagaaaataaaaagagtatgagtctctctgtaattcatatgagcagattagctcatttgagataaagtcacatgccacacactcagctctgtattaatccccatcaattactcggtaaagcctcatttgtaatgtgttgaatcaatacagggctatgtaaa

SEQ ID NO: 5964 - DNA, 271 bp, Homo sapiens
  misc_feature 261: n = A,T,C or G
catatcagaaaagaagggaaatggctttcaattcctttatattgtatcctatacttagtaatgttatttaactacctgattaccctattctaggctgtttgtactgatggcaagctcttcaaccacttagagactatttggcgatacagaccctggtgattcctgcctcatcctcgaacctgcactgtggacttttcgatttcctttgaaattcgttctctgctgcactcccagctggccaccatgtttttttatgaggtngtcaaacaga

SEQ ID NO: 5965 - DNA, 145 bp, Homo sapiens
aggtgcagtgggtacaggaagagatcccttgcagacttagctgggatgtcgttgctggcaattgtcttagcatttccaggctggtaacttgaacctcttattttgtaggcctgggtattcgtgaggcgggaggttaggaccaggg

SEQ ID NO: 5966 - DNA, 217 bp, Homo sapiens
cagacatcgaagccgttctgattggccgaggacaggatggggcaggacagggtagctgttttggcccagcccagaaattcctcctctccctaaccagaaggggaggaggaggaattggccaatagctcttgttgttccgaggttttccccagcctgtccctgtgggctcaatgccccttggcgttggggctttttgtcccttgcaaggggcttgggc

SEQ ID NO: 5967 - DNA, 145 bp, Homo sapiens
gggggtgtgtacccacgagagaacccccgcatcctgtttttcctgagcaaccagagaaaccatttgaaccttgcaacaatattagttcctcctcgccctctgtactaatatgaatgacaaccatggtttagaccacagtgttcct

SEQ ID NO: 5968 - DNA, 270 bp, Homo sapiens
gctgggagaaactggcaaggagaagctcccgcggtactacaagaacatcggtctgggctttcaagacacccaaggaggctatttgagggcacctacatttgacaagaaattgcccctttcacttggtaattgttgtccatttcgagggcggattcctctcttggcgttggtgacccacggattgaaggattgcagagggaccatttgttattccgccgagactattctgcactacatacgcaagtacacacgctttgagaggcgccacaa

SEQ ID NO: 5969 - DNA, 230 bp, Homo sapiens
caagctagaagaagaacacatggtgatagtcatcgtcagagacactgcctagcccaagcctgtctttcccagcgtaatgtttgtgtcacaaaggcagttattttaaaatctgatcccctcttttaccctaccactttggtttgaattatctcctggggttattttggttaatttgggtggggatcaaagtgctcttccaccaccaaaactaaggttcttaggatttttgg

SEQ ID NO: 5970 - DNA, 136 bp, Homo sapiens
gcacctctggtcccggctactgggaggctgaggtgggaggattgtttgagccaggaggtggaggctttagtgagtcatgatcatgccattgcattccagcgtggctgacagagtgaagcttaatacatacttaaaa

SEQ ID NO: 5971 - DNA, 145 bp, Homo sapiens
ctttcttaaatatttcatttatgacctgcaaattcaagaataaaggcactgaagtaagtttgaagccctaccagttgttttccagtcttttcagattggatgcctactgtggagattaactttggcatattccagtgtccagctt

SEQ ID NO: 5972 - DNA, 191 bp, Homo sapiens
tgacaagtaaagacttttataatacctaccttcaaaattagaatcagcagcactgtacaaataaagtgcctgtgcttcacctccacaccaaggaatcttgcctaaccctgtccagagtgcctaatatcctgtggtgattatgtataatgaaacagtcttattttgtgctctttggtttcttaaaagggaag

SEQ ID NO: 5973 - DNA, 110 bp, Homo sapiens
cggagagccttcaagcattccattacgccccatctcgctctgtgccccttcccaccagggctttagcaggagccctggacttattattaataaaacacctttttcagcaa

SEQ ID NO: 5974 - DNA, 178 bp, Homo sapiens
cttaatatttgcatgataagctagtttattgggttagtattcttgttggttacggaatggatcaactaattcctgggttatctaaccaccgagggctagaagcgcgcgcgaaagaggtcctgggtacacagagccatgagccacccattttataagacactctgtatttctaaaagtt

SEQ ID NO: 5975 - DNA, 255 bp, Homo sapiens
ctctctcttcgccgccgacgcagaaagaaactggggaggaaaaagctgctgccttttgcgctggagattcgtgggcaaggcttctcattttcccaggctgcttcccctcccgggtgaggagcgtcctgagactaaggaaagagcctggaaaatggagcagacctggacgagagattattttgcagagtatgatggggagatggtacccagaccgggtcacacagcagcttttctaagtcacactaaagatcgagg

SEQ ID NO: 5976 - DNA, 125 bp, Homo sapiens
caagatccaaatatatacaagaaactcacctcacctgtaaggacacacataaacttaaaagtgaaattcatagaggaggatacacatggaattggaacctgaaaaggagctggattggctatgct

SEQ ID NO: 5977 - DNA, 193 bp, Homo sapiens
gcaaactagagggtgggatgaagggtgctgtcccaggcttcttctgggcttatcttaccacatcttatgagaggagttgggaccatgtattattagtttccagttaactgtactgttaaggcaaatgtctgaagattctgtgcttcgttttgggagttggacttgaaatattagagtaggcattatcaaaggt

SEQ ID NO: 5978 - DNA, 320 bp, Homo sapiens
tgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtaaccatgagaagtatgacaccagcctcaggatcatcagcaatgcctcctccaccaccaacttcttagcaccctggccaaggtcatccatacactttggttt

SEQ ID NO: 5979 - DNA, 296 bp, Homo sapiens
ctggcaatttggagaacctagaatgtcagcgtttacatacgacgtagctttcctacaatacagcctctaacaaaactaggctgtccgaacccctggtaatagaattgtttacctttataccaggaaggttgggaaagcaccaaaatctgcatgtggtgtgtgcccaggcagacttcgaggggttcgtgctgtaagacctaaagttcttatgagattgtccaaacaaagaaacatgtcagcagggcctttggtggtccatgtgtctaatagttttcgtgacagatcaagcgtgcttt

SEQ ID NO: 5980 - DNA, 227 bp, Homo sapiens
gtcatacttcttccagctcgatagcatagcatctgaatgggttggacttccacctttgccttcagccaggtgtctcttcggtctgggagaggtggatgataaaatctatgtagttgcaggcaaagaccttcaaacagaggcttcgctggattcagtattatgctatgatcctgtggctgcaaaatggaacgaggtaaaaaaactccctatcaaagtctatggccata

SEQ ID NO: 5981 - DNA, 105 bp, Homo sapiens
tatttctcctctaatccaagacctagattaaagtcaggacactttgacatatcactctgaacatgagaggattgccaacacaaaaggcaccccaggaggaaagag

SEQ ID NO: 5982 - DNA, 135 bp, Homo sapiens
ttggctgccttgtgaaatgattccctgcagtaaacggacttttcattttattttagatcattacaaactttccatttcacattcttccattgatttaccagaacaaccactgggggatattgtaggacttaggtt

SEQ ID NO: 5983 - DNA, 230 bp, Homo sapiens
ttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaagggctcaacccagatttagggctcttcttaattgatcatgttcagaaaggggactcattttggtccactttgttacaatggga

SEQ ID NO: 5984 - DNA, 145 bp, Homo sapiens
ctactctgggggggaagggaggtggggggcaagcgtcctgctgagaacagtgcagggcagggttggcgcaggccactgcaggcaccgtcagtacagtgactctctcctcacaggggtttccaaggcaaggaccggcccttccagg

SEQ ID NO: 5985 - DNA, 210 bp, Homo sapiens
attggtaatagcaacttttaaaattgtcattagttctgcaatattagctgacatgtagtacagaaaaggattgtacatttagacatttggggttcagttgcttggtagtctggtaaatttaaacccagcttaatttgggtacagggtacacacatatgggccatttaatgtaaaggtccctctaggattcacatactttttggttaaaac

SEQ ID NO: 5986 - DNA, 201 bp, Homo sapiens
tagctctatggttcaccttggaaccactttatagagaattggagcgaatacaggctgatgaagtgattgcaattatggatcaagaacaagcaagggaagcatgaactgaatatcaaccctaaagatgagctttaaaaaaaagaaagaatgttctgtcaaatatttatttaaaatattatcttatggggcccttttttattt

SEQ ID NO: 5987 - DNA, 270 bp, Homo sapiens
cggcacgagactatgagaccagcaagatgaaagtcctcaagtttgcctgcaaggtacaaaagaaggatcccaaggaatgggcagctcagtaccgagaggcgatggaagcgggatttgaaggctgcagctgaggctgcagctgaagccaaggctagggccgagattagagctcgaatgggcattgggctcggctcggagaatgctgccgggccctgcaactaggacgaagctgatatcggaccctgggccaaagcccgataccaagcggga

SEQ ID NO: 5988 - DNA, 366 bp, Homo sapiens
ctttgacgaatccatggatccctttaaaccaactacgaccttaacaagcagtgacttttgttctcccactggtaatcacgttaatgaaatcttagaatcacccaagaaggcaaagtcgcgtttaataacgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggcatatagaaggagacgtgccacaagatggagaggacgggtcactgtgcttggct

SEQ ID NO: 5989 - DNA, 235 bp, Homo sapiens
tggaggtagccccggttatggaggaggaagaggaggatatggtggtggaggacctggatatggcaaccagggtggggcctacggaggtggtaatgacaactatggaggaggaaattatggaagtggaaattacaatgattttggaaattataaccagcaaccttgtgaactgacggtccatggaagagtgggaaactgtggggggtagcaggacacatggggggaccatgatggg

SEQ ID NO: 5990 - DNA, 429 bp, Homo sapiens
ccactgcagactgagcggtggaccgaattgggaccgctggcttataagcgatcatgtttctccagtattacctcaacgagcagggagatcgagtctatacgctgaagaaatttgacccgatgggacaacagacctgctcagcccatcctgctcggttctccccagatgacaaatactctcgacaccgaatcaccatcaggaaacgcttcaaggtgctcatgacccagcaaccgcgccctgttctctgagggtcctttaaacttgaatgtcttttctgccgtctgttacccctcgcagacttcgtaaccaaaacttttcggactttgagccctgatgcctttttgcagcatactttttggcatcaggcttttgggcgctgatcatgcttttgtatggaatattggtgcaattccattttgggacacattt

SEQ ID NO: 5991 - DNA, 420 bp, Homo sapiens
caattatcaagaaatatcgaccaaatgcctgtgaagaagcattaattaatggatctggagtcaagttcaaagagtttatccactacttgctggattcccaccgtccagtagggatggacattcactgggaaaaggtcagcaaactctgctatccgtgtttgatcaactatgattttgtaggggaatttgagcctttggaagaagatgccaattaacttttcacagatgatcggtgctccaaaggagtgaaatttcccaactttaaggatagacactctcctgttgaaagaccaatctcacgtcgtgagcagtatttaaaggatctgactagactgagaacaattaatctatgacttttgatacttggactattaatgtaaattacacacctcattttagaagttgcatacatctcaagcc

SEQ ID NO: 5992 - DNA, 388 bp, Homo sapiens
ctcgtgcgaatttcggcacgaggatggcattgaacaaagttttaaactattttattaagattatttttcacatctgtggtatatcattacaatttagcaaccaaagtttaaagagttgccataaagtattcctaagctgtatggcttttctttattagatcacagtttgatactttctcagtaaactctttgagtaaaagagttaccttactgaaacttttccatacttacacaggggtgggaggtcaaatgtttggtttggagtttaaattattgggcttttaaaatatcagatttgtattacaattcctcccagtaacctctcaatttctccttcccccaccgtggtttatctacagacagtctctcaacagggcgctaatctggg

SEQ ID NO: 5993 - DNA, 366 bp, Homo sapiens
ttttctaggatttctcattgtcagcaccgtacaactaaagttaaggaggcactgttaattaaaacttgcacagtttctgaattagaagcacaacttagacagttgacagaggagccaaatacactcaatatttcttttcaaaaggctactcataagttagaggcaaaggaaaattccaatttaagagcatgaaggctgatattgaaaggtccttgtgacaggacaaagcaggccttacagcagggcgggaggcaatcagcaacaggactgctttttaaaggagctttgattaccaacagcttgaagacagagtttctgacaccatcaatgcygtcacattgatgaaagagagcttaagaaaaacga

SEQ ID NO: 5994 - DNA, 431 bp, Homo sapiens
  misc_feature 411: n = A,T,C or G
tagtgcctttcagaagtagatgtcattatatgccaaaagtctagctctttgctttaccatacaggggcctgtcccaaagaaaaaggctctttttagccagcatatttccccttctacccttttactttgttgttctgattttaggacttttgcttgccatgttccttttgggtgccattccctcatttgccatttggattgcaaccttaattggtttgggggacaaagagcagcgagtttttgggtcagacctctctgctcttcacagtagttgttaaaaaagggcacggggcccttctcataggagagaagcgacaatgatggtggctccttgttgagggcgaaatacggcatgccctsctgtgagaggvtctaagttggtagtagtagtagagattgttgactggtagntagtactacatcacttactc

SEQ ID NO: 5995 - DNA, 478 bp, Homo sapiens
  misc_feature 464: n = A,T,C or G
acccacaggacttcagctggatctcgttgggaaaagctcaagattgggaaatggaactttggtaggcacatgtcagtatgaaacatttgcctcacagccccatacatgattaaccctttactttgggrggggaaaggtttaaacaagtctttacttgcagaattgagataaacctcatttcagtggtttaataaacctttcttaaaattggttaccaagattataggccttaaaaaattttaagaacaatttggtatttcagtctgagctctgccacttaagattctggggactttgggcaggctgcttattatccactaaccttccaatttttcttccagcttccttaaaagggcagttgttccattacccttattaattaatttggccaccttgtttttttgagggaagaaatgaggtaattgccttaaaggttttaaacataagtccctgcacagcgaggntactaataatgtga

SEQ ID NO: 5996 - DNA, 428 bp, Homo sapiens
taaaaatttggttggtgtttcatgacatgtgggacttcttttgaaatagcaagtcaaatgtagtgaccaaattgtggaaggagatttctgtcaaataggaaatgtgtaaggtcgtctaaaagctgatggggtaattgtaaggtgcctccaggcactccaggattggaccagccaggtttcttgggttgcttgggagtggtcctggtccctcttacatgccttggaggcctcatggtcttcagtccttggagggcccggccaacacccttttgggcacacctgcggttaatgttgcggttgtggcccagtcacaagggaattgtgttggtctagccaaggggggagctgactgtgattyaccacaaaatttctgtattcaacccacatgtctgcgcatcacagtttgatacttccttgtaatcagacag

SEQ ID NO: 5997 - DNA, 426 bp, Homo sapiens
ctcgtccaattcggcacgagtgaagtttcattacctgatccatgggggctttgttggttttggcatcacacagggggaggctcttgccccctccattctctggatttggaaggatgtccattggagcctgccagtgcctgggacaagggttaagatcgggaaccttttgaggagtgtcaatagttgtaacagttcaacctgttaggaaggccaattaatgggggggctcattaatccccttttgggcttttagtgcctttgcccttttatcacaaccttattgcgctcctactcatctgaaccaacaaaaaatgaattgagttgttgagtactaattggcaaagacttttaatcatggcccagaactttcattgacttgaaagtacttctcccacaggaaggaccaaaaacctgttttacttaaaa

SEQ ID NO: 5998 - DNA, 224 bp, Homo sapiens
agaattactctcaactcaccagaattaaattttatatctgcatattttacactattagctcatataatttataagataaattttcaaaggatctggttttaaattttttggaaatgaaatgaattggccttttctgcctctttcgcaaggactattttgttaactatattggcactaactatatccaaaacacacatctgaggcatcactgtgagtgacagccc

SEQ ID NO: 5999 - DNA, 252 bp, Homo sapiens
ctcgtgccgaattcggcacgaggcggaccttccgcaagttcacctaccgcggcgtggatctcgaccagctgctggacatgtcctacggcagctgatgcagctgtacagtgcgcgccaggcggccggctgaaccggggcctgcggcggaagcagcactccctgctgaagcgcctgcgcaaggccaagaaggaggcgccgcccatggagaagccggaagtggtgaagacgcacctgcgggacatgatcatccta

SEQ ID NO: 6000 - DNA, 254 bp, Homo sapiens
ggatcatcgatgttgtctacaatgcatctaataacgagctggttcgtaccaagaccctggtgaagaattgcatcgtgctcatcgacagcacaccgtaccgacagtggtacgagtcccactatgcgctgccccttggccgcaagaagggagccaagctgactcctgaggaagaagagattttaaacaaaaaacgatctaaaaaaattcagagagatatatgatgaaaggaaaaagaatgccaaaatcagcagtct

SEQ ID NO: 6001 - DNA, 145 bp, Homo sapiens
tggcgacaagggcagccaagcagggcttaggatatcccagcctaccaatatgctcattcgactaactaggagggtgcagttcggccctgtctcttcctccttcccctgggacctcagtttccttcagtgcaggcttggtaaggaa

SEQ ID NO: 6002 - DNA, 251 bp, Homo sapiens
aaattaaccactaaaacattgtttatagcaggagattaaagtgaatttaggtgttcctcagtagctgaatgattacataaattattgtatgtctagataatgaatgaaattctacatagaatgaggaagctctctctgtactaacatggaaagatttccaaggcatgtaattgattttaagaaaaggtacagaacagtgtatagcatactacaatatgaattttttttaataaaagagagagaaggaggga

SEQ ID NO: 6003 - DNA, 249 bp, Homo sapiens
ctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtccccccagaactgtcctggctccttccgtattaaacgcatttgcattttgagaagtgtccttccacttcagccctccggagagactacctagtctctctgggg

SEQ ID NO: 6004 - DNA, 253 bp, Homo sapiens
ggagatttgtgataacgtgaccatgtattggatcaatcccactctaatatcagtttctgagttacaagactttgaggaggagggagaagatcttcactttcctgccaacgaaaaaaaagggattgaccaaaatgaacagtgggtggtccctcaagtgaaagtagagaagacccgtcacgccagacaagcaagtgaggaagacttccaataaatgactatactgaaaatggaatagaatttgatcccatgctgg

SEQ ID NO: 6005 - DNA, 252 bp, Homo sapiens
taaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgccccagaaagctcagaaggctaaatgaatattatccctaatacctgccaccccactcttaa

SEQ ID NO: 6006 - DNA, 259 bp, Homo sapiens
ctgacatccaaacagcagagtctggagactgccatgtcgtttgtggccaggaacacatttaagcgtttgtaggaccggattcctaatggaggaaagttggctttttttttcagcaacacacccacaagagcatccccacagctcagagaggctttgctcaagctctcagatgcgggggatcacccccttgttccttacaaggcaggaagaccggcagctcatcaacggctttgcagatcaataacacagcagtgggggc

SEQ ID NO: 6007 - DNA, 253 bp, Homo sapiens
ctcgtgccgaattcggcacgagccaggttttgcagctctcccctgggccactaaccatcctggcccgggctgcctgtctgacctccggacctagtcgtggctctccatcttgtctcctccccgtgtccccaatgtcttaagtggggggcccctcttgggtcccctcctctgccatcacctgaagacccccacggcaaacactgaatgtcacctgtgcctgccgcctcggtccaccttgcggcccgtgtttgac

SEQ ID NO: 6008 - DNA, 145 bp, Homo sapiens
caaaggaggaagtaaggcgaattctggggctgctggatgcttacttgaagacgaggactttcttggttggcgaacgagttacattggctgacatcacagttgtcctgcaccctgttgttggctctataagcaggtgctagagcct

SEQ ID NO: 6009 - DNA, 114 bp, Homo sapiens
ccgccgcgccgccatcatggacaccagccgtgtgcagcctatcaagctggccagggtcaccaaggtcctgggcaggaccgggtttcagggccagtccacgcaggtgcgcgtgga

SEQ ID NO: 6010 - DNA, 177 bp, Homo sapiens
gccaaacgtcaccgtcccctgattgctctacccacccaagagcccgcccacgggggcgcccccccagagatggccagcaatcggaagtgagcacactgccgcagtctgcagcccggcgccaccatctgcagcctcctcctgaccacggacgtttccatcaggttccatcccgaaaat

SEQ ID NO: 6011 - DNA, 110 bp, Homo sapiens
ccagacatgggaggaggaggaagccaagcaatctcgctgagcgaagccattcgcagcttggcatcttcaacgaccctggccttccgcaaggccaaccatttaaccctctc

SEQ ID NO: 6012 - DNA, 110 bp, Homo sapiens
cggctggttatcgggagtttgagggctgaggtcgggagggttgtgtgtacagagctctaggactaacgaaccaggccagttcgcgggttttgggccaaggcctgggtaca

SEQ ID NO: 6013 - DNA, 273 bp, Homo sapiens
  misc_feature 266: n = A,T,C or G
ctatctcgcacctgaaacaagataacatgactaacacccttaattccatccaccctcctctccctaggaggcctgcccccgctaaccggctttttgcccaaatgggccattatcgaggggttcacaaaaaacaatagcctcatcgtccccaccatcatagccaccatcaccctccttaacctctacttctacctacgcctaatctactccacctcaatcacactacttcccatatctaacaacgtaaaaataaaatgacagtttgnacataca

SEQ ID NO: 6014 - DNA, 266 bp, Homo sapiens
atttttgtgatagggaaacacattctttgaaataaaaataaataacaaaaaaggttattgagccacgaataaataaatatgtatatattacttttttcttatttaaatatttttaaaagataatttttacataaaaattatgtaggttataacatgcagaagtacaaggcataacaacaatagctgggaggggaaaaattgaagtattcttctataagattcttctaggatgcattaggtataatatctactagaaggcagacagt

SEQ ID NO: 6015 - DNA, 132 bp, Homo sapiens
cgccacacccgtgaaacatgccttgtccatctggctcagcgtaatcgttttcggcaacaagatcaccagcttgtcggccgtttggcacagccctggtgaccgtttggggtcccgctctacaacaaagccagg

SEQ ID NO: 6016 - DNA, 143 bp, Homo sapiens
tcgtactgaaacaggcacaccttggaaaaccaaatattttattaaagagggagatggctgggtttatcataaaccactttggaaaataattccaacaacacaaccagcagggttgacaaatactatctaaaactcgaccaaat

SEQ ID NO: 6017 - DNA, 225 bp, Homo sapiens
cggaggcggaaggcttgggtgcgttcaagattcaacttcacccgtaacccaccgccatggccgaggaaggcatttctgctggaggtgtaatggacgttaatactgctttacaagagggttctgaagactgccctcatccacgatggcctagcacgtggaattcgcgaagtgcccaaagccttagacaagcgccaagcccatctttgtgttccttccaatccaact

SEQ ID NO: 6018 - DNA, 247 bp, Homo sapiens
ctgatgtcggctgcgagagctgtgcttaagtgactaataaaggtaccagaagaatatggctgcacaaataccagaatctgatcagataaaacagtttaaggaatttctggggacctacaataaacttacagagacctgctttttggactgtgttaaagacttcacaacaagaggagtaaaacctgaagagaacacctgttcagaacattcttacagaaatatttaaaaatgacacaaaggaatatcc

SEQ ID NO: 6019 - DNA, 282 bp, Homo sapiens
agacgctggtggtgcagttcacggtgaaacatgagcagaacatcgactttgggggcggctatttgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatacgttgcaaggatgatgagtttacacacctgtacacactgattgtgcggccagacaacacctatt

SEQ ID NO: 6020 - DNA, 110 bp, Homo sapiens
gccaccagtacataccattgggtctgttcattcctttggccagcttctcaaggtggctttagacctcaacaagccctatcttcaccaatgttctatcttgttcccctaaa

SEQ ID NO: 6021 - DNA, 105 bp, Homo sapiens
tgaagccactgagcatgatagtaaaagcaatggtggaaagggagcagagactagatgctaacccaggcaggaggtctattcaaaagctctttaaattagctagga

SEQ ID NO: 6022 - DNA, 290 bp, Homo sapiens
ctttctgttctgcagcatgcgctgttgtgccattagatggagtctcgcttctgatgggcagatgtcacagttctcggctctgtctccagtcacaccacccctccaattcaggctcagagagtccccagctggccacacctgctcatctcacccaggagagaggagtgtcgaaatggatacagcctcatgttttcaccagtcacatctcttactactgctagtcgctgcaacactcctctcagtttgagctttgtaccgaaagcctggtttgcaaagtagggtacctgact

SEQ ID NO: 6023 - DNA, 325 bp, Homo sapiens
ctgaggttatcaataagctcctagtccagacgccatgggtcatttcacagaggaggacaaggctactatcacaagcctgttgggcaaaggtgaatgttgaagatgctggaggagaaaccctgggaaggctcctcgttgtctacccatggacccagaggttctttgacagctttcgcaacctgtcctctgcctctgccatcatgggcaaccccaaagtcaaggcacatggcaagaaggtgctgacttccttgggagatgccataaagcacctggatgatctcaagggcacctttgccagctgagtgactgcactgtgacaggctgc

SEQ ID NO: 6024 - DNA, 316 bp, Homo sapiens
agagaagagttggttaaaaccttggtaccatagccaaatctgggacaagcgagtttttaaacaaaatgactgaagcacaggaagatggccagtcaacttctgaattgattggccagtttcgtgtcggtctctattccgccttccttgtagcagataaggttattgtcacttcacaacacacaacgatacccagcacatctgggagtctgactccaatgaattttctgtaattgctgacccagaggaacactctaggacggggacgacaattaccttgtcttaaaggaggagcatcttattaccttgaattggatac

SEQ ID NO: 6025 - DNA, 320 bp, Homo sapiens
atcggcatttctgtggatccgaggaggcggaacaagtccacggagtccctgcagaccaacgtgcagcggctgaaggagtaccgctccaaactcatcctcttccccaggaagccctcggcccccaagaagggagacagttctgctgaagaactgaaactggccacccagctgaccggaccggtcatagcccgtccgcagcgtctatatgaaggagagagctcgagtcatcactgaggaggagagaatttcaaagccttcgctagtctccgtatggcccgtccaacgcccgctcttcggcatacgggcaaaagagcaaggaa

SEQ ID NO: 6026 - DNA, 316 bp, Homo sapiens
tggaggccgaagatagtccctagcttgaagatgataaaacttttccaggctgtgtacttaaggggattcatttattcttaacgcttctataagtttgcctctaaatatattcaattctgtcttgatttctgaattttgaagtgctgtgtttgtttttcacacgatacatgtattcagcttttaataactgtgtttctggaggagcttgaaacaacagccatctgtatgcatgcctgcatgtgtcttttgcttgtaagataccttccttgcttcttcagagtgagctgggttttctatttaaaattaaatttggcat

SEQ ID NO: 6027 - DNA, 320 bp, Homo sapiens
ctcgcctttcggcgagggggaaacttgatgggaacctgcttctcctactccggttattgtggcctcccacacagccaacaaagaagaaaagagtttactcgaactagaagtagatttggataatttggaattagaagatattgacacaacagatatcaatctggatgaagatattttggatgattgactgtaatgctttccatttacctgactaaacagatcattattatatataggtattgagttgctaccctgaccacagttcttttggactatgagaaacttcttagatttttattatgtaaatgcctgtggaccac

SEQ ID NO: 6028 - DNA, 320 bp, Homo sapiens
ctgcagtcagaaattcacaagtcagcttctcgatcaaggtacctctcaatgttatgatgtattatcttctgatgtgcagaaaaacgccttagcagcctgtgtgaggctcggagtagtggagaagaagaagataaataataactgtatatttaatgtgaatgaacctgccacaaccaaattagaagaaatgcttggttgtaagacaccaataggaaaaccagccactgcaaaactttaataatcaacaaatagttatggaaaattcggtcacgtaattactctcatcgagggcttcattacaacaaacaggggtgtaaggc

SEQ ID NO: 6029 - DNA, 317 bp, Homo sapiens
attcattcaagggctaaatttatattttttggaaatcatggcaactacacaggatgttgcttaccaggacggagttttggtatcttagtactgaagttagcactatgtttacatgcaaaagattaaggcaaaaacccttaaagtggacaggtatccaaagttcattttctgtgactcatcagagtgacacaggacttgtaacaactttgcctggacttttttcattttacaacagttcatccattcacaatgatttggttctctgctccatattttgtgatcccttgagcatttgatgaacactctgtggtgctata

SEQ ID NO: 6030 - DNA, 335 bp, Homo sapiens
gccaaagaggccatggagcacccatacttctaccctgtggtgaaggagcagtcccagccttgtgcagacaatgctgtcctttccagctggtctcacgggcagcacgatgaagacttggaaagcgacgggtctcttgccggtcctcccacctttccataagcagaacaaggaaccacatcaaacgtcttaacgcgtatagagagatcacgttccgtgagcagacacaaaacggttgcaggttttggcgagcacgactagaccaagcgagggcagcccaccaccgtatatcaaacctcacttccctaatgtaaaggctcacttgcctttgctttcct

SEQ ID NO: 6031 - DNA, 366 bp, Homo sapiens
cacagactcagagagaacccaccatggtgctgtctcctgccgacaagaccaacgtcaaggccgcctggggtaaggtcggcgcgcacgtgggcgagtatgggtgccggagccctcggagaggatgttcctcttccttcccaccaccaagactaacttcccgcacttcgacctgagccacggctctgtccaaggttaagggccacggcaagaggtggccgacgcgctgcaccaacgccgtggccacgtggacgaatgcccaacgcgctgtccgccctgagcgacctscacgcgcacaagcttcgggtggaccggtcaactccagctcctaagccactccctcctgtggaccgtgccgcccaccttccc

SEQ ID NO: 6032 - DNA, 139 bp, Homo sapiens
aaaatgttctgtaaatatctattaggttcatttagtctataatgcagattaattctaatgtgtccctggtgatttttcttgtcttgataatgggcatggaaatctcccagctattttttcattgggatctatttctctg

SEQ ID NO: 6033 - DNA, 377 bp, Homo sapiens
gcaccaggttcaaggcatttgttgctatcggggactacaatggccacgtcggtctgggtgttaagtgctccaaggaggtggccaccgccatccgtgggggccatcattcctggccaagctctcccatcgtccccgtgcgcagaggctactggggggaccaaggatcggcaggccccaccactgtcccttgcaaggtgacaggccgctgcggtcctgtcctggtacgcctcatccctgcacccaggggcactggcatcgtctccgaacctctccctaagaagctgctcatgatggctggtatcgatgacttgctacacctcaagccggtctgcacttcccaccttggaaatcttgacaaggcacctttgatgcatttt

SEQ ID NO: 6034 - DNA, 276 bp, Homo sapiens
gtgaacataaagttatttgattctacagtattattgtcattgtctttattaattgaagcttaaggaagttatatgagtttttcaaagttggatatagctttccagtttcaaagttcaactctttctgttgttcatagtgttgtgattatataattcatggtctaaattgggatgcttgtgagattaataggaggctgtctaggtgggtacactagacaccgaggtgcgatataccagggcttttctagacacactggggatgtatgattaactccg

SEQ ID NO: 6035 - DNA, 418 bp, Homo sapiens
attgagaagaggaagaaaaaggaaagatgagagacaaagagacacggagagaccacaggcaaagaaagtcatattgggagacaaagacagagctgtgatggaggcatataaacaaagcaggagaatcataaaaagagaggaagagatgaaaataaaaggcaaaagtgtcagtgagtgtattagtccattctcatgctgctaataaagacatacccatgacttggtgatttttaaaggaaagaggtttaattgactcacagttcggtgtcgccagtgaggcctccagaaacttacaatcatggcagaaggggaaggcaaacagatccttcttcatgtgacagcagaagagaaagaacataagttcatgacaaggcagaagagacagaggaagccagacagcagaggcagatttagagag

SEQ ID NO: 6036 - DNA, 487 bp, Homo sapiens
cagattgagaaatatgattttaatgctttaatctcatgtagtttgtttttaatttcaagcaaaatcttactgtacttgaatgtgccctgttttgttagcacacctagacttgctgtaactgtactcatgtcccagtatgtacgttctttctatgaaagagaaaacactaatcttaaattatatccagcaatgtttctggtatcctttaagaaaagttaagactattatttccttcccttccctgtgcagcattcaaaatcacccctagaaaaagtgagtgttttaatgagacttcctaggagggatgcactgtaaacaaaagtattcttgtactcagttttgtgaaaggtaaaaactactatgttttaggtacactttagaaagtctcttcaaacaaacagtcctgtatttgactctgttcatagtttttttttgacagtttagcaaacttctggaattaaccaatttcctgcattaggtgagcaag

SEQ ID NO: 6037 - DNA, 453 bp, Homo sapiens
gcatcatttttgaagcagaacgtggcaagggcaaaaccggcgaaatcgcagtggatggcgtcttgcttgtttctatgcttattgtccagatagccttttatctgtggatgactgaatgttactatctttatatttgactttgtatgtcagttccctggtttttttgatattgcatcataggacctctggcattttagaattactagctgaaaaattgtaatgtaccaccagaaatattattgtagatgcctttcttgtataagatatgccaatatttgctttaaatatcatatcactgtatcttctcagtcatttctgaatctttcacattatattataaatatggagatgtcagtttatctccctcctcagtatatctgatttgtatagtaaggttgatgagcttctctctacaacattctggaaataggaaaaaagccagggaatgtttac

SEQ ID NO: 6038 - DNA, 319 bp, Homo sapiens
gttcaagaaccctttcaaaatgtaagaacatgcttatgaaaacaaagggaagtggaaaagccgcagctggccataagctctaagtcaaagctgtatttggggtctcagtaaagaggagataaacccagtaagtctggaacttactaactggctacacaattcagattaaagagaactcagaaatgatcattacagatttacaaacctaagagtataaaggatggcagtgcttaaatcagagtaatatttggggcaacagtctaagtggaaaatttggttcaaatcgtgttttgtttttagggggtcagtagatgccagg

SEQ ID NO: 6039 - DNA, 189 bp, Homo sapiens
cggcacgaggtcacttgtacctggtggtttctctgttagcagtccattagctcatgctgaattatttttgccttactttcttaagaaacattaattttatgtatagtgagtatattttcgcatgttttaaattgtaaatggagctaagtccaagaagtacttgaagctctcttccagcgatgcttaatt

SEQ ID NO: 6040 - DNA, 283 bp, Homo sapiens
gcaaaatcaaaaccatgatgagatatcatctgccagtcaggatggctacaaaaaagtaaaaaaataatagatgttggtgaggttatggagaaaaggacttatacacttgttaggagtgtaaattagttcaatcactgtggacagcagtgtggtgattctcagagagctaaaacagactaccatttgactcaccaatccattactggatatttacctaaaggatataaatcattccaccataaagcacatgcaggctatgttcattgcagcctattacagtaca

SEQ ID NO: 6041 - DNA, 350 bp, Homo sapiens
ggaagttctgcgcatggtggcaccatttcccgtgaacacccatgggaggtcatgcctgatctgtacttctacagagatcctgaagagattgaaaaagaagagcaggctgctgctgagaaggcagtgacccaggaggaatttcagggtgaatggactgctcccgctcccgagttcactgctactcagcctgaggttgcagactggtctgaaggtgtacaggtgcctctgtgcctattcagcaattcctactgagactggagcgctcagcctgccacggagactggtcgcagctccactgctcaggccactgaatgggtaggagcaaccactgactggtcttagctgtctgc

SEQ ID NO: 6042 - DNA, 169 bp, Homo sapiens
cacggctcacattgcatgcaagtttgctgagctgaaggaaaagattgatcgccgttctggtaaaaagctggaagatggccctaaattctggaagtctggtgatgctgccattgttgatatggttctggcaagcccatgtgtgttgagagctgctcagactgatccacct

SEQ ID NO: 6043 - DNA, 182 bp, Homo sapiens
aatttttgtaggtagaattttctacattccctctgaatgttagttgtcagttgtatttagctaatcccataattcccagaggaaggcagaagaaagaagacttctctgctcctcggctggtggaagggaggtctcgccatttttctgtctcctctctctttatagtcccagaattcctattc

SEQ ID NO: 6044 - DNA, 173 bp, Homo sapiens
cacctctgtattcagcatagctattcctgttgatggtgatgaagacagtgcatctgggggaggtgttgtagccattgccaccaaatagaccagcatggatctggtgaaaagccatttgatgtatcagtagagagagttggaggtttaaaggaccaattaaagtattagttgta

SEQ ID NO: 6045 - DNA, 149 bp, Homo sapiens
gaaattcatatcttaaagaaacagctttcaagtgcctttctgcagtttttcaggagcgcaagatagatttggataggataagctctagttcttacaaccgcactcctacaagatttaggaaaagtttacaacatatctaggtttcagaa

SEQ ID NO: 6046 - DNA, 228 bp, Homo sapiens
ttggtcattatgaccaggtgagcatgctactataccgcagaggatccaaccatgagctcttcccagcctaggggaagctggatttgccctcatgtaggagctggctaggactgttgactctctcagctgagtcagggacactcaggcactggacagttgggcatttgaggccgtgtgtaattctgctctcatgctgagtctccatttcttccctttctctgtcatcca

SEQ ID NO: 6047 - DNA, 310 bp, Homo sapiens
gtaaaacctgaacccagaaacaacacatccgttgcaaacccaaaggacccaagtactttccaatctcagtcactctaggactctgcactgaatggctgacctgacctgatgtccattcatcccaccctctcacagtttggacttttctccctctctttctaagagacctgaactgggcagactgcaaaataaaatctcggtgtctatttatttatggtcttcctgtagaccttcgggtcaaggcagagcaggaactactgtgtagtcaatgcccctgagtactccccagccagcagaggcctccttcagt

SEQ ID NO: 6048 - DNA, 134 bp, Homo sapiens
tagctttgaatcccaattacacattggtcagtgggaaaactaagggcctccaacaggcaaattcagggaggataggtttcagggattataaatttattttatattagtggccttcaaggataaactgatgtaat

SEQ ID NO: 6049 - DNA, 288 bp, Homo sapiens
agatggcggaggtgcaggtcctggtgcttgatggtcgaggccatctctgggccgcctgccgatccgttggctaaacaggtactgctgggccggaagtggtggtcgtacgctgtgaaggcatcaacatttctggcaatttctacagaacaagttgagtacctggctttcctccgcaagcggatgaacacacccttccggaggcccttaccacttccgggccccagccgcatcttctggcggacgtcgagtatgctgcccacaaacagcaggcagcgctctgacgttcag

SEQ ID NO: 6050 - DNA, 313 bp, Homo sapiens
gcctgttgggccaccggccttgccaggagagagaggccaccctggagctccggggccttcggggagccctggcttgccttggtgtgcctggctccatggagacatggtgaattatgatgaaatcaagaggttcatcagacaagagatcattaaaatgtttgatgagagaatggcttactacacctccaggatgcagttcccatggagatggcggcatccgggacgaccagggccttcaggaaggatggtgctccgggcaggccaggtctccaggtcacctgctcctgtcagattgcagcagacggcaggcttc

SEQ ID NO: 6051 - DNA, 227 bp, Homo sapiens
ggaatcctaagtcttctgtataagtagggtacaatatacaatgaaactaaaacagctcttgtcttttagcccctggaatcgtggcggatataataggaggggcaacatgcacagagaggtggtggcggtggaggagtggtggatcggctatccatacctcgtgccctgtttttcctggccgtggtagttactcaaacagagggaactacacagagtggaatgccaca

SEQ ID NO: 6052 - DNA, 250 bp, Homo sapiens
aaggaatttaatgcagaagtacatcggaagcacatcatgggccagaatgttgcagattacatgcgctacttaatggaggaggatgaggatgcttacagaaacagttctctcaatacataagacagcgtaactcagacatgatggaggagatgtataagaaagctcatgctgctatacgagagaatccagtctatgaaaagaagcccaagaaagaggttaaaagagaggtggacctcccaaatgtccttgt

SEQ ID NO: 6053 - DNA, 249 bp, Homo sapiens
cttggggggaggttgagaacacacccttgagagttgaagggtcggaaacgccctacgtggacaggacacccggcccagcttttaagatcctggagccaggccgcaggagcgttggggtctgaagatggccaacgaggcgctgcaagaaccgggccaagagcaggaagcctttcggagagtgacggagaatcttggccagcctcacccccaaaggcctgagcccagccatgtcgcagcctacagcgcttg

SEQ ID NO: 6054 - DNA, 144 bp, Homo sapiens
ggaaagcaaaataacaaaaaagagaacgccaacaaaatcagcagatgattgaagacaggggcctcgggggtgggctccggcaccgacatcctagagtcaggcactttcctcagtgactgtgtgtaggggggatttcagggctga

SEQ ID NO: 6055 - DNA, 336 bp, Homo sapiens
agaacactatgtggctgccgtgtaagagtggactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttg

SEQ ID NO: 6056 - DNA, 335 bp, Homo sapiens
gctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtgccttatgcccgctcagaggcccacctcacagagctgctggaggagatatgtgaccggatgaaggagtatggggacagattgatccttccacccatcgcaagaactacgtacgtgtagtgggccggaatggagaatcagtgaactg

SEQ ID NO: 6057 - DNA, 333 bp, Homo sapiens
atttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggcacagcagggagtcagccctaccttcttccttggcagctggagaaatctggtttcaatatactcatttaaaatt

SEQ ID NO: 6058 - DNA, 306 bp, Homo sapiens
agcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtagtcttgctgatttgcagaatgatgaagttgcatttagaaaattcaagctgattactgaagatgttcagggtaaaactgcctgactacttccat

SEQ ID NO: 6059 - DNA, 244 bp, Homo sapiens
gtcgcccaggttggtttagaacttagagctctgcccgcctcagcctctcaaagttctgggattacaggcatgaatcaccacacctggcctttagaaaaaatttaaaaattagccaagtgtggtggcaagtgcagtattccagctacttgggaggctgagttggagtactgcttgatcctgggaagttgaggctgcagttagccgtgattgttccacttaactccagcttggcgacagaggcctg

SEQ ID NO: 6060 - DNA, 227 bp, Homo sapiens
gtggcaatccggtcagcgtggaggttcagtccgtcaccgacgcgtgaaggtaaaagtgagccgtgttcctgacggtgttgctgaatacagcgtatgggagctgaagctgccgacgctgcgccacgactgtttccgcttgcgtgagtatccgtgagaacgacgacggcacgtattgccatcaccgtccgttcagcatgtgccggaaaaagaggccatcgttgatatcg

SEQ ID NO: 6061 - DNA, 178 bp, Homo sapiens
aattgttctccgacatctacaagatccgggagatcgcggacgggttgtgcctggaggtggaggggaagatggtcagtaggacagaaggtaacattgatgactcgctcattggtggaatgcctccgctgaaggccccgaggcgaaggtaccgaaagcacagtaatcactggtgtcgcta

SEQ ID NO: 6062 - DNA, 310 bp, Homo sapiens
cgtgccgccatcatggacaccagccgtgtgcagcctatcaagctggccagggtcaccaaggtcctgggcaggaccggtttctcagggacagtgcacgcaggtcgccgtggaattcatggacgacacgagccgatccatcatccgcaatgtaaaaggccccgtgcgcgagggcgacgtgctcacccttttggagtcagagcgagaagcccggagtttgcgctgaacttggctgctcgctgggtctgggatgtcgggttcgccacttgcccatgggaatggtctgtcacatctgctccttttttttgtccgc

SEQ ID NO: 6063 - DNA, 186 bp, Homo sapiens
acaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacct

SEQ ID NO: 6064 - DNA, 246 bp, Homo sapiens
tgaaaccctcctccacagctgcagcccatcctcccggctccctcctagtctgtcctgcgtcctctgtccccgggtttcagagacaacttcccaaagcacaaagcagtttttccccctaggggtggggaggaagcaaaagactctgtacctattttgtatgtgtataataatttgagatgtttttaattattttgactgctggaataaggcatgtgggagatgaccccaaacataaaagtaaaaaga

SEQ ID NO: 6065 - DNA, 190 bp, Homo sapiens
ggggacagaaatcaggtattggcagtttttccattttcattttgtgtgtgaatttttaatataaatgcggagacgtaaagcattaatgcaagttaaaatggtttcagttgacaaggttcagcggttcaactttataattattataaataaacccgttaaatttttctggacaatgccagcattgggattg

SEQ ID NO: 6066 - DNA, 245 bp, Homo sapiens
gcacgagggagcatattctcctgctttgtacatagggtgtggtcccctggcacgtggccaccatcatgtttaggcctatgctaggaggcaaatggccaggctctgcctgtgtttttctcaacactacttttctgatatgagggcagcacctgcctctgaatgggaaatcatgcaactactcagaatgtgtctcctcatactaatgctcatatgtttaatggtgatgcctcgcgtacaggatctcg

SEQ ID NO: 6067 - DNA, 112 bp, Homo sapiens
gtcttcagcagccaactcctgggagctgccaggtgaggggttaaagaagaggttggggaagcaagtgttggcctccttgggaaaggtcttgctgccttctggttcttaagcc

SEQ ID NO: 6068 - DNA, 108 bp, Homo sapiens
gttttgcaggcactgcctgctactggagggacaggatgctcccccagggaagagaccggaatagtgtggggtgtgttccagggtctgcatcccgaagatgggctggga

SEQ ID NO: 6069 - DNA, 230 bp, Homo sapiens
ccaccccagaggggcccttcaatgttgggagccagagggcatgtcccccattggacccagccgggccgttttccccctttgccagggcccccagagggcacaccgggaggcttagagggagacacccatttggaagtttccctctttcacagagacccccttctccccacacatctcggtctctctcccagggagccagcgccccctctccagagggccccctgtgccct

SEQ ID NO: 6070 - DNA, 105 bp, Homo sapiens
ctcgtgccgaattcggcacggggggatttttgagacttaaagcggttttgggacctcttattttattttggaatacttaattttttccattaagggattattggt

SEQ ID NO: 6071 - DNA, 178 bp, Homo sapiens
gtgcgtagtccgccgcgtcttgggtcagcggataaggctagcccgcttaggggacccccccggaggttggttcagcaattggtcaagacctgagaggtttttaaggaaccttaggaccccagaaggccctttcagacaagaaaggctttaggggggggtaaccctgggcaggaccctt

SEQ ID NO: 6072 - DNA, 201 bp, Homo sapiens
gggagggtgaagaaggcaagcagaggccagctggtgccactgagggagaattggagtcacagagcattcttgggtcacgctcttcctgctgcttcttcagaacgcggttttctggctcacttggcggtcccgaggaacggttagcttcttagagctttcggggatttgtgggagggggcttgggaagggctctccacacgg

SEQ ID NO: 6073 - DNA, 210 bp, Homo sapiens
aaatacaaaacttggaccacccaaatgtccacacgatagactggattagaaaatgtggcacatatacaccatggattactatgcagccataaaaaggatgagttcatgtcctttgtagggcacatggatgaggctggaaaccatgatttctgagcactctatcgcaggcacacaaacccacacaccgcatgtctctcactcataggtggg

SEQ ID NO: 6074 - DNA, 272 bp, Homo sapiens
ccacagctcacaaactcagccgcagcctcgaccccgctgctctgcccgcggctttcctggctgttggacatctgagccaggccagactcctgatctgcgtctcctagacccacacacctcttaggaatggccccgcagtactcctccattacactggcaggttcccacatgtgtgtggtcaaagacagttcgctacatatatagagtgtacacactaaaacactcttctttcacatctcactcgagatacgctactctcccaagacagacgc

SEQ ID NO: 6075 - DNA, 216 bp, Homo sapiens
cggcacgagttcatccagcacttggacctgattgaacatgcgagtacacacacgggaaagaaactctgcgagtctgaatgtgtgtcagagttccagtctaacaggccataggaaggtcctctttggagagaaggttcatcattttcatagagtgtggaaaaacccttccagagagggtcacacacctgtgaaaagacatacagaaatatcccatct

SEQ ID NO: 6076 - DNA, 270 bp, Homo sapiens
cagcagtcgcgcatccgcatcgacagcctctctgccccagctcagccagctccagaaggcagctggcagccagggaggcgaggtttcgggacctggaggactaactggcccttaagcggacaaccagccgcgcgcttcttggcgaaaaagaagcggagagatggccgagatgcggcacacgtatacagcagcatctggcgcgtgtaccacgagcttctgagacatcacgctgcgccctgacacatgagagacgccacgtctcaccccaat

SEQ ID NO: 6077 - DNA, 245 bp, Homo sapiens
cttcttccctctctctctttggacaatagttaaattagcagtattagttatgagtttggtttccagtgtcctaatcttgtgggctgttttccaaaaaccacatgctcctgatttaaccagggatcctaatacctacacaatgcaaaccctcttactcccaggcyttttctctgtgccacacgggggagcttgcgcacacactcagagcacagtgggcccctacagagagctctcttgtgttagag

SEQ ID NO: 6078 - DNA, 279 bp, Homo sapiens
ggcacctgtacctccggggtgggcgctcggggttggctccatgaccacgatctattgggggacgtaagagaaaccgccgtaatggcccagcccacttaaggccggggttccaggagttttggccccccgggttcctccaggccctgggagggcttgaaaattggtggaaaagaaccagagttgggcgcccaaaactcttacaccctcagggcacagagagatctaaacagtctccccccacagatcacatctcccaccacggcgttttagcacacacca

SEQ ID NO: 6079 - DNA, 258 bp, Homo sapiens
attacatgtattagattcgaaaggactgaaatcgtatgaatgtaatcaaatagaccggatttgattccatggattgaatagaaggtattcaattggattggattagcctggattggattggatccgtttggatttgtattgaatgtgtattggagggaattcgcatatggagtggattggattggatacacactgggcccgggtttatattgagggcccaatggtatcacagggagattagagccaagaggtagtgat

SEQ ID NO: 6080 - DNA, 143 bp, Homo sapiens
gtgaattatagaggaaatacagagagaacctctctcactcttacttttcgtccaaataaaattgataggtgtaccagcaagttgaaggatccggtttaagaatttggggcttactctcattacaaattaggccccccacacay

SEQ ID NO: 6081 - DNA, 206 bp, Homo sapiens
cgccatcgtggtgtgttcttgactccgctgctcgacatgtcttctcacaagactttcaggattaagcgattccctgggccaagaaacaaaagcaaaatcgtcccatttcccaattggattcggatgaaaactgggaataaaatcaaggacaacttcaaaaggagacaattgaggagagacccagtttgggtctataaagggatttc

SEQ ID NO: 6082 - DNA, 324 bp, Homo sapiens
  misc_feature 15, 305: n = A,T,C or G
caaaagactcacagnctccatgcggctggagaggcctcacaatcatggaagaaggctaaagacatgtcttacatggcagcagacaagacagaatgagagagaggcaaaagcagaaaccccttataaaatcatcagatctcatgagacttattcactgccacaagaacagtatgggggaagctgcccccatgattcaatatctcccaccaggtccctaccacaacatgtgagaattatgggagctacaattaaagatggaatttaggtgggaatacagagccagaccatatcattctgcccctggnccctcccaaatctcatgtc

SEQ ID NO: 6083 - DNA, 295 bp, Homo sapiens
  misc_feature 142: n = A,T,C or G
ggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccanaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaagga

SEQ ID NO: 6084 - DNA, 131 bp, Homo sapiens
  misc_feature 124: n = A,T,C or G
ctgaggaggagaatcacttgaacctggaggctgaggttgcagtgagtcgaggttgcgctactgcactccagcctggacaacagagggagactctgtctcaaaaaaaaaaaaacctacagctgtncaaggac

SEQ ID NO: 6085 - DNA, 351 bp, Homo sapiens
  misc_feature 339, 341: n = A,T,C or G
gtcagcatttcagaaaggaccatccaaaccttaacgcataatatgggcattgcaactggtaatatgctggtaaggaagatgtgtggagaaggagggccttcagggtcctggctaaataatgccctatatgaagctgcctacctcctactccttggtctattcctggtcacatgtactgattttccaaaacaaagaaattcccatcttacccaaattcttggagttgatgttgactgtggaattctaatgtgcttggctcttagggtatgactggtttccctggtgctgctggacggactggtcccccaggaccctctgtaagtaaatcactgtaaacgngncttcatttac

SEQ ID NO: 6086 - DNA, 302 bp, Homo sapiens
  misc_feature 4, 78, 89, 152: n = A,T,C or G
tgcnaatgcctctttgaagcaattcaggctaggtaaaccgattttgccatttcaaaacgtctttattttactttgttntatatcagagncttataaaacctgctgcaaatatttctgaatgtctttgtaaaagtgtttgttagtgtacctgngattatagtacttcacttttttcctttggattaattggttaaatgaatgagaaatgtgttatgttttttactaaaaagtataaattaaaattttggaaagaaaaggcaatattatctggctccccaattaaagtttgattttattgtcac

SEQ ID NO: 6087 - DNA, 328 bp, Homo sapiens
  misc_feature 22, 26, 27, 77, 123, 191, 271, 311: n = A,T,C or G
aagcccttctaccttcacggcnctgnngtttagatcccataaatccattcatatggataatgtgctttgagcagtgnccggcacacagtcgagcctatggaactttcagtagttacaatgggnacaaaaagatggataatacatattactttattgtcacttggaaataggtttgagttttctgcaactgnggcaacacagttcccggcaccaggtctacaggctgacttgcacaatggaagcgatttggggtttttcaaaagaacctggngtctagggtcagagtctgttgttggttggttgggagaggncaagaaaaggggagagg

SEQ ID NO: 6088 - DNA, 114 bp, Homo sapiens
  misc_feature 13, 21, 32, 68, 70: n = A,T,C or G
gagagaactagancttgaatnttaatttttgnttttactttttatgtacacagtataatgatgttagngntaaatattaaaaatctgactcttcactgggacttttttatagat

SEQ ID NO: 6089 - DNA, 347 bp, Homo sapiens
  misc_feature 33, 90, 139, 198, 278, 321: n = A,T,C or G
aggatcttgagctttagtgtgctatacctatgngtcttatcgtgggccactgtgccaataaacaaaaacaactgtttggtttacctcagntgcagtagttattttcatttagaagttgttctcagattattgtttcagntatatagaggattactagactagttatgaagaaaccccactacattcaatggaattggngcttaaaatctcatcgatgtgctgtctctggagtgataagaaagggctacatctcccgaaatgatttctttacgtcatgnattgggttccttcttcaccttgaacttttgttgaactgtatgnactttaccccaaacctgttaatattt

SEQ ID NO: 6090 - DNA, 349 bp, Homo sapiens
  misc_feature 18, 72, 105, 116, 174, 198, 255: n = A,T,C or G
ccgagcagtacatgctangacttcaccagtcaaagcgaactactatactcaattgatccaataacttgaccnacggaacaagttaccctagggataacagcgcantcctattctanagtccatatcaacaatagggtttacgacctcgatgttggatcaggacatcccgatggngcagccgctattaaaggttcgttngttcaacgattaaagtcctacgtgatctgagttcagaccggagtaatccaggtcggnttctatctacttcaaattcctccctgtacgaaaggacaagagaaataaggcctacttcacaaagcgccttcccccgtaaatgatatcatctcaa

SEQ ID NO: 6091 - DNA, 333 bp, Homo sapiens
  misc_feature 6, 42, 76, 79, 112, 287: n = A,T,C or G
tgcgcncctgcaggtcgacactagtggatccaaagaattcgnacgagaacggactgattcaccgcaagactgtggncgnggagccggcagccgacggcaaaggtgtcgtggnggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagncagaagcctgtgatggtgaagaggaagcggacccgccccaccaaga

SEQ ID NO: 6092 - DNA, 349 bp, Homo sapiens
  misc_feature 19: n = A,T,C or G
cttttttgagacatgaganatgcctcttccctgctgtatgacatgcatttgggaagttggaaagaaatgacaaaatcagggagaaaacatccaagcttcttacctgtagatagaatcagccctcacttggtgcttattaccagttattcaagaacaataacaacaacaaaattagtagacatccaagaagcacatattaggaccaaagatagcatcaactgtatttgaaggaactgtagtttgcgcattttatgacatttttataaagtactgtaattctttcattgaggggctatgtgatggagacagactaactcattttgttatttgcattaaaattatttttggg

SEQ ID NO: 6093 - DNA, 331 bp, Homo sapiens
  misc_feature 88, 91, 124, 162: n = A,T,C or G
taccactcccctgccccaggagccactcccactccagctgcctgtttccagcaggttcccagtgcccctgacaagcccctgctggtgnctncatctcctgccaagcatcctccagtgcctcctnctgtgggcctggcctcagggctatggacagactcctgncccatcccagagacccctcgtgatcgtgccctggcacgtgggccgtggcccggctgggtcggctgaagaactgcggatggaagctgcggaaagaggcccttgatggggcccaccatcccggacccaagtcttcttcctggcgggcctctcgtctccttcctggtttggg

SEQ ID NO: 6094 - DNA, 144 bp, Homo sapiens
  misc_feature 20, 33, 35, 56, 65, 68, 93, 98: n = A,T,C or G
gcccaatgaagatgaagtanatcaggactcggncnaaaaaaactcgagagtacttntagagcggncgngggcccatcgattttccacccgggnggggnaccagggtaagtgtacccaattcgccctatagtgagtcgtattaca

SEQ ID NO: 6095 - DNA, 400 bp, Homo sapiens
  misc_feature 9, 11, 52, 54, 55, 229: n = A,T,C or G
tggtttttngngcgcctgcaggtcccacactagtggatccaaagaaattcgntnngagctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgnggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcatttgtggatgcaaatc

SEQ ID NO: 6096 - DNA, 316 bp, Homo sapiens
  misc_feature 203, 301: n = A,T,C or G
aggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcggcctgggtgggtgagccatggggcanttgacctgggtcttgaaagagtcgggagtgacaagctcagagagcatgaactgatgctggcatgaaggattccaggaagatcatggagacctggctgntagctgtaacagaga

SEQ ID NO: 6097 - DNA, 343 bp, Homo sapiens
  misc_feature 85, 330: n = A,T,C or G
tatgaatcgtaagttaggatggacattagatgtgattatgatgataaagcgaaggtctgcggtcctatatctacagacacgtggngagaaattagaacaaactggagacgggccattgacacatggactctgcctgggcatgttaggttaattctttgactccaagccttaaaatactcacatggagtcagcgctcacctcattcacacaattatcatagagctccctggacactgaacctctaaagggaaaaggtctaccctggagccaggagcatcagggttggcttgggagcattgagaggtgagcccagggctaggcctgggccangccccggcagcac

SEQ ID NO: 6098 - DNA, 350 bp, Homo sapiens
  misc_feature 48, 83, 146, 172: n = A,T,C or G
ttaaagcttaccaaattgatggtgaatttatcagattaacctttttgnggtgcaggatggttctaagtatcaggtgacagggnattctactctttctagtcaattaaaattgataatgcagcatgattcataaactaaccagctgngcctccttttattttgaggaccctgnagtcactataataaatttctaagccaaatttttcaaacaagatagttcttatagaaggagaaataataaatatgtgtgtgttgatgcatgcacacagaatgacctgtgaaaggaaacttaaattttgccggtaaaacaaacatatctctacagactgtgattatacttcataagcatt

SEQ ID NO: 6099 - DNA, 328 bp, Homo sapiens
  misc_feature 30: n = A,T,C or G
gtgaaatcacttcatatatcatgtgctgtnaaataagaactagctgaagagacaaccaaagaagcattaaggcaggttgatgctgatgggaccataaaatatttttacactcaacctgagcggttattcttgacactcttaacagaattttttcaattgttttccagaactttagtatatgcaaatgtactgaaagggtagttcaagtctaaaatgccataacccctttattatttgttattttttatttgcattgctttgccataagtcttcccttgcttgtatcttccaaagctattttgaaataaacatgaaaatttacagtttg

SEQ ID NO: 6100 - DNA, 343 bp, Homo sapiens
  misc_feature 212, 319: n = A,T,C or G
ctgagacttgggatgaaatttaaaccagatacgatttactttgcagatcataaggctttttatactcttgttatcaaaatggcttatttttcaggcactaaggattgttaagagaaaagcttttcaacgaaggattgcctttcttctcccacactgttcttgatttcctctctctttcaggcctcaacaggcactgtattcattgccaatgntccaaattatcaaattcaagtgaatttatttgtgtgttctttacttatataaaaaaagataactttaaggatgtgcaagtacatttccaactgctagcacaaccagnattttgtaattaaacaaattgctg

SEQ ID NO: 6101 - DNA, 398 bp, Homo sapiens
  misc_feature 12, 15, 60, 61, 67, 99, 136, 174, 218, 251: n = A,T,C or G
gcgcctgcaggnccnacactagtggatccaaagaaattcggtacgagccactggactggnnccacanggaataggaccaggcccttatcaggccatggnactcatctcccaccacccgcagcccaacctctgttcnagcatgatgggcagaactcaggcctttttccgtgctgntcttattcctatatctgcttttgcttttggtggtctctttatgngaaatatctttcccgtccttctgaacacgtggnaaccctttgagcctagatgactccaaagactaggactctccatctgtgctgcagaacggggcggccttggcatgtctggtcttttgtggacttcccagggatctgggtggcttccaaggccctggatggcccaaattctcttccctt

SEQ ID NO: 6102 - DNA, 400 bp, Homo sapiens
  misc_feature 5, 23, 52, 142: n = A,T,C or G
tggtnttttgcgcgcctgcaggnccgacactagtggatccaaagattcggtncgaggacccctggagtccagccaccaccacctcagatgggagagattattagctgctgtggaggcacatacctacccagcatgcctcggncctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtgggaagaaagaactcagggcgttagaaaggattg

SEQ ID NO: 6103 - DNA, 142 bp, Homo sapiens
  misc_feature 117: n = A,T,C or G
gtaaaattgacagagaggggaaaccccgtaaagtggttggttgcagttgtgtagtagttaaggactatggcaaggagtctcaggccaaggatgtcattgaagagtatttcaaatgcnagaaatgaagaaataaatctttggc

SEQ ID NO: 6104 - DNA, 398 bp, Homo sapiens
  misc_feature 2, 18, 38, 308: n = A,T,C or G
tnacaattcactgcccantagtggatccaaagaattcntttcgagcatgggtctggagatatttctgattgtcacgactggggcaggagtgctagccagggatgctgctcaacatcttgtaatgcacagtataatcgtaacaataaagaattatttggtctaaaatgtcgataaagccactgttgagaaaccctgatctagagggttcaggggtttggagaaaggggacaaaagttgagtagatgagccaggacatgtttccctgattcctccagctatgctgggttcttggctggttcagcctcggngaccaactccagactgtctgaactttgggaggacgaggtgggtggatcacctgaggtcaggagttcaagatcagcctggccagcatggcg

SEQ ID NO: 6105 - DNA, 400 bp, Homo sapiens
  misc_feature 15, 17, 102, 175: n = A,T,C or G
tgcgcgcctgcaggncnacactagtggatccaaagaaattcggtacgagcccaaaaagaactggtggagcagcaagagcaaggagaagaaacacatactggnttggagaaaccatcaatggtggcttccatttcagctatggagatgacaatctggctcccaacactgccaacgnccagatgaccttcctacgcctgctgtccacggaaggctcccagaacatcacctaccactgcaagaacagcattgcctatctggacgaagcagctagcaacctcaagaaggccctgctcatccagggctccaatgacgtggagatccgggcagagggcaatagcaggttcacgtacactgccctgaaggatggctgcacgaaacataccggtaagtggggcaagac

SEQ ID NO: 6106 - DNA, 331 bp, Homo sapiens
  misc_feature 25, 154, 229, 274, 287: n = A,T,C or G
gtcatgcaggtcttccctggctganctcatggcccgcacctccctggacttggagctggatctccaggcgtcgagaacacggcagaggcagctgaatgaggagctctgcgccctccgtgagctgcggcagcggttggaggacgcccagctccgnggccagactgacctcccaccctgggtgcttcgggacgagcggctccgtggcctgctgcgggaggccgagcggcanacaagacagaccaaacttgactaccgtcatgagcaggcggctganaagatgctgaaanaaggcctccaaggagatctaccagcctgcgtgggcagagcccca

SEQ ID NO: 6107 - DNA, 400 bp, Homo sapiens
  misc_feature 3, 195, 218, 282, 397: n = A,T,C or G
tgngcgcctgcaggtcgacactagtggatccaaagaaattcggtacgagtgagcataagtcttttatttctttttaaggttaaatcgtaaactgtatacctttactactgaaaacaaaactatagggcatcatactaattgaaaatcaatagtaatgggttccatccattggctttttaaatgaatagatctggnattgatttccttcctgttttttngaggcacattcctttacaaccagtgtttaaaccaccacgtaatcatcttctgcaaacaaggggngccagtgttgcctaacagaagataatctttaataaagcaaatcctctgcttcaaaggtttttgaaataattggatccctttttgaaaaggaagatgagtttaactgtgtccaggngga

SEQ ID NO: 6108 - DNA, 400 bp, Homo sapiens
  misc_feature 3, 17, 41, 75, 117, 222, 233: n = A,T,C or G
tgngcgcctgcaggtcnacactagtggatccaaagaattcntttcgaggccatgagtatgctcaggcttcagaanaggctcgactctagtgtcctccgctgtggcaatgaagaaggnctggttagaccccaatgagaccaatgaaatcgccaatgccaactcccgtcagcagatccggaagctcatcaaagatgggctgatcatccgcaagcctgtgacggnccattcccggnctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgat

SEQ ID NO: 6109 - DNA, 400 bp, Homo sapiens
  misc_feature 3, 21, 61, 92, 118, 120, 167, 193, 227, 265, 374: n = A,T,C or G
tanggaaaaaccctgtttttngcgcgcctgcaggccgacactagtggatccaaagaaattntgcacgagaaatggctacccaacttgccttnatgcgcctgctggccaactatgcctntnagaacatcacctaccactgcaagaacagcattgcatacatggatgangagactggcaacctgaaaaaggctgncattctacagggctctaatgatgttgaacttgtngctgagggcaacagcaggttcacttacactgttcttgnagatggctgctctaaaaagacaaatgaatggggaaagacaatcattgaatacaaaacaaataagccatcacgcctgcccttccttgatattgcacctttggacatcggnggtgctgaccaggaattctttgtgga

SEQ ID NO: 6110 - DNA, 213 bp, Homo sapiens
  misc_feature 18, 78: n = A,T,C or G
tcaggagttgaagaccancctggccaacatggcgaaaccccatcttttctaaaaatacaaaaattagctgggcgtggnggcgggcgcctgtaatcccagctactcgggaggctgaggcaggagaatcgtttgaacccgggaggcagaggttgcagtgagccgagatcacaccactgcacttcagcctgagcgacaagaatgagagtctgtcta

SEQ ID NO: 6111 - DNA, 220 bp, Homo sapiens
  misc_feature 15, 21, 35, 43, 62, 63, 70, 97, 142, 155, 171, 215: n = A,T,C or G
aaggaaaaaacctgnatttgngcgcctgcaggtcnacactagnggatccaaagaattcggtnngaggtgnaaggcccgggaccgcgggatgggtgtnggcgtgaccaggcctgagctccctgtctctcctcagtgacatcgnctttaaaccctgngtggcaatccctgacncaccgccgtgatgccccagggaaaaaaggggccaacctgggaancccaa

SEQ ID NO: 6112 - DNA, 348 bp, Homo sapiens
  misc_feature 109, 268: n = A,T,C or G
ccgctgtctgttctccgacgcctacccgggacgcctccctgggatgcttctggcgcgcagtggtcctcgcggaggtgatccaggcgttctccgccccggagaatgcagngcgcatggacgaggctcgggataacgcctgcaacgacatgggtaagatgctgcaattcgtgctgcccgtggccacgcagatccagcaggaggttatcaaagcctatggcttcagctgcgacggggaaaggtgtccttaagtttgctcgcttggtcaagncctacgaagcccaggatcctgagatcgccagcctgtcaggcaagctgaaggcgctgtttctgccgcccatgaccctgcca

SEQ ID NO: 6113 - DNA, 351 bp, Homo sapiens
  misc_feature 17, 41, 44, 62, 119, 153, 154, 266: n = A,T,C or G
tgcgcgcctgcaggtcnacactagtggatccaaagaattcnttncgaggaactgagcatctncagcattctcagccacaaccaaaaaaaaataaaaagggcagccctccttaccactgnggaagtccctcagaggccttggggcatgacccanngaagatgcaggtttgaccaggaaagcagcgctagtggagggttggagaaggaggtaaaggatgagggttcatcatccctccctgcctaaggaagctaaaagcatggccctgntgcccctccctgcctccacccacagtggagagggctacaaaggaggacaagaccctctcaggctgtcccaagctcccaagagctt

SEQ ID NO: 6114 - DNA, 239 bp, Homo sapiens
  misc_feature 41: n = A,T,C or G
gcgcgcctgcaggcccgacactagtggatccaaagaatttngcacgagtggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgt

SEQ ID NO: 6115 - DNA, 383 bp, Homo sapiens
  misc_feature 3, 36, 41, 55, 65, 93, 329: n = A,T,C or G
tgngcgcctgcaggcccgacactagtggatccaaanaattntttacgagcagtgngctccctcangtgccacggccgcaccagtgagatgcangcacctggcagaccctctggctagcctgcagccccccctctcccatcccctggtgggctgcggtgatgggtgttttgggagaacgaagacagccaggctgatggccagggccgcagtgcccctccccccgacccagccccaaggttgatcccacgggaacaggcttccaccccagcacttgcgcacctgggagggagctgccatccgggctccattacctgttgctgaaggcgggngctaggctggctgggtgtcaaggagcaagctccaggccaaggtcctggcccagc

SEQ ID NO: 6116 - DNA, 400 bp, Homo sapiens
  misc_feature 3, 42, 220, 251, 333: n = A,T,C or G
tgngcgcctgcaggcccgacactagtggatccaaagaattcnttacgagcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagntcagaagaggtttggctttccagagggcagngtagagctttatgctgaaaaggtggccactagaggtctgtgtgccattgcccaggcagagtctctgcgttacaaactcctangagggcttgctgtgcggagggcctgctatggtgtgctgcggttcatcatggagagtggggccaaagg

SEQ ID NO: 6117 - DNA, 398 bp, Homo sapiens
  misc_feature 61: n = A,T,C or G
gcgcgcctgcaggcccgacactagtggatccaaagaattcttgcacgagcaatgatattgngtggtcttccctcctgtggaatcgaggggaaattattcttcccaataccttgatttgattttcagtttcataagcttcttcctctgaatcttattgagggactatggtaccaagcaggtaggactgttcacctggtggaacagttcttgctctgccttctaggcttcatcccagaaatccagcctctttctggagaccccaaagctggagggagatgggctttcctctgggcctctctcctactttgccatccacactgctcctggctaaccccagcaataaccaacaaatggtaggaagccccatctattgctttttctcaattatgactgcatag

SEQ ID NO: 6118 - DNA, 349 bp, Homo sapiens
  misc_feature 33, 131, 240, 278: n = A,T,C or G
actgcaagaaacagcattgcctacatggatgangagactggcaacctgaaaaaggctgtcattctacagggctctaatgatgttgaacttgttgctgagggcaacagcaggttcacttacactgttcttgnagatggctgctctaaaaagacaaatgaatggggaaagacaatcattgaatacaaaacaaataagccatcacgcctgcccttccttgatattgcacctttggacatcggnggtgctgaccaggaattctttgtggacattggcccagnctgtttcaaataaatgaactcaatctaaattaaaaaagaaagaaatttgaaaaaactttctctttgccatt

SEQ ID NO: 6119 - DNA, 400 bp, Homo sapiens
  misc_feature 3, 6, 41, 43, 67, 93: n = A,T,C or G
tgngcncctgcagggcgacactagtggatccaaagaattcntnacgagggtaaacgcaaggcttganttttctcggggccttatgatgctggntcttgagaagttagccactgatattccttgtctgctatatgatgacaatctcttctgtcatttggtggatgaagtactcttgtttgaaagggagctacacagtgttcatggctatcctggcacttttgctagttgtatgcatattctatcagaggaaacctgttttcagagatggttgacggtggagagaaaatttgctcttcaaaaaatggactcaatgctttcctcagaagctgcctgggtatcgcaatataaggatatcactgacgtggatgaaatgaaagttccagattgtgcagaaactttt

SEQ ID NO: 6120 - DNA, 398 bp, Homo sapiens
  misc_feature 13, 15, 39, 66, 119, 368: n = A,T,C or G
atccaaagaattntncacgagctcgtgccgtactttttnccctctcaaaatctgtattgataagtntctatctaaatttatatgtcaaataatcaaagattgttttacctacatgttgnaaataatattaaaaattgcctagatgatcaatttgaaatatttgtatattcatgttagcttatatgtggcaaaaataagagaactagtagagttttttatagactacatagtccaaagaaaagtaatgcaataaaacagtagtaacagtacaattgtactatgatgttacaaaaattgtaaaaataatgacagctctttacttcttgagcacttatgatatatattattgagaacttgtttggtagtgntctgatcactttctaagcatcagttcattt

SEQ ID NO: 6121 - DNA, 392 bp, Homo sapiens
  misc_feature 8, 58, 220, 241: n = A,T,C or G
ggaaaaancctggtttttgcgcgcctgcaggtcgacactagtggatccaaagaattcntacgaggacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggnctttagccatgcacaaacggnagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 6122 - DNA, 277 bp, Homo sapiens
  misc_feature 99, 136, 138: n = A,T,C or G
gctgagagcaagatgggtcaccagcagctgtactggagccacccgcgaaaattcggccagggttctcgctcttgtcgtgtctgttcaaaccggcacggnctgatccggaaatatggcctcaatatgtgccgccagngnttccgtcagtacgcgaaggatatcggtttcattaagttggactaaatgctcttccttcagaggattatccggggcatctactcaatgaaaaaccatgataattctttgtatataaaataaacatttgaaaaaacccttc

SEQ ID NO: 6123 - DNA, 190 bp, Homo sapiens
  misc_feature 4, 27, 137: n = A,T,C or G
aagntgtttaactagactgcgtgctgnttttcccgtataataaaaccaaagaatagtttggttcttcaaatcttaagagaatccacataaaagaagaaactattttttaaaaattcacttctatatatacaatgagnaaaatcacagattttttctttaaataaaaataagtcattttaatatctaataa

SEQ ID NO: 6124 - DNA, 329 bp, Homo sapiens
  misc_feature 25, 34, 260: n = A,T,C or G
ggagcagcacagtactcagaggagngaggagcgnggcgcctgctgggaggaaggcctggccatggtatgttcttggatttctggcagcagccctcattggtccacgtgcgtccccactacagactccttgacttgagccagcttgagtgggtctctactcttttctattgtgttttgccacttggctgcttcctggccaagtcgcacctgactgcatgaacacctgttcaaacgtgtgttctctgttctctaagatgggnagaaagtcgatgccttctagtctcagtgaatttaacctgtgattttatgtctacgtatattgttccttt

SEQ ID NO: 6125 - DNA, 328 bp, Homo sapiens
  misc_feature 49, 62, 76, 288: n = A,T,C or G
atggcagacaatgattgaagctcacgttgatgtcaagactaccgatggntacttgcttcgtntgttctgtgttggntttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgntagaaaagtaaaaatgctgaagaagcccaagtttgaattg

SEQ ID NO: 6126 - DNA, 320 bp, Homo sapiens
  misc_feature 2: n = A,T,C or G
tncggcacgagcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaagg

SEQ ID NO: 6127 - DNA, 350 bp, Homo sapiens
  misc_feature 6, 68: n = A,T,C or G
atttgnagtcatgtacagaacatgatccagggtgttacactgggcttccgttacaagatgaggtctgngtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagca

SEQ ID NO: 6128 - DNA, 330 bp, Homo sapiens
  misc_feature 110, 113: n = A,T,C or G
ggaaataggactggtgcggggagtataataggaattcatctttatctgttatcctttgtctttttattttgagacggagtctcattctgtcacccaggccggagtgcagnggngtaatctcggctcactgcaatctctgcctcctgggttcaagtgattctcctgcctcagcctcccgagtagctgggattacaggcgcacgccaccgtgcctggctaattttttgtgtttttagtagagacgaggtttcaccatgctggccaagctggtcttgaactcctgacttcatgatctgcctgccttggcctcccaaagtgctgggatcacagg

SEQ ID NO: 6129 - DNA, 284 bp, Homo sapiens
  misc_feature 61, 250: n = A,T,C or G
ttcggcacgaggatatatttgcacatcaacctcaaatagatgatttttgaagccacagcanctagataaaatcataccagggagagtgtgcagagtgaagaaataagcaggctgaggttggaatcctgggaacacccatcatttaagggatggagggtagaggaaactgaaggaaatgaagtgtgagcacagaagtaaaagccaagaagaagagtgttataaagaggaaatagccaaagatactacttgnggttcaattagtatttacccaaagaaaatacttc

SEQ ID NO: 6130 - DNA, 353 bp, Homo sapiens
tcgcactggtgatgctggtcctgttggtccccccggccctcctggacctcctggtccccctggtcctcccagcgctggtttcgacttcagcttcctgccccagccacctcaagagaaggctcacgatggtggccgctactaccgggctgatgatgccaatgtggttcgtgaccgtgacctcgaggtggacaccaccctcaagagcctgagccagcagatcgagaacatccggagcccagagggcagccgcaagaaccccgcccgcacctgccgtgacctcaagatgtgccactctgactggaagagtggagagtcttggattgaccccaaccaaggctgcaacctggatgcca

SEQ ID NO: 6131 - DNA, 348 bp, Homo sapiens
  misc_feature 78, 152, 180: n = A,T,C or G
gaggagtagggccgcctcggggctgggcatccggcccctggggccaccccttgtcagccgggtgggtaggaaccgtanactcgctcatctcgcctgggtttgtccgcatgttgtaatcgtgcaaataaacgctcactccgaattagcggtgnatttcttgaagtttaatattgagtttgngatactgaagtatttgctttaattctaaataaaaatttatattttacttttttattgctggtttaagatgattcagattatccttgtactttgaggagaagtttcttatttggagtcttttggaaacagtcttagtcttttaacttggaaagatgaggtattaatccc

SEQ ID NO: 6132 - DNA, 395 bp, Homo sapiens
  misc_feature 7, 35, 54, 55, 60, 65, 80, 158, 181, 221, 236, 273, 304,322, 342, 343, 368: n = A,T,C or G
gctatanccaagaaccaacctgctcttagctcttncttttctgtaaaaggctgnngaggntgggncctgatactgggttntggcttttgcatggagctcctgacattcccattcctgaggtctttgaaggatgcagcacacaccttccctgttctagntttccccttttggagctcagagncctaaggtgtggcttccagtcccccacaccacagcctgangaataagctgtcagnggtaccaagggggctggaatcctcttcaccacagatnttttaatttctcaaggatttactggcacttnttttcttttgcttctggnttgccaattgaagggcatgnncttccacctacatttttgcaactgnctactgttaagctgtggctctcacatt

SEQ ID NO: 6133 - DNA, 343 bp, Homo sapiens
  misc_feature 5, 35, 52, 107, 124, 154, 180, 190, 211, 216: n = A,T,C or G
tattntgattcaatgtttaagtttctaaaaaaggngatattaaagtatatgnattccttcagcattaccttaaaggctagaaaaacgggataaatcttcagaaaagngtcaaaagtgtcacagnacatgttcaaatttaaacttgaatcctggntcatctttgacttttgatgtgcattnttaatgcttntttatttttgatacacagaangcagntgaacttgatcttttaaaattgagacatgtaagctaatcagcaaaagacagaaacaaaactgcacatctgtaataatcagatagcaattctactgcacaattcattgattgtaaggtatcctgtaac

SEQ ID NO: 6134 - DNA, 331 bp, Homo sapiens
  misc_feature 7, 8, 30, 191: n = A,T,C or G
cctgcanngccacactagtggatccaaagnaattcggtacgagtgcatgcagaggcaacatgagtcctgccttaaaattccagcttttctgtatcaatcgtactgacataattcaactgtctttctttgcaagttcttgttcttttcgaaattatatcactgcagaataactttcttccactattcagtanaccttccatagtttcttatcttctctctcattattaaatttccacatttaagtgattagggatagaaatagccctactacagaagcatcattgatgaattctaagtacttgaggcaggatatctctactttttttttttt

SEQ ID NO: 6135 - DNA, 312 bp, Homo sapiens
  misc_feature 118: n = A,T,C or G
agcggctgaaggagtaccgctccaaactcatcctcttccccaggaagccctcggcccccaagaagggagacagttctgctgaagaactgaaactggccacccagctgaccggaccggncatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttgg

SEQ ID NO: 6136 - DNA, 324 bp, Homo sapiens
  misc_feature 20: n = A,T,C or G
aaataaccgaatagtagaanaaaaactgtttgtaggaagacgatgcagatggaatgatgtggacattgagtaaccatgtcaataaaatatataaaccaaacttaaatttgtgaaataaggaagttggtacctttgttgttacagtgtataaaaacaatttcggaactgctgttgcaaaaagacatatatagttttgcttccttctggtgttaagctgtttatatttcagtttcagttttaacttctaagttgccttgtaattgggactgtgtttcagcatcacaaaaaccaaatatttattatggatgcatctgtatcagcaat

SEQ ID NO: 6137 - DNA, 329 bp, Homo sapiens
  misc_feature 36, 126: n = A,T,C or G
aaaaagcttctaaaaagctatttcgccaggcacggnggctcatgcctataatcccagcactttgggaggccaaggtgggtggatcgcctgaggtcaggagttcgagaccagcctggccaacgcggngaaaccccatctctactaaaaatgcaagaattggccgggcgtggcggcacatgtctgtagtcccagctacatgggaggctgaggtgggagggttgcttgaacccaggaggcggaggcagaggctgcagtgacccaagattgtgccacttgcactccaccctgggcaacagagcaagaccccatctcaaaaataaataaatata

SEQ ID NO: 6138 - DNA, 213 bp, Homo sapiens
  misc_feature 19, 114: n = A,T,C or G
catgttagatactcactanttatgtgttttattaattttcaggatgtttgtctttctatcagtactgagttccctaatgataaactggtcatctatatgccaaatacagtttgncatgagtaatccatttagggtacaaataaataagtggctatatttgaaatgaaaatcactttctagaaggtttggtagtcccagttactggtttttttt

SEQ ID NO: 6139 - DNA, 333 bp, Homo sapiens
  misc_feature 6, 192: n = A,T,C or G
gctggnctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggnggcaggaacaactatcctcgtctgtcccaacactgagcaggcactcggtaaacacgaatgaatggatgagcgcacggatgaatggagcttacaagatctgtctttccaatggccgggggcatttggtccccaaattaaggc

SEQ ID NO: 6140 - DNA, 327 bp, Homo sapiens
aggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcacccatcctggagtacctcaccgcagaggtacttgaactggcaggaaatgcatcaaaagacttaaaggtaaagcgtatt

SEQ ID NO: 6141 - DNA, 400 bp, Homo sapiens
  misc_feature 5, 8, 37, 38, 49, 66, 333: n = A,T,C or G
ccctncantgcgacactagtggatccaaagaattctnnacgagcgtgcngccccagccgctgccgnctgcaccggacccggagccgccatgcccaagtgtcccaagtgcaacaaggaggtgtacttcgccgagagggtgacctctctgggcaaggactggcatcggccctgcctgaagtgcgagaaatgtgggaagacgctgacctctgggggccacgctgagcacgaaggcaaaccctactgcaaccacccctgctacgcagccatgtttgggcctaaaggctttgggcggggcggagccgagagccacacttttcaagtaaaccaggtggnggagaccccatccttggctgcttgcagggccacttgtccaggcaaatgccaggccttgtccccagat

SEQ ID NO: 6142 - DNA, 398 bp, Homo sapiens
  misc_feature 43, 103, 351, 353: n = A,T,C or G
tgcgcgcctgcaggtcgacactagtggatccaaagattcggtncgagcatacaagcaacattttgctgagatggctgccagtcttaagcgtccagactcaggngccactgggcttcctggaaggcctggccctcctggtccccccggccctcctggagagaatggtttcccaggccagatgggaattcgtggccttccgggcattaaggggccccctggtgctcttggtttgaggggacctaaaggtgacttgggagaaaagggggagcgtggccctccaggaagaggtcccaacggtttgcctggagctataggtctcccaggtgacccaggccctgccagctatggcananatggccgagacggtgagcgaggccccccaggggtggcaggaattc

SEQ ID NO: 6143 - DNA, 400 bp, Homo sapiens
  misc_feature 4, 25, 31, 71, 143, 252, 317, 382: n = A,T,C or G
cttntattgggaaaaaaccctggtnttttgngcgcctgcaggcccgacactagtggatccaaagaaattcnttacgagaatccacattcctcttgagttctgcagcttctgtgtaaatagggcagctgtcgtctatgccgtanaatcacatgatctgaggaccattcatggaagctgctaaatagcctagtctggggagtcttccataaagttttgcatggagcaaacaaacaggattaaactaggtttggntccttcagccctctaaaagcatagggcttagcctgcaggcttccttgggctttctctgtgtgtgnaagttttgtaaacactatagcatctgttaagatccagtgtccatggaaacattcccacatgccgngactctggactatatcag

SEQ ID NO: 6144 - DNA, 102 bp, Homo sapiens
  misc_feature 14: n = A,T,C or G
tgataacgtgaccntgtattggatcaatcccactctaatatcatgtttctgagttacaagactttgaggaggagggagaagatcttcactttcctgccaacg

SEQ ID NO: 6145 - DNA, 334 bp, Homo sapiens
  misc_feature 59, 282, 285, 321: n = A,T,C or G
cagactttgcttaccatcagcatctgcaatgggccaaacacacctcaaattggctgagntgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgnggntaatctgtttcacctggtttgtcctaaggccatagntaaaaagtaccag

SEQ ID NO: 6146 - DNA, 324 bp, Homo sapiens
  misc_feature 44, 283: n = A,T,C or G
gtacaatgattgaagctcacgttgatgtcaagactaccgatggntacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgntagaaaagtaaaaatgctgaagaagcccaagtttgaattgg

SEQ ID NO: 6147 - DNA, 329 bp, Homo sapiens
  misc_feature 4, 84, 172, 234, 247: n = A,T,C or G
gtcnacctggggacggctgcggctgcaggggagggcccggcggtgcgtttcacacttgctcctacttccgccttccagggctgnggggctgcctcccctctagggtccagcgcaggggctggggccctaccaaaggtaggaggggcttccgggataagatggcaggcgtggntctggccctcctgctcccctgtgtcctcacccctcgggggtccgtgggtgaggctgctgcanccgtgagtctcantgacacttcctaccaggtctttatctacaccactatttgctccaattataactaattggacacgtactgtatcttcatggca

SEQ ID NO: 6148 - DNA, 240 bp, Homo sapiens
  misc_feature 15, 37, 78: n = A,T,C or G
cacccactacctaanaaatcccaaacatataactganctcctcacacccaattggaccaatctatcaccctatagaanaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaagg

SEQ ID NO: 6149 - DNA, 290 bp, Homo sapiens
  misc_feature 24, 26, 150, 156, 285: n = A,T,C or G
cactagtggatccaaagaattcgntncgagcagtattttagtttttcacagcgaatttgattttagtctaccaaggagtttaacttttctatgttccctaactctaagattagggctgtattacctagacaggccttaaaaggtttttgngttgtnctctgttaataagaatttgttcctttaaaccagaggatcaaccttggaactattaacattttgggattgataattcattgttgttgggggctgtcctgtgtgcttaggatgttcagctgcagccctggnctcta

SEQ ID NO: 6150 - DNA, 332 bp, Homo sapiens
  misc_feature 12, 20, 102, 173, 175, 185, 312: n = A,T,C or G
caagaccccgcncacggggncgcccccccagagatggccagcaatcggaagtgagcaaaactgccgcaagtctgcagcccggcgccaccatcctgcagcctnctcctgaccacggacgtttccatcaggttccatcccgaaaatctctcggttccacgtccccctggggcttntnctgacccagnccccgtgccccgcctccccgaaacaggctactctcctcggccccctccatcgggctgaggaagcacagcagcatcttcaaacatgtacaaaatcgattggctttaaacacccttcacataccctccncccaaattatccccaattat

SEQ ID NO: 6151 - DNA, 347 bp, Homo sapiens
  misc_feature 6, 27, 207, 217, 310: n = A,T,C or G
ggccgncttgacccaggctacccttanccaatatcctctgcccctgggtggctggtggctgggcctcagggtgggcaacgttaggggtttggcgaaagcccgccccatgggattgagggacggggctgcactccaaccgtctgcacctgctcttcccccacccctgtgggacctcatcttcacgtgccatgtgtgctgaaggcccanggcccagcanggggcagtggcacctgttgacggaaaaggccgaggtgcttaccagtgaaccttctggcccgcccctcccctgtcacttgtcgggcatccaggnccccgacctgtgcctagccgccagggtgacaggaagg

SEQ ID NO: 6152 - DNA, 319 bp, Homo sapiens
  misc_feature 20, 196: n = A,T,C or G
gaagaactggtacatcagcnagaaccccaaggcacaagaggcatgtctggttcggcgagagcatgaccgatggattccagttcgagtatggcggccagggctccgaccctgccgatgtggccatccagctgaccttcctgcgcctgatgtccaccgaggcctcccagaacatcacctaccactgcaagaacagcgnggcctacatggaccagcagactggcaacctcaagaaggccctgctcctccagggctccaacgagatcgagatccgcgccgagggcaacagccgcttcacctacagcgtcactgtcgatggctg

SEQ ID NO: 6153 - DNA, 352 bp, Homo sapiens
  misc_feature 89, 132, 317: n = A,T,C or G
tagaagctctaagaaaagaaattctccctggagactcatacagggttaataaagccacaacttttctatactgctgagccacagctgcngaaaaagagagaaagaagaagaagaaaacaggtctgtccttgntagctttctgtcttgaagccttagatgtaacctggcctcttcctgagaaggaagggagcattactgcacttaccctagctcattgaagatggaggtactgtgctcacaaaatgaggctttattactctctccatttgatgtccaaatcccagagcaacaataaaattatgcttgtagatgtgcgngggtcattctgctgaccttctgacttcccagcaca

SEQ ID NO: 6154 - DNA, 291 bp, Homo sapiens
  misc_feature 56, 106, 192, 230: n = A,T,C or G
agattatcaaagctgaagctggctttgctgagaagctccctacctccctgcccttntcctccttcctgctggaatgaactaaagcagatgtcaagcaggggctggngggggtgcctactcccttttccactctatctttagatttcaaaccttaggcttacagcccctcaatatctctctgctaacaccagngtctctttctagttaggcctctaatcttctgtttctgnttaccagcttcccagcaactttccttttttaaaatattaaaaatttaattcaggttctctt

SEQ ID NO: 6155 - DNA, 286 bp, Homo sapiens
  misc_feature 246: n = A,T,C or G
caaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggntggctggattcagtaataaatatgtaaggcctttcttttt

SEQ ID NO: 6156 - DNA, 294 bp, Homo sapiens
  misc_feature 17, 45, 63: n = A,T,C or G
cgcgcgcctgcaggtcnacactagtggatccaaagaaattcggtncgaggagacgacgtgcanaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttgg

SEQ ID NO: 6157 - DNA, 323 bp, Homo sapiens
  misc_feature 3, 5, 32, 42, 111, 121, 182, 249, 254, 296, 313: n = A,T,C or G
cancnccttcagattcatgcacgggatgctgnggaggcttangagtcatgagactggaaaaaggagaatcgattgccaggagcttcagaccaacagagtatatggagtagntaggccctgncctccctagctcacactgactctaccaattccccaaccctatgtgaggtatcagggatagncttaggctacattgaatcagagatactctagactcaaggattgggcccaggagagaggatgaaactncacanagagaacaggggaaaccctcctggactattccctgacatagntcccagggaacctacanctagggactg

SEQ ID NO: 6158 - DNA, 355 bp, Homo sapiens
  misc_feature 15, 18, 43, 45, 46, 116: n = A,T,C or G
tgtgcgcctgcaggnccnacactagtggatccaaagaaattcntnncgagtagggatcctgaccacaatgactgtcctgctacatgaagtgccccacgaggtcggagactttgccntcttggtccagtctggctgcagcaaaaagcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatca

SEQ ID NO: 6159 - DNA, 297 bp, Homo sapiens
  misc_feature 2, 16, 130, 133, 199, 287: n = A,T,C or G
gntagatgatgcaggntcttcctagtctcgatggtctttacattttggcatgattttgcagcggctggtaccagttattcctttccatgtttagcgcttccttcaggagctcttttagggcaagcctggnggngacaaaatctctcagcatttgcttgtctgtaaagtattttatttctccttcacttatgaagcttantttggctggatatgaaattctgggttgaaaattcttttctttaagaatgttgaatattggcccccactctcttctggcttgtagagtntctgccaaga

SEQ ID NO: 6160 - DNA, 169 bp, Homo sapiens
  misc_feature 12: n = A,T,C or G
gccattgcactncagcctgggcaacaagagcaaaattctgtcaaaaaaagaagacagaaagaagagaaagagacagagagagaaagagggaaggaagggaggaagggagggagaaagggagggagggaggaaagaaaagaaaagaaagaaagagaagagaaaagaaaag

SEQ ID NO: 6161 - DNA, 293 bp, Homo sapiens
  misc_feature 42, 287, 291: n = A,T,C or G
ctcgtgccgccatgattttcctcccattcatcatgagggagnttctcaaaccaggagtttatatttattttttagaaaatacacacttttcaggagaaacctgagcatgattttggattctccacctccccccagtctctgcacctgggattcagctcaaggattcagggtcttcatttttacaaaagttcccccaagaaatcagcaaccagcctctgtttcatctgggagcccctcccttggccccctgggtttgggggtgctgccctactgggaacagcgggggnctgnca

SEQ ID NO: 6162 - DNA, 395 bp, Homo sapiens
  misc_feature 14, 113, 195, 210, 211, 254, 270, 291, 297, 334, 368: n = A,T,C or G
gaaacaaaaggganagccccacaaaactttggggacaagggagagagagactcatctgacacttcttttggaggtcaggatttgtatatcaggaattgaagttagaattaagngaattaaactgaatttgattgtgagtgaacctagaacagcactgaagtattacataacctggaagactgagaagggtatatnatttgaaggatcttnntatttccccgaggtctttcgcactggagacagcataaaagagngaacaaatgttgggangagagaagatgacatcaatgngggagntcagtataactggggataaactagaagaacctgtgantttacagtcatcttattacctgccagggctcatntagccatggcaatggttgccttgaatg

SEQ ID NO: 6163 - DNA, 124 bp, Homo sapiens
ggtgtgtgcctataatcccagctactcaggaggctgaggcaagagaatcgcttgaacccaggatggggaggtttcagtgagccgagatcgcaccactgtactccagcctgggcacagagcggga

SEQ ID NO: 6164 - DNA, 395 bp, Homo sapiens
  misc_feature 86, 174: n = A,T,C or G
gtcattctcttgggggagatggattaaacaaatgatgtattctcccatcggtcagtgcttttatgctaactagagactgggcaggntgagtagaaagtgtatgaatgccattgtatgatctgagctgaaatctggtgtgcacatacttcacactgaagcagcagaaagctctgngaaataggtctaattattcccattttatagataacaacactgagacatagctggtaagtggtaggaccaggacttgaactcatgactctgattccaaagttcatggttgcctggctgttccatgcactatgcttagagaaaaggcaaatttctcagtctttactcacataccctgatatctaccataagaaaaagaagcaaagaggcctgttacccagaat

SEQ ID NO: 6165 - DNA, 253 bp, Homo sapiens
  misc_feature 42, 58, 81, 84, 87: n = A,T,C or G
cagccgtgtgcagcactatccgctggccagggtcaccaaggncctgggcaggaccggntctcagggacagtgcacgcaggngcncgnggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatg

SEQ ID NO: 6166 - DNA, 273 bp, Homo sapiens
  misc_feature 5, 16, 62, 94, 130, 180, 204: n = A,T,C or G
acccngggaaaatggngaagaaaattgaaatcagccagcacgccaagtacacttgctctttntgtggcaaaaccaagatgaagagacgagctgnggggatctggcactgtggttcctgcatgaagacagnggctggcggtgcctggacgtacaataccacttccgctgtcacggtaaagnccgccatcagaagactgaaggagntgaaagaccagtagacgctcctctactctttgagacatcactggcctataataaatgggataatttatg

SEQ ID NO: 6167 - DNA, 112 bp, Homo sapiens
  misc_feature 8, 17, 45, 106: n = A,T,C or G
agtacttntagagcggncgcgggcccatcgattttccacccgggnggggtaccagggtaagtgtacccaattcgccctatagtgagtcgtattacaatttcactgnccgctg

SEQ ID NO: 6168 - DNA, 284 bp, Homo sapiens
  misc_feature 3: n = A,T,C or G
cgngcgcctgcaggtccgacactagtggatccaaagaaattcggtacgaggcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatg

SEQ ID NO: 6169 - DNA, 399 bp, Homo sapiens
  misc_feature 224, 377: n = A,T,C or G
gcgcgcctgcaggcccgacactagtggatccaaagaaattctgcacgaggccaggagccggcagacctgtcacccgcaggtggggtgagtctcggagctgccagaggggctcaccgaaatcggggttccatcacaagctatgtttaaaaagaaaattggtgtttggcaaacggaacagaacctttgatgagagcgttcacagggacactgtctgggggtgcagngcaagcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctncttccacacctgattagaacat

SEQ ID NO: 6170 - DNA, 142 bp, Homo sapiens
  misc_feature 44, 138: n = A,T,C or G
cccgcagtggcttttgccccagaaaggggaaaggaacacgcggntagatgatttctagcaggcaggaagtcctgtgcggtgtcaccatgagcacctccagctgtactagtgccattggaataataaatttgataaggnggtg

SEQ ID NO: 6171 - DNA, 394 bp, Homo sapiens
  misc_feature 2, 17, 43, 96, 102, 107, 174, 221, 249, 310, 375: n = A,T,C or G
gngcgcctgcaggtccncactagtggatccaaagaattcggtncgagatgactttgaaattatggatttatattaatggcactataaaccaatggnaatggnaattnttaaacttgctaaatattgagaaactaaactactaagttaataaattatatatagcagtgtagctgntctctctagatggtgtctcacaatggatttctgttgcttgactattntcttagtgaatatttatactaaggtagngactgagatttggtgatctggctgagtattttgaaacacattttgaataatatggcttagngttaacggggacttaaatatgatttttttttcttactcatttcaccttccctgtactgtatgttnggaattgatcataaaacat

SEQ ID NO: 6172 - DNA, 260 bp, Homo sapiens
  misc_feature 66, 95, 103, 232, 247: n = A,T,C or G
ccaaactacatcgcacccgaggtgctcctccgcaaagggtacactcaactctgtgactggtggagngttggagtgattctcttcgagatgctggnggggcagncgccctttttggcacctactcccacagaaacccagctgaaggtgatcaactgggagaacacgctccacattccagcccaggtgaagctgagccctgaggccaggggacctcatcaccaagctgtgctgntccgcaaaccaccgnctggggcggaatg

SEQ ID NO: 6173 - DNA, 325 bp, Homo sapiens
  misc_feature 37, 216, 222, 230, 324: n = A,T,C or G
ctgatttgtaattctgtttgtacaagtttagagcagnctagctcgagtcctcaaccccagtcctcttagaagtgaactgattgcactggatccctaaacccacaatgttgaggacacatgtgatgactccacttgctcagccagctggcctcttgcactttcccctgcccaccacttgtaactaccacttaattatcttgtgttaattgcttttgntgtgtngggtctgnatttttgtggtcagtgcctgcaggcagaaatgtgaaagcatttggtatgttgaagatacttgcttcttttttaataaaattaaaagtgcagcana

SEQ ID NO: 6174 - DNA, 134 bp, Homo sapiens
  misc_feature 6, 7, 28, 40, 51, 54, 66, 74: n = A,T,C or G
gcacannctgagagcaatcatgacacancattaacactancttgtgcaggnggncatgaagaactngtatctgngctcattgcacgggatgccaaaattgaacacagagacaaaaaaggtttcacaccactaat

SEQ ID NO: 6175 - DNA, 324 bp, Homo sapiens
  misc_feature 50, 176, 240, 299: n = A,T,C or G
ggacacttaggttgtgttcattacttggttattgagaataatgctgcagngaacatggaagtacagatatttcttcaagacagtgattaaattttctttggatatacaccctgaaatcggattgcttgataatatggtcattctgtttttaatttttttagtatcatccataatgnattacataaccctttgctggtattttatacaggcaacacaatatgccttttgaaaacactgagntgaggatatttgcatctatgtttatcagaattggcctgtaattttcttttcttgtaagngtgtttatctggctttgggataagg

SEQ ID NO: 6176 - DNA, 319 bp, Homo sapiens
  misc_feature 303: n = A,T,C or G
tcaataacgctaataatagctaacaataatctgcaatgcctggaatacacatattttagattcttaaaagacatctttaactttttaccaagaatttctatttgactttaagtaagtaagctgttttatctatcctaatgtcgcatagctaaagagtggtagaactgatattgaacatgcatttctctcattcaagtgtctttaaattttccagcaagccaagttcctgtcatgctggtctctttcttcttctgcatatagtctatgcccaccctgatttctatactttcaactcagattggnctttgattttgaattg

SEQ ID NO: 6177 - DNA, 279 bp, Homo sapiens
  misc_feature 3, 43, 78, 184: n = A,T,C or G
tgngcgcctgcaggtcgacactagtggatccaaagaattcttnacgaggcgcttcgggagccgcggcttatggtgcanacatggccaagtccaagaaccacaccacacacaaccagtcccgaaaatggcacagaaatggtatcaagaaaccccgatcacaaagatacgaatctcttaagggggnggaccccaagttcctgaggaacatgcgctttgccaagaagcacaacaaaaagggcctaaagaagatgcaggccaacaatgccaaggccatgagtg

SEQ ID NO: 6178 - DNA, 400 bp, Homo sapiens
  misc_feature 12, 14, 39, 42, 52, 65, 66: n = A,T,C or G
gcgcctgcaggncnacactagtggatccaaagaaattcnttncgaggtgggngtgggcaatgccnnggaggatgagctgagggaaatagcctcagagcctgtggcagagcactacttctacacggctgacttcaagaccatcaaccagataggcaagaagttgcagaagaagatctgtgtggaggaagacccgtgtgcctgcgagtccctggtgaaattccaagccaaagtggaggggctgctgcaggccctgaccaggaaactggaagctgtgagtaagcggctggccatcctggagaacacagttgtctaaggctgcctgtcaccactgtggcctctccaagcgtcctgcacgtgtccgccgtagctttaccattttagtgagggaagccagcccggg

SEQ ID NO: 6179 - DNA, 163 bp, Homo sapiens
  misc_feature 43, 45, 59: n = A,T,C or G
tgcgcgcctgcaggtcgacactagtggatccaaagaaattcgntncgaggctacggaancaggccgagaagaacgtggagaagaaaattgacaaatacacagaggtcctcaagacccacggactcctggtctgagcccaataaagactgttaattcctcataa

SEQ ID NO: 6180 - DNA, 359 bp, Homo sapiens
  misc_feature 6, 10, 12, 61, 92, 145, 153, 164, 183, 207, 232, 237, 289: n = A,T,C or G
ctgacnttgncntctcatttcaacgtgtcaggcacagaggaagcatcgcatagacatgggnctcctccatcacatgccttgtggaatatagngagacctctctgctcatagatttcctggtctttctgctgcccccaagccttanggatatgncaagttagccntcatttgaattaacctcancactttctcttgcatcaggtattngaactgcattctttcagatctcatngattntgaaatcaattccgttgatgcagaattgctctgtgtaattatttatacaaanctcttgatgtgattggtggagccttacttcagagcacagcagcatgatgctacgcagagctctaaatatg

SEQ ID NO: 6181 - DNA, 125 bp, Homo sapiens
  misc_feature 15, 61, 66, 67, 91, 100, 104: n = A,T,C or G
ccgacaagctggagncattgactaaccacatccacaaagcacaccattaatccactatgancaagnnggggggaatctggagaagggttcngaatatctncctnttcatccctcccgaaatctgg

SEQ ID NO: 6182 - DNA, 338 bp, Homo sapiens
  misc_feature 16, 87, 91, 101, 129, 131, 171, 258, 328: n = A,T,C or G
gcgcgcctgcaggtcnacactagtggatccaaagaaattcggtacgagcgagtttttttttttgctggatattatcttgtaaaacgngaanactacctgtntgctgtgagggaccgggaaatgtttggntntatgaaattacatccagaggattttcctgaagaagataanaaaacatatggggaaatttttgaaaaattccatccaatacgttgaagtcttcaaaatgcttgctccagtttcactgatacctgctgnttctgaatttgatggaacatgtttcttatgacagttgaagcttatgctaatctgtatgttgacaccttgnaattaaaata

SEQ ID NO: 6183 - DNA, 338 bp, Homo sapiens
  misc_feature 75, 76, 78, 86, 101, 297, 304, 309: n = A,T,C or G
aaaaaagttaaaaaaattaacattaaaatatatataaattgagacgggttcttttttcttttcttgagatggagnntngctcttgntgcccaggctggagngcaatggagcaatcttggctcaccgcaacctcccgctcccaggttcaagggattctcctgcctcagctactcgggaggctggggcatgaggatcgcttgaacctgggaggcagaggttgcagcgagccgagattgcaccactgctctccagcctaggcgacagggcaagaccctgtcttaaaaaaaaaaagaaggnggagggnactgntaaaaagttaaaaatttagagctttaaac

SEQ ID NO: 6184 - DNA, 330 bp, Homo sapiens
  misc_feature 228: n = A,T,C or G
acgtaaaacttgatgtttatcaggattacttatgtttcaattttcctgtggttagaaaaattaagacagaagtaagctattaacggtatttgcttgtaagagtaacgttaaaggtttaaggaaaggtttgttgaaatcgatatgcatcacacgaatcatttattttcaatgttgttttccagttgcagcaatcatttgtgtttacatgactttgaaaaagggtttagnttatgttgattttgaccctcttatttaatctctagtgcagaagtgcagctttctgcaggctgcgcctcaatcgctaagttccactctccatcctctgccgcg

SEQ ID NO: 6185 - DNA, 285 bp, Homo sapiens
  misc_feature 20, 21, 106, 134, 140, 171, 218, 223, 248, 257: n = A,T,C or G
ggaagtacaggctacaccannccaccaccattggccacgtgctacagacctggcatcccttcctccccaagttctccatccaggatgccgatcgccagacagtctngcgagtggtggggccctgctggacctgnggctgnggcacagacaccaactttgaggtgaagactngggatgaatcccgcagtgtgggccgcatcagcaagcagtgggggggnctggnccgagaagccctcacagatgcagangactttggnctacagttcccgctggacctggatgtga

SEQ ID NO: 6186 - DNA, 279 bp, Homo sapiens
  misc_feature 6, 47, 50, 127, 145: n = A,T,C or G
ctgcancggctggcagacggggccctcgacctctatgccatggtggnggntctctcgagggcctcaagatccctgagtgagggccaccccacggcccagcatgagaaaatgctctgtgacacctggngtatcgaggctgcagctnggatccgagagggcatggccgccctgcagtctgacccctggcagcaagagctctaccgcaacttcaaaagcatctccaaggccttggtggagcggggtggtgtggtcaccagcaacccacttggcttctgaata

SEQ ID NO: 6187 - DNA, 400 bp, Homo sapiens
  misc_feature 10, 14, 38, 41, 70, 224, 260, 320, 392: n = A,T,C or G
gcgcctgcangtcnacactagtggatccaaagaattcnttncgagagcagacccacatacccggagcggnggaccagcgaggcactagtagaggcagtcccgtggagcccgcctctccagtcccagccagaggggaccctggcctttggtgaccactgagaaggacacttcacgggcccagagctcctggtactgcccttcctttgagggccgaggagggctgnggacagcccagcaacctgtcgctcttggaggctggngtggccttgaggagggaagcctcgcatggccgctggaagagaggcgcctcctggcctggntctgcagaacccaggggcacgctctgggcctgggcctgaggaagtcccgctctccccgcggctctgagttgnactgagga

SEQ ID NO: 6188 - DNA, 400 bp, Homo sapiens
  misc_feature 9, 14, 123, 126, 128, 167, 223, 225, 302, 330: n = A,T,C or G
cagaaaaangaccnttattttttcattttcagcaaacatcatacttaaaggggtaatgcaagcatttattttaagctagaggaactgagtattactactgctactattcaaaattgaactggnagntntaattagaacagtaaaagagggaaaagacatgaaaagtnaatgtactgactgatactacctgacttcaaggcttactgaaaagctaccagacagngnggtataagccaaagaataaataaatagatcagtggaacagaataaggagtccagaaataaacccacacagacatagncaattcttttgaaaaaggtgcaaaggcnatccaaaggagaaaagataatattttcaacaaaaggtgctggcacaacaggacatccagaagcaaaaaag

SEQ ID NO: 6189 - DNA, 396 bp, Homo sapiens
  misc_feature 6, 19, 49, 75, 215: n = A,T,C or G
cactgncacctttgatccngggctcaagcgatcctcccaccttggcctnccaaagtgttggattttcaggtgtgngccaccaagcccggcctcagacttacttctgataatgtaactctgactatactaattcgatttaattactctatgattttaggttttagttttctaaaaactcctttccagcaaattttttactcctcacttgtgttcgntgtgtctatcattaaggtattattgctttactcctaacatgggaagctctcagctcctttaaaacacaactttgggagggaaatgcttgcatccacttgcatctacttttccatgaattacttgaacaagtatttgtccacggcaggagggattgagcatggtgggatggatttgcagagt

SEQ ID NO: 6190 - DNA, 267 bp, Homo sapiens
  misc_feature 17, 94, 108, 119, 152, 154, 166, 185, 193, 208, 221, 250: n = A,T,C or G
acaacgaaggccgagcntgcctttcccatctgtctatctatctggctggcagggaaggaaagaacttgcatgttggtgaaggaagaagtggggnggaagaagtggggngggacgacagngaaatctagagtaaaaccaagctggcccaaggngncctgcaggctgnaatgcagtttaatcagagngccatttntttttttgttcaaangattttaattatnggaatgcgcaatttttttaatatgcaaanaaaaagtttaaaaagtt

SEQ ID NO: 6191 - DNA, 128 bp, Homo sapiens
cacattctctgtcgacgtctgggctgcagctgtcctttgaggtccctcggtgggcactgccaacctgagctgcaataggggctgactccggccctgtatcctcagcacctgtgagagtgttggatgag

SEQ ID NO: 6192 - DNA, 122 bp, Homo sapiens
cataaatggattttaaactgtctacggttcttaacctcatctgttaagttcccatgcctggagaagctaatgccaactcatcatgtgataattcaatttgtacaataaattatgaacctgga

SEQ ID NO: 6193 - DNA, 400 bp, Homo sapiens
  misc_feature 24, 28, 30, 38, 69, 71, 83, 199: n = A,T,C or G
cttcttggggaaaaaacccctgtntttngngcgcctgnaggcccgacactagtggatccaaagaaattntntacgaggttagnttcctccctcatttataccccaatggcataccattccagagatctcataaaaacagacacagacttctccctctttatatggttatcttacgacttacctagtccttgagtctggncattaactccttggtgaggagagaacccataagcttaggaagtgctctgcgagaaagagactgctaagaagtagaggcattagctcggccagtgctctagagttgggtaaaatgtaaatgttatggcggggagaaggatggggtagagggtatgcatgtatggggaatgggaccattatttagcagcaaaaaggaaagttt

SEQ ID NO: 6194 - DNA, 168 bp, Homo sapiens
  misc_feature 92, 137: n = A,T,C or G
ctggcaactgaaggctggaacacttgctactggataatcgtagcttttaatgttgcgcctcttcaggttcttaagggattctccgttttggntccattttgtacacgtttggaaaataatctgcagaaacgagctgngcttgcaaagacttcatagttcccaagaatt

SEQ ID NO: 6195 - DNA, 143 bp, Homo sapiens
tgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagatta

SEQ ID NO: 6196 - DNA, 130 bp, Homo sapiens
  misc_feature 21, 23: n = A,T,C or G
cccacagcttcacgtggtggngngcagtgtgaggcagctccttggctttcctggttttcacaacaagctagagattttcaaagctacacttttgagtaaaaacccttattaaaagaaaaacatgattaat

SEQ ID NO: 6197 - DNA, 400 bp, Homo sapiens
  misc_feature 59, 110, 157, 180, 188, 220, 312, 376: n = A,T,C or G
tgcgcgcctgcaggtcgacactagtggatccaaagaattcttacgagctgacagctggngcgcctgcccgggaacatcctcctggactcaatcatggcttgtggtctggncgccagcaacctgaatctcaaacctggagagtgccttcgagtgcgangcgaggtggctcctgacgctaanagcttcgngctgaacctgggcaaagacagcaacaacctgngcctgcacttcaaccctcgcttcaacgcccacggcgacgccaacaccatcgtgtgcaacagcaaggacggcggggcctgggggaccgagcancgggaggctgtctttcccttccagcctggaagtgttgaagaaggtgtgcatcaccttcgaccangccaacctgaccgtcaagctgcca

SEQ ID NO: 6198 - DNA, 324 bp, Homo sapiens
ggcgcgcaaattacccactcccgacccggggaggtagtgacgaaaaataacaatacaggactctttcgaggccctgtaattggaatgagtccactttaaatcctttaacgaggatccattggagggcaagtctggtgccagcagccgcggtaattccagctccaatagcgtatattaaagttgctgcagttaaaaagctcgtagttggatcttgggagcgggcgggcggtccgccgcgaggcgagccaccgcccgtccccgccccttgcctctcggcgccccctcgatgctcttagctgagtgtcccgcggggcccgaagcgtt

SEQ ID NO: 6199 - DNA, 398 bp, Homo sapiens
  misc_feature 4, 5, 27, 28, 30, 31, 61, 92, 95, 97, 106, 167, 200, 206,248: n = A,T,C or G
gccnnactagtggatccaaagaattcnntnngagcgacagcacccatttgctttctgcttntggggacaaaacttccaagatttgggacgtnagngngaactccgnggtcagcacatttcccatgggctccacggttctggaccagcagctgggctgcctatggcanaaggaccacctgctcagtgtctccctgtccggntacatnaactatctggacagaaacaaccccagcaagcccctgcacgtnatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacg

SEQ ID NO: 6200 - DNA, 229 bp, Homo sapiens
  misc_feature 109: n = A,T,C or G
gtgaagtgagaccttccttttacttttcttctattgcctctgagagcatcaggcctagaggcctgactgccaagccatgggtagcctgggtgtaaaacctggagatggnggatgatccccacgccacagcccttttgtctctgcaaactgccttcttcggaaagaagaaggtgggaggatgtgaattgttagtttctgagttttaccaaataaagtagaatataagaag

SEQ ID NO: 6201 - DNA, 325 bp, Homo sapiens
  misc_feature 4, 12, 15, 112, 191, 222: n = A,T,C or G
aggncatgaagnttntttgcatttttatttaaatgaaggaattccaaataactcacctacagatttttagcacaaaaatagccattgtaaagtgttaaaatttacgataagnattctattggggaggaaaggtaactctgatctcagttacagtttttttttcctttttaatttcattattttgggttttnggtttttgcagtcctatttatctgcagtcgnattaagtcctattgctagaataggttactacaaaaaaggttatattctgaaagaaaaataactgacattatatataaccaattaatttaaagtattgccattt

SEQ ID NO: 6202 - DNA, 350 bp, Homo sapiens
  misc_feature 80, 154, 183, 255: n = A,T,C or G
ctgctattatctgctctccgcgcctgacccctcccaggactcgtgatgccaaggccgctgcgagcggctacgaagagtcngggttgagccccagctgagccgagggctcgcactcttctggtctcccaggcccaacccacctgaagaaatgagnggtggattggctccaagtaagagcacagngtatgtatccaacttgcctttttccctgacaaacaatgacttgtaccggatattttccaagtatggcaaagntgtaaaggttaccatcatgaaagataaagataccaggaagagtaaaggggttgcatttattttatttttggataaagactctgcacaaaactgta

SEQ ID NO: 6203 - DNA, 204 bp, Homo sapiens
  misc_feature 6, 80, 85: n = A,T,C or G
ctccgnaccagctggacccggccaacatcacgctggaacccatggaaatccgcactttcctggcctcagttcaatggaangaggnggatggttaggtctgctgggatgggccctccaagcccaagcctcctgctccgggggcagaccagactctgactctcctcttggggctgctgccattaaaacgctactactaagactcag

SEQ ID NO: 6204 - DNA, 319 bp, Homo sapiens
  misc_feature 26, 286: n = A,T,C or G
agcagatccgcatgtcccttcgcggnaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctnctttttccaggctttaggtatcaccactaaaat

SEQ ID NO: 6205 - DNA, 317 bp, Homo sapiens
ctaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagg

SEQ ID NO: 6206 - DNA, 164 bp, Homo sapiens
gtggatccgaggaggcggaacaagtccacggagtccctgcagaccaacgtgcagcggctgaaggagtaccgctccaaactcatcctcttccccaggaagccctcggcccccaagaagggagacagttctgctgaagaactgaaactggccacccagctgaccgg

SEQ ID NO: 6207 - DNA, 393 bp, Homo sapiens
  misc_feature 6, 20, 115, 138, 182, 345: n = A,T,C or G
ggcatngctgctggaggcgnaatggacgttaatactgctttacaagaggttctgaagactgccctcatccacgatggcctagcacgtggaattcgcgaagctgccaaagccttanacaagcgccaagcccatctttgngtgcttgcatccaactgtgatgagcctatgtatgtcaagttggnggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcangccaaggatgtcattgaagagtatttcaaatgcaagaaatgaagaaat

SEQ ID NO: 6208 - DNA, 400 bp, Homo sapiens
  misc_feature 17, 41, 54, 157, 382: n = A,T,C or G
tgcgcgcctgcaggtcnacactagtggatccaaagaattcnttacgagcgcggncgtcgggtgtgagctgcgccgaccgctctgagggttcgtggcccaccgctccttcgcggtccctgccgccaccgtccacgctcagcgttgtagagaagatggngggtcggaacagcgccatcgccgccggtgtatgcggggcccttttcattgggtactgcatctacttcgaccgcaaaagacgaagtgaccccaacttcaagaacaggcttcgagaacgaagaaagaaacagaagcttgccaaggagagagctgggctttccaagttacctgaccttaaagatgctgaagctgttcagaagttcttccttgaagaaatacagcttgntgaagagttactagctca

SEQ ID NO: 6209 - DNA, 351 bp, Homo sapiens
  misc_feature 67, 166, 322: n = A,T,C or G
ctgattttccctacaaagatgacctcctggccttggactccagctgcctcctgttcattgttcttgngttctttgccttattcatcatttttaaggcttatctaattaactgtgtttggaactgctataaatacatcaacaaccgaaacgtgccggagattgctgngtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgntacagaatgctgcaattcagggctcttca

SEQ ID NO: 6210 - DNA, 190 bp, Homo sapiens
  misc_feature 21, 104, 130: n = A,T,C or G
tcttgatgggtttctgttagncatgtattttgctaataatttccctagtttgtagtttgccacttagtgctatttttgacataaatgatgtattttaatgtagntgcatgttgacctagtccattatggnttttgtatttggtccacgtggattggaaaacctttgctttgattatacttttctttgggc

SEQ ID NO: 6211 - DNA, 128 bp, Homo sapiens
gatctcacaggctgagaactcgttcacctccaagcatttcatgaaaaagctgcttcttattaatcatacaaactctcaccatgatgtgaagagtttcacaaatccttcaaaataaaaagtaatgactt

SEQ ID NO: 6212 - DNA, 330 bp, Homo sapiens
  misc_feature 112: n = A,T,C or G
ggtcccccaagtcccgagatgaggtcaatgtggaaaacaggcagaagcttcgggttgatgagctgcggagagaatattacgaggaacaaaggaatgaatttgagaacttcgnggaggaacaaaacgatgagcaggaagagaggagccgggaggctgtggagcagtggcgccagtggcactatgacggcctgcacccatcctatctctacaaccgccaccacacctgatcccatcctgaagccggccaagaagacaaagcttgtagcaccattggcatccccgtgttccagcaatctttcccatgcaaaccggcccttcagagggtctcag

SEQ ID NO: 6213 - DNA, 298 bp, Homo sapiens
ggacaggaagatgtcacccaagcgcatagctaaaagaaggtcccccccagcagatgccatccccaaaagcaagaaggtgaagggtaagttggccttggcctctttgtgggtacaggtggccccttgaaaccctaagaacccgggactgggctcctttcttcctgaggcttgaagctgaagggtgtggatgtgcagagaccccacccagctggaaggtttcctgtagctcattgaatcctaccctctgggaatcacaaagtgggcagaaactcctctcaaagcactcaggcagcactgg

SEQ ID NO: 6214 - DNA, 109 bp, Homo sapiens
  misc_feature 2, 52, 62, 63, 66, 77, 90, 106: n = A,T,C or G
tngcgcgcctgcaggcccgacactagtggatccaaagaattctgtacgaggncggacagcgnncgncccccatgctncactcccacgctntcatctgcaggcctgnctt

SEQ ID NO: 6215 - DNA, 136 bp, Homo sapiens
  misc_feature 62: n = A,T,C or G
cggagtccctgcaggccaacgtgcagcggctgaaggagtaccgctccaaactcatcctcttncccaggaagccctcggcccccaagaagggagacagttctgctgaagaactgaaactggccacccagctgaccgg

SEQ ID NO: 6216 - DNA, 329 bp, Homo sapiens
  misc_feature 194: n = A,T,C or G
gagaaagacagagagactgagagagactgccttgggaaggggaagctcttctcatttcagctctttaaaaataaaaaggaatgtgggtaccatgcttgcatttacacactgattatgcagacagtctctcatttacgtttcatctctgagagtggcctattcatagccagactgttttacattacacaatcagncaattatcacatgatcaagtcacatcaagacaatctgaaaattacatttctactgggcaatatctcgagagtacttctagagcggccgcgggcccatcgattttccacccgggtggggtaccagggtaagtgtac

SEQ ID NO: 6217 - DNA, 153 bp, Homo sapiens
  misc_feature 51, 152: n = A,T,C or G
gatgcatttatcttaataaaatgctaaatgtcaatttatcactgcgcatgnttgactttagactgtaaatagagatcagattgtttctttctgtgctgggaacaatgagcgtcgcacagacatggtttcaggtaaataaatctattctatgnt

SEQ ID NO: 6218 - DNA, 134 bp, Homo sapiens
  misc_feature 14, 68, 116, 126, 127: n = A,T,C or G
tggaattgcctcanagtctgctgtggatccccatgaaatgaaatcactttgctttaatcacacttcangtttcaggtaatacatagattggtgaatgaaataaaataagcagtttnttagcattgnntttcttt

SEQ ID NO: 6219 - DNA, 242 bp, Homo sapiens
  misc_feature 191, 218, 229: n = A,T,C or G
cccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccacccnactcttaatcagtggtggaagaacggnctcacaactgngtggttgaattgg

SEQ ID NO: 6220 - DNA, 125 bp, Homo sapiens
cccaggagctgctcagggtgctgcgggcccaacctgtgcaggtggcagaaggcagcgagccagatggcttctgggaggccctgggcgggaaggctgcctaccgcacatccccacgggtgaaggac

SEQ ID NO: 6221 - DNA, 273 bp, Homo sapiens
ccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaag

SEQ ID NO: 6222 - DNA, 246 bp, Homo sapiens
  misc_feature 43, 97, 125, 157, 210, 218, 222: n = A,T,C or G
caagactgttatcgagtaccggtcacagaagacctcacgcctncccatcattgacattgcacccatggacataggagggcccgagcaggaattcggngtggacatagggccggtctgcttcttgnaaaaacctgaacccagaaacaacacaatccgntgcaaacccaaaggacccaagtactttccaatctcagtcactctaggactctnggcgactngganatgggcttgacctggacctggatt

SEQ ID NO: 6223 - DNA, 149 bp, Homo sapiens
gtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacatttt

SEQ ID NO: 6224 - DNA, 202 bp, Homo sapiens
cagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtt

SEQ ID NO: 6225 - DNA, 110 bp, Homo sapiens
  misc_feature 35, 41: n = A,T,C or G
cgcgcgcctgcaggtcgacactagtggatccaaanaattcngcacgagttccacggtgctaggctgagatggatcctctcagggcccaacagctggctgcggagctggag

SEQ ID NO: 6226 - DNA, 113 bp, Homo sapiens
  misc_feature 17: n = A,T,C or G
aaaagattgatcgccgntctggtaaaaagctggaagatggccctaaattcttgaagtctggtgatgctgccattgttgatatggttcctggcaagcccatgtgtgttgagagc

SEQ ID NO: 6227 - DNA, 275 bp, Homo sapiens
  misc_feature 4, 10, 237, 258, 270: n = A,T,C or G
aaanctggantctcgcgcgcctgcaggtcgacactagtggatccaaagaattggcacgaggcgaaaaggtttttaggaagtatggcaaaaatgttgtattggctatgatggtgacatgatatagtcagctgccttttaagaggtcttatctgttcagtgttaagtgatttaaaaaaataataacctgttttctgactagtttaaagatggatttgaaaatggttttgaatgcaatgnggttatgctgtttggacaatnaactcaccttgncctga

SEQ ID NO: 6228 - DNA, 208 bp, Homo sapiens
ctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaag

SEQ ID NO: 6229 - DNA, 135 bp, Homo sapiens
  misc_feature 10, 12, 124: n = A,T,C or G
aagaacttcngncgagaagtagttctttgaaagttaaagaaacttgaccaaaagacagtacaaaaacactggcacttgaatgttgaatgtcaccgtatgcgtgaaattatatatttcggggtantgtgagctttt

SEQ ID NO: 6230 - DNA, 106 bp, Homo sapiens
  misc_feature 10, 12, 60, 72, 74, 78, 79, 83, 89, 94: n = A,T,C or G
aagaatttcngncgagctgataggctggtgcagcctgccagggaaagttctactggactnaatactggcttngnggtnngganagccancaacntgaatcttaaac

SEQ ID NO: 6231 - DNA, 142 bp, Homo sapiens
  misc_feature 15, 17, 40, 55, 105, 117, 118: n = A,T,C or G
cgcgcgcctgcaggncnacactagtggatccaaagaattntgcacgagtcttggnaaatacggcatcatctgcatggaggatttgattcatgagatctatactgntggaaaacgctnnaaagaggcaaataactggcctgtg

SEQ ID NO: 6232 - DNA, 107 bp, Homo sapiens
  misc_feature 103: n = A,T,C or G
gttggggtgaggccctcacttcatccggcgactagcaccgcgtccggcagcgccagccctacactcgcccgcgccatggcctctgtctccgagctcgcctgcntcta

SEQ ID NO: 6233 - DNA, 112 bp, Homo sapiens
  misc_feature 17, 25, 26, 27, 29, 50, 51, 67, 70, 72, 88, 90, 94, 97, 98,103, 104, 106: n = A,T,C or G
ggggggttcaaaaaaancccaggtnnntncgccggcgccgcccctaggcnnaaggcccgggaccacnggngnggggcgacccccaaananaaanttnnggggnnanaggaag

SEQ ID NO: 6234 - DNA, 100 bp, Homo sapiens
  misc_feature 2, 11, 28, 41, 45, 53, 59, 61, 62, 90: n = A,T,C or G
anaacctggtnttttcgcggcgcctgcngtccgacactgantggntcccaaanaattcngnncggagttggaaatgacgatatccacagntttcaggaat

SEQ ID NO: 6235 - DNA, 131 bp, Homo sapiens
  misc_feature 13, 16, 33, 38, 42, 64, 115, 118: n = A,T,C or G
aagaatttcttgnacnatggtcgcacgcgtganacttntccnccgcctccgccgcagacgccgncgcgatgcgctacgtcgcctcctacctgctggctgccctagggggcaactnctnccccagcgccaag

SEQ ID NO: 6236 - DNA, 150 bp, Homo sapiens
  misc_feature 43, 44, 87, 141: n = A,T,C or G
ttcgcgcgcctgcaggtccgacactagtggatccaaagaattnngcacgaggtaaacgcaaacagggtttgatagcacttaaactanttcatttcaaaattaagctttaaaataatgcgcaatttcatgttatgccttaantccaaaaag

SEQ ID NO: 6237 - DNA, 209 bp, Homo sapiens
  misc_feature 9, 14, 51, 66, 119, 155, 170, 193: n = A,T,C or G
aagaattcngcacnatggcctgcacccagggggaagcacggacccgagacnacggcgatgaggaanggctcctgacacacagcgaggaagagctggaacacagccaggacacagacgcngatgatggggccttgcagtaagcagcctgacaggancaatggccaccagcnggtgaagggcatcgctgccccangcctcaagccgggcac

SEQ ID NO: 6238 - DNA, 101 bp, Homo sapiens
  misc_feature 1, 14, 30, 55, 90: n = A,T,C or G
naaaaacctggttntcgcgcgcctgcaggncgacactagtggatccaaacaattntgcacgagatggaacgaattcaggaatcctgagtnttcaacaacta

SEQ ID NO: 6239 - DNA, 100 bp, Homo sapiens
  misc_feature 3, 55: n = A,T,C or G
cgngccgcctgcaggtccgacactagtggatccaaagaattctgcacgagcaatntgaatttgaatgatcatagctatatgtcacataatagaatactct

SEQ ID NO: 6240 - DNA, 175 bp, Homo sapiens
aaaacacaagtgccttctccacggtgcaattcagacttcagtgatctccagtggtcaaaagacatttacccttaatatcatgacaacatttatattttagtgaagaaacaagttctcgggtggggaatctatgtttcactcagatttatatgtttggaggaaaaaagcctttttt

SEQ ID NO: 6241 - DNA, 119 bp, Homo sapiens
  misc_feature 67, 73, 83: n = A,T,C or G
tgggggaacaaaaacctggtttttcgcgcgccctgcaggtccgacactagtgggatccaaagaattntgcacnaggccgaggnaaggcattgctgctggaggtgtaatggacgttaata

SEQ ID NO: 6242 - DNA, 108 bp, Homo sapiens
  misc_feature 6, 34, 42, 64, 77, 87: n = A,T,C or G
agaaangggaggttttttgggggggacaaaaaancctggttntctccgccgccgccctgcaggnccggacactgagngggacccaanagaattcgggcacggagcaca

SEQ ID NO: 6243 - DNA, 170 bp, Homo sapiens
  misc_feature 60, 145, 154: n = A,T,C or G
caccaaggtggcttctccttggctgagagatggaaggcgtggtgggatttgctcctgggntccctaggccctagtgagggcagaagagaaaccatcctctcccttcttacaccgtgaggccaagatcccctcaaaaggcaggagngctgccctntgccatggtgcccgtg

SEQ ID NO: 6244 - DNA, 100 bp, Homo sapiens
  misc_feature 6, 16, 29, 32, 38, 44, 46, 51, 58, 71, 74, 88, 98: n = A,T,C or G
actttnacttgcgcantccacagagaggnaantttttnacaacngnagccncctcctncccatgcgggagnaangcgcgggccttcangaggagcccnac

SEQ ID NO: 6245 - DNA, 100 bp, Homo sapiens
  misc_feature 2, 28, 44, 55, 56, 57, 75, 76, 82, 91: n = A,T,C or G
tntcgcgcgcctgcaggtcgacactagnggcatccaaacaattntgcacgagggnnngggctgccaaaaccaggnnaacctnctacatggntcatgactc

SEQ ID NO: 6246 - DNA, 282 bp, Homo sapiens
  misc_feature 235, 270, 273: n = A,T,C or G
gtaagaccctgtctcaaaaaaataaataattatcataataataaaaatcaatttctcaatgcattatctcatttaatccccaaaacaatcctataactaaagtgtcttcacctcactttatagaaggcaaaattactaagaatggcgatacttagtaatttgcccaagaaagtaaaaaggctgagattcaaatccaatcatcctgacaccagcttttcttatctatttgttaagngacaattacctcattgtgaattattattgcaggtntantttaattat

SEQ ID NO: 6247 - DNA, 128 bp, Homo sapiens
  misc_feature 4, 7, 36, 121: n = A,T,C or G
cgcntgnaggtccccactagtggatccaaagaattntgcacgagcaactacacaggagatttctcagcctacaaattgtgtctatacatttctaagccttgtgttgcagaataaacagggnatttagc

SEQ ID NO: 6248 - DNA, 235 bp, Homo sapiens
  misc_feature 100, 107, 170: n = A,T,C or G
ccaaggtgggcggatcgcctgaggtcaggagtttgagaccagcctggccaacatggtgaacccccatctcttaaaaatataaaaattagctgggcatggnggcaggngcctgtaatcccagctactcaggaggctgaggcacgagagtcgctttgaacccgggaggtggnggttacagtaagctgagatcttcccactgcactccagcctgagcgacagagtgagactccatctc

SEQ ID NO: 6249 - DNA, 246 bp, Homo sapiens
  misc_feature 17, 35, 179, 233: n = A,T,C or G
gatacaagggaacgtantcgtttggaaagcgtcgnagtaagacgcacacgttgtgccgccgctgtggctctaaggcctaccaccttcagaagtcgacctgtggcaaatgtggctaccctgccaagcgcaagagaaagtataactggagtgccaaggctaaaagacgaaataccacccgnaactgggcgaatgaggcacctaaaaattgtataccgcagattcaggcatggatncctgggaaggaac

SEQ ID NO: 6250 - DNA, 205 bp, Homo sapiens
  misc_feature 8, 12: n = A,T,C or G
ctttgtgnctcnaagaatttcggcacgatgctggacttgaacagtatgctattaagaagtttgctgaggcatttgaagctattccccgcgcactggcagaaaactctggagttaaggccaatgaagtaatctctaaactttatgcagtacatcaagaaggaaataaaaacgttggattagatattgaggctgaagtccctgctgg

SEQ ID NO: 6251 - DNA, 118 bp, Homo sapiens
  misc_feature 2, 16, 44: n = A,T,C or G
tncgcgccccctgcantgcgacactagtggatccaaaaaatttngcacgaggcccctcacccgattggggacatgggtgcacgtgagtgggggcagcgaatgttgctgtggacagagg

SEQ ID NO: 6252 - DNA, 123 bp, Homo sapiens
  misc_feature 4, 5: n = A,T,C or G
gcgnnactagtggatccaaaaaatttggcacgagctaagtacctcacggcatcactgaaagatgagtattattagttggaattttagggatgagaaaactgaccctcaggggagaataactga

SEQ ID NO: 6253 - DNA, 273 bp, Homo sapiens
  misc_feature 3, 15, 50, 175, 187, 194, 231, 238, 244: n = A,T,C or G
cgngcgcctgcaggncgacactagtggatccaaagaattttgcacgagcnagacaaaaaacaaacaaacaaacaaacaaaaaaacaactctgtcaggtggaaggaacgtgaaacgtgttaacccatgaaaaacagaagcaggccagaaggaagccagctagaatctagggtttanaatgcgagcagngcctgtnaatctacccttcagttctagatttgagaaaagtagtnaaccacnacaccnatggacaatgaggcaggaccaacagaaac

SEQ ID NO: 6254 - DNA, 195 bp, Homo sapiens
  misc_feature 180, 193, 195: n = A,T,C or G
gtaaagtgcttatggctaacagttcagttctgtatttgttgacaggtaaataagtggagttgagtgccatctttgaaaaaattaccctctagctctaacactgaaaataataataaattgtagatctctgcaactaagtttaaagcagtgtgactgggttgcttaaatatcaagtattgnttataacccccgnan

SEQ ID NO: 6255 - DNA, 202 bp, Homo sapiens
  misc_feature 147: n = A,T,C or G
cttcaggggatgattaaaccatcctttattatagcctgagtctagtctaagggaagaaggtcattctctataccagtgaaggctccatccaaaccagtgtttgggggcatagtcataattgaaaaatgattgttttccttatctgtnagacaggtaaatggtattaatcctcaggtggttgtgaggattaagtgatacatgt

SEQ ID NO: 6256 - DNA, 187 bp, Homo sapiens
  misc_feature 25, 158, 159, 168: n = A,T,C or G
cagatacttgaagaatgttgatggngctagaagaatttgagaagaaatactcctgtattgagttgtatcgtgtggtgtattttttaaaaaatttgatttagcattcatattttccatcttattcccaattaaaagtatgcagattatttgcccaaagnngtcctcttnttcagattcagcatttgtt

SEQ ID NO: 6257 - DNA, 100 bp, Homo sapiens
  misc_feature 2, 9, 80, 90, 92, 93: n = A,T,C or G
cnatgcacngcgacactagtggatccaaaggaatttggcacgagctggaaatgcaaatgaggctgtcaatggggtaaganaaatgagggntnntaaacac

SEQ ID NO: 6258 - DNA, 259 bp, Homo sapiens
  misc_feature 9, 150, 179, 191, 212, 223, 226, 245: n = A,T,C or G
gcgcaggtncaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtnatgaccattccgtaccagcccatgccggncagctgcccatncatctgcggcgggcggccaanatcgggtgcangtnacgctggggggctaccccncatgccacccatga

SEQ ID NO: 6259 - DNA, 214 bp, Homo sapiens
tcgcgcgcctgcaggccgacactagtggatccaaagaatttggcacgagcgtggccctccaggaagaggtcccaacggtttgcctggagctataggtctcccaggtgacccaggccctgccagctatggcagaaatggccgagacggcgagcgaggccccccaggggtggcaggaattcctggagtgcctggacccccgggacctcctgggctt

SEQ ID NO: 6260 - DNA, 111 bp, Homo sapiens
  misc_feature 14, 43: n = A,T,C or G
tcgcgcgcctgcangtccgacactagtggatccaaagaatttngcacgagcccttatgacatgttggaaagcatcaggaaagaggttaaaggagacctggaaaatgctttc

SEQ ID NO: 6261 - DNA, 149 bp, Homo sapiens
  misc_feature 3, 4, 34, 114, 130: n = A,T,C or G
ctnnactgcgacactagtggatccaaagaatttngcacgagctcactcctgtaatcccaacactttgggaggccgaagtagacggatcacttgaggtcaggagttcgagaccantctggccaacatggtngaaaccccctctctactac

SEQ ID NO: 6262 - DNA, 139 bp, Homo sapiens
  misc_feature 77, 80: n = A,T,C or G
caaaaaactctgtttctgcaggggatgatattggtgagttgccaaagaagcaatacagcatatctgcttttgccttntgntgtttatcttacctgcagatattaagaatgtatgcattatgtaaaatgctcaattgtat

SEQ ID NO: 6263 - DNA, 177 bp, Homo sapiens
  misc_feature 155, 157: n = A,T,C or G
gctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccaggatctngnggagaattttgatgaggctt

SEQ ID NO: 6264 - DNA, 104 bp, Homo sapiens
  misc_feature 3, 51, 56, 83: n = A,T,C or G
acngcgacatctagtggatccaaagaattttgcacgagcctttcttgcttncagcnagtacccaaagcatctgtggcagtcgnaaagaaataatacattctagc

SEQ ID NO: 6265 - DNA, 106 bp, Homo sapiens
aatgaagactattctcagcaatcagactgtcgacattccagaaaatgtcgacattactctgaagggacgcacagttatcgtgaagggccccagaggaaccctgcgg

SEQ ID NO: 6266 - DNA, 100 bp, Homo sapiens
agccattacagtatccaatgtcttttgacaggtgcctgtccttgaaaaacaaagtttctatttttatttttaattgggtgagttcttaactgctggccca

SEQ ID NO: 6267 - DNA, 109 bp, Homo sapiens
  misc_feature 5, 7, 82: n = A,T,C or G
cgtcnangcgctgaaaaaactaacaagaataaaaaactggtcaagaagctggccaacaagtatgatgcgtttttggcctganagtctctgatcaaggcaggatgccacg

SEQ ID NO: 6268 - DNA, 101 bp, Homo sapiens
  misc_feature 85, 88, 97: n = A,T,C or G
tacttctagagcggccgcgggcccatcgattttccacccgggtggggtaccaggtaagtgtacccaattcgccctatagtgagtngtnttacaattnactg

SEQ ID NO: 6269 - DNA, 226 bp, Homo sapiens
  misc_feature 56, 128, 131, 204: n = A,T,C or G
ccacaaagtgaccaagaacgtgagcaagcccaggcacagccgacgccgcgggcgtntgaccaaacacaccaagttcgtgcgggacatgattcgggaggtgtgtggctttgccccgtacgagcggcgcnccntggagttactgaaggtctccaaggacaaacgggccctcaaatttatcaagaaaagggtggggacgcacatccncgccaagaggaagcgggaggag

SEQ ID NO: 6270 - DNA, 103 bp, Homo sapiens
  misc_feature 56: n = A,T,C or G
ctcccgcaaagaagggtggcagagtaagaaaaagggccgttctgccatcaacgaantggtaacccgagaatacaccatcaacattcacaagcgcatgcatgga

SEQ ID NO: 6271 - DNA, 173 bp, Homo sapiens
  misc_feature 83, 100, 159, 170, 172: n = A,T,C or G
gctaaccacccagcttgctcagagatctcatattgaagcaacatacaggcaatccacatctttctttccctttgaagtatagncacttggatgggatganggacagggcctgttgggttcacagggccttgcactgcatgggcacatacttaaaagctnttgtgcatggnant

SEQ ID NO: 6272 - DNA, 102 bp, Homo sapiens
  misc_feature 9, 10, 32, 83, 99: n = A,T,C or G
gcttaggcnngcggggcaccctgcagtggcanggactcggcaccgcgccctccaccgccggttggtggcctgcgtgacagttncctcccgtcgacatcnaaa

SEQ ID NO: 6273 - DNA, 100 bp, Homo sapiens
  misc_feature 44, 94, 98: n = A,T,C or G
cgcgcgcctgcaggtcgacactagtggatccaaacaattctgcncgagggactacaatggccacgtcggtctgggtgttaagtgcttgcaaggnaggngg

SEQ ID NO: 6274 - DNA, 118 bp, Homo sapiens
  misc_feature 116: n = A,T,C or G
cagttccagcccctcgctgctgggggcgcaaccaccccttccttaggttgatgtgcttgggaaagctccctccccctccttccccaagagaggaaataaaagccaccttcgccctngg

SEQ ID NO: 6275 - DNA, 116 bp, Homo sapiens
  misc_feature 5, 12, 33, 93: n = A,T,C or G
gcgcntgcaggnccgacactagtggatccaaanaattctgcacgaggctgctaccacccttttcaattgctatcttttgaaaggcaccagatntgtgttttagattgatttccctg

SEQ ID NO: 6276 - DNA, 100 bp, Homo sapiens
  misc_feature 50: n = A,T,C or G
gcaagatcctgtacagccagtgtggggacgtgatgagggccctgggccanaaccccaccaacgccgaggtgctcaaggtcctggggaaccccaaaagtga

SEQ ID NO: 6277 - DNA, 146 bp, Homo sapiens
  misc_feature 4, 24, 45: n = A,T,C or G
cacnttgtgactccaagaatttcngcacgatgaaggatggaatgnaaaacaacgctgcatatacaggtaccactttaggaaataccgatgcctttgtgggggcaggaatcacatggcaaaagctttgaaaatcataaagatataag

SEQ ID NO: 6278 - DNA, 109 bp, Homo sapiens
  misc_feature 3, 4: n = A,T,C or G
aanntccggagcccagagggcagccgcaagaaccccgcccgcacctgccgtgacctcaagatgtgccacctctgactggaagagtggagagtactggattgaccccaac

SEQ ID NO: 6279 - DNA, 100 bp, Homo sapiens
  misc_feature 2, 11, 45: n = A,T,C or G
gnccacacttntggatccaagaattctgcacgagcccaaatgttnggaaacagtataatttgacaaagaaaaatgatacttctctttttttgctgttcca

SEQ ID NO: 6280 - DNA, 101 bp, Homo sapiens
  misc_feature 46, 62, 84: n = A,T,C or G
atttcgcactgtattaaatgtaacttatttaatgaaatcagaagcngtagacagatgttggngcaatacaaatattgtgatgcntttatcttaataaaatg

SEQ ID NO: 6281 - DNA, 117 bp, Homo sapiens
  misc_feature 106, 111: n = A,T,C or G
ccctaatgaagtggtttaactcagtaaataaggaattataaaaacaattcttataagttatgtagtgttttttttctgttgcaaacactaacattttaatgtgatnacatncattac

SEQ ID NO: 6282 - DNA, 153 bp, Homo sapiens
ctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatt

SEQ ID NO: 6283 - DNA, 105 bp, Homo sapiens
  misc_feature 40, 55: n = A,T,C or G
cgcgcgcctgcaggtcgacactagtggatccaaagaattntgcacgagcggaggngcaggtcctggtgcttgatggtcgaggccatctcctgggccgcctggcgg

SEQ ID NO: 6284 - DNA, 121 bp, Homo sapiens
  misc_feature 2, 18, 60, 86, 96, 102, 105: n = A,T,C or G
tnggggaaaaactggttntcgcgcgcctgcaggtcgacactagtgggatccaaaaaattntgcacgagcttctgacagctggtgcncctgcccggnaacatnctnctggactcaatcatgg

SEQ ID NO: 6285 - DNA, 163 bp, Homo sapiens
  misc_feature 152: n = A,T,C or G
gaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttntggtgctaatg

SEQ ID NO: 6286 - DNA, 156 bp, Homo sapiens
  misc_feature 3, 8, 33, 34: n = A,T,C or G
aanctgcnacactagtggatccaaagaattttnnacgagcggaaaacagctggaagatggtcgtaccctgtctgactacaacatccagaaagagtccaccttgcacctggtgctcccgtctcagaggtgggatgcaagatcttcgtgaagaccctg

SEQ ID NO: 6287 - DNA, 236 bp, Homo sapiens
  misc_feature 2, 11: n = A,T,C or G
gnacaatgctnaaacccacaaacacttagttaacatgctaagcaccctaataaactggcttcaatctacttctcccgccgccgggaaaaaaggcgggagaagccccggcaggtttgaagctgcttcttcgaatttgcaattcaatatgaaaatcacctcggagctggtaaaaagaggcctaacccctgtctttagatttacagaccaatgcttcactcagccatttttacctcacc

SEQ ID NO: 6288 - DNA, 206 bp, Homo sapiens
  misc_feature 192, 204: n = A,T,C or G
tccaattagtctgaaaagggtactttggaattgtcccatattaatctgagatggcaaaagaaaaagttctcatattaccaggttgattttgtgtctcatttcaaattttaatttaaaattatggttttcatttttgtttaccttaaagtgatgcttaaaagtggcatgtaattaaggacacttaggtttgtngaaagcattttnga

SEQ ID NO: 6289 - DNA, 125 bp, Homo sapiens
cagaatcacatggcaaaagctttgaaaatcataaagatataagttggtgtggctaagatggaaacagggctgattcttgattcccaattctcaactctccttttcctatttgaatttctttggtg

SEQ ID NO: 6290 - DNA, 147 bp, Homo sapiens
  misc_feature 1, 16, 32, 79, 83, 140: n = A,T,C or G
naaaaaaacctggttntcgcgcgcctgcaggncgacactagtggatccaaaaaattttgcacgaggaggaaaccagggngacngaggagacaaaggcgcggcaggagcagggctggacgggcctgaaggagaccaggggnccccaag

SEQ ID NO: 6291 - DNA, 255 bp, Homo sapiens
  misc_feature 199, 250: n = A,T,C or G
gaacattttcatcatcccaaaaggaaaccctatactcattacgcagtcactccccagtcttcctcctcccagccccagcaaccactcatctattttctgtctctatagatttgtctattctgatggaaatgtacaatatgtgcccttttgtgtctggcttttttcacttagcatgttttcaaggtttgtccatgttgtnccatgtattggcacactgttactttttatggccaaataaatattacactgngcgat

SEQ ID NO: 6292 - DNA, 147 bp, Homo sapiens
gtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcaca

SEQ ID NO: 6293 - DNA, 216 bp, Homo sapiens
  misc_feature 11, 15, 29, 53, 120, 132: n = A,T,C or G
cgcgcctgcangtcnacactatgtggatncaaagaattctgcacgagccctgngcttcctggaaggcctggccctcctggtccccccggccctcctggagagaatggtttcccaggccanatgggaattcgnggccttccgggcattaaggggccccctggtgctcttggtttgaggggacctaaaggtgacttgggaaaaaagggggagcgtggc

SEQ ID NO: 6294 - DNA, 164 bp, Homo sapiens
  misc_feature 150, 151: n = A,T,C or G
cgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggnntttagccatgcac

SEQ ID NO: 6295 - DNA, 128 bp, Homo sapiens
  misc_feature 44, 48: n = A,T,C or G
ggatgcagtgctcgctgttgctgaataggcgatcacaacgtgcnttgngcttctttctttgggaatatttgaatcttgtctcaatgctcataacggatcagaaatacagattttgatagcaaagcgac

SEQ ID NO: 6296 - DNA, 100 bp, Homo sapiens
  misc_feature 33, 59, 68: n = A,T,C or G
ggaattcttttgaagctcagccccaggcctggnggtttccgttccttcctcaccctgtntcaagcatncctgctcttctcccctccaggctcccctgggt

SEQ ID NO: 6297 - DNA, 112 bp, Homo sapiens
  misc_feature 40, 41, 46, 96: n = A,T,C or G
cgcgcgcctgcaggtcgacactagtggatccaaagaattnngcacnaggtcgcggcgacatggccaaacgtaccaagaaagtcgggatcgtcggtnaatacgggacccgcta

SEQ ID NO: 6298 - DNA, 181 bp, Homo sapiens
cgttgtggctccaagaatttcggccgatgagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcct

SEQ ID NO: 6299 - DNA, 115 bp, Homo sapiens
  misc_feature 24: n = A,T,C or G
cagatgtcgaaacgaggacgtggngggtcctctggtgcgaaattccggatttccttgggtcttccggtaggagctgtaatcaattgtgctgacaacacaggagccaaaaacctgt

SEQ ID NO: 6300 - DNA, 182 bp, Homo sapiens
ccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaag

SEQ ID NO: 6301 - DNA, 180 bp, Homo sapiens
  misc_feature 32, 140, 146: n = A,T,C or G
atccagggcctccggataatgtgaagctgagngagcctccgccatccagcatgacaaactgtggccgaccgcagctgtgccgtggcacgatggcgaggaagccagccccaaggaaacactgaaaacacatatcacgccantgccgngtggttttgtttgaatataaaattggggaaagtg

SEQ ID NO: 6302 - DNA, 141 bp, Homo sapiens
  misc_feature 38, 58, 63, 64, 65, 122, 124: n = A,T,C or G
tgcgcgcgcctgcaggtccgacactagtggacccaaanaattttgcacgaggctgggngctgnnntccagttcaggtgaattagcctcaatcccccgtgttcacttggctcccatagccctntngatggatcacgtgaaac

SEQ ID NO: 6303 - DNA, 201 bp, Homo sapiens
  misc_feature 8, 17, 25, 27, 32, 42, 45, 49, 53, 69, 79, 108, 156, 164,191: n = A,T,C or G
gtgactcnaagaatttngcacgagntnttgcnaaattgaaanagnttcnaaanaatcccgcgatgcatncatagaacanggcgtgagaaattgggaaccctcactctnatttctgctttccttaacctgctgtagcgacctgacatgcaggcgttnaaccattnaccctgtgctacccagaaaggaagccnctggccacag

SEQ ID NO: 6304 - DNA, 231 bp, Homo sapiens
  misc_feature 89, 201, 211: n = A,T,C or G
tgcgcacacgagaacatgcctctcgcaaaggatctccttcatccctctccagaagaggagaagaggaaacacaagaagaaacgcctggngcagagccccaattcctacttcatggatgtgaaatgcccaggatgctataaaatcaccacggtctttagccatgcacaaacggtagttttgtgtgttggctgctccactgtnctgtgccagnctacaggaggaaaagcaagg

SEQ ID NO: 6305 - DNA, 191 bp, Homo sapiens
  misc_feature 125, 136, 142, 161, 175: n = A,T,C or G
acagtgccgacttgcaaacggattggcctaatgaagaagttcaacctggagagatggaaaatcagctctcataactaagttaatttagtataaaaatagaattgatagtgagggtataaagtgtnaccatcaggtnaacctntcctgtcattcctagcttncttgcttgagaatngaaatggaaggggggg

SEQ ID NO: 6306 - DNA, 236 bp, Homo sapiens
  misc_feature 17, 30, 31, 41, 54, 65, 117, 130, 151, 219, 223, 232: n = A,T,C or G
cgcgcgcctgcaggtcnacacttgtggatnnaagaattctncacgaggtaaatngccatggcccngagccactgagtatgttcattgccacccctgtccctcccctgggcacccctnactttccctgatnctgcaattaaagggttaatgngtggcatatggaagggactcccaggaccctgtgcccagcttccatgctgactgatggttaaataatgngatngtctcctgncagg

SEQ ID NO: 6307 - DNA, 181 bp, Homo sapiens
  misc_feature 3, 18, 31, 41: n = A,T,C or G
tcncgcgcctgcaggccnacactagtggatncaaagaattntgcacgaggtgaaaaggaggaaggggttcccatgcgggggaggctctggggctgaggggaacaattctcacgtgtttggtgcttagagacctgcccggggcgttgggcaggccctccgggggctgaattaaaaatgcttt

SEQ ID NO: 6308 - DNA, 231 bp, Homo sapiens
  misc_feature 191, 206: n = A,T,C or G
gaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttanccagttgtatttgcnaaacaaggaaataaaggcttacttg

SEQ ID NO: 6309 - DNA, 124 bp, Homo sapiens
  misc_feature 2, 5, 48, 56, 62, 71, 78, 87, 94, 98, 116: n = A,T,C or G
tncgngcgcctgcaagtccgacactagtggatccaaagaattttggcncgagcttnaatcangccacatanccctcgnaggaacagncattctnatgncaaaccccctgaagctgnaccggcgc

SEQ ID NO: 6310 - DNA, 108 bp, Homo sapiens
  misc_feature 2, 15, 16, 17, 18, 20, 21, 29, 33, 34, 35, 41, 43, 44, 53,63, 68, 71, 80, 82, 90, 91, 96, 97, 100, 102, 103, 107: n = A,T,C or G
gntgagggggggagnnnngnnggaatttngggnnnggaccngnnagcgcgganagggcacccnagggngcnccagggaananccctcacnnatganngancnnacgna

SEQ ID NO: 6311 - DNA, 124 bp, Homo sapiens
  misc_feature 41, 60, 115: n = A,T,C or G
cgcgcgcctgcaggtcgacactagtggatccaaagaatttngcacgagcacaacccaagngggcctgggcagctgggatgggaagcagcccagttacttcatcatcttccatggnggacacatt

SEQ ID NO: 6312 - DNA, 282 bp, Homo sapiens
  misc_feature 5, 12, 74, 97, 142, 147, 233: n = A,T,C or G
aaaancctgganttcgcgcgcctgcaggtcgacactagtggatccaaagaattctgcacgagcggaccctgcanccgcacagatgttgatgcctaanaagaaccggattgccatttatgaactcctttttaaggagggagtnatggnggccaagaaggatgtccacatgcctaagcacccggagctggcagacaagaatgtgcccaaccttcatgtcatgaaggccatgcagnctctcaagtcccgaggctacgtgaaggaacagtttgcctggagacattt

SEQ ID NO: 6313 - DNA, 285 bp, Homo sapiens
  misc_feature 17, 33, 171: n = A,T,C or G
gatgtgaggttcacagntgtattccagtattcnagatagattcctgatttttcaattaggaaaagtaaaatccaaaatgttagcaaaacaaagtgcaatattaaatgtttgctttatagattatattctatggctgtttgtaatttctctttttttccttttttatttggngctgaatatgtccttgtaggctctgttttaagaaaacaatatgtgggaaatgatttaatttttcctattgctcttccttgtggaaaataaagtgttttgtttttttctgttttg

SEQ ID NO: 6314 - DNA, 148 bp, Homo sapiens
  misc_feature 12, 13, 18, 53, 124, 137: n = A,T,C or G
ctctttcttctnnaacantggatgacacaaaactatgagagtgacaaaatggngacaggtagctgggacctaggctatcttaccatgaaggttgttttgcttattgtatatttgtgtatgtagngtaactattttgnacaatagagga

SEQ ID NO: 6315 - DNA, 103 bp, Homo sapiens
  misc_feature 9, 18, 41, 49, 50, 64, 69, 77, 83, 87, 99: n = A,T,C or G
atccaaagnaattcttgnacgagcttttttgtcaactcttncttttatnnggatgatgaactgncgggnttgggggntctttntggnggggggtggggntggg

SEQ ID NO: 6316 - DNA, 155 bp, Homo sapiens
  misc_feature 6, 16, 39, 114, 141: n = A,T,C or G
tggtgngtccaagaanttctgcacgaggcttttaccagnacaaaatcccaattcactttattattttgcttcaggatccaagtgacaaagttatatatttataaaattgctatnaatcgacaaaatctaatgttggctttntaatgtgagtgatc

SEQ ID NO: 6317 - DNA, 149 bp, Homo sapiens
  misc_feature 13, 19, 27, 36, 38: n = A,T,C or G
ccttgaaggcccncacttngtggatcnaagaatttngncgaggccctgacccgcggtaacccgcgtgagctcgcccgccagaagaatatgaaaaagcagagcgactcggttaagggaaagcgccgagatgacgggctttctgctgccgc

SEQ ID NO: 6318 - DNA, 203 bp, Homo sapiens
  misc_feature 13, 20: n = A,T,C or G
cattgttcattgntattggnatgtaccttattacaaaaaaaatgatgaaaacatatttatactacaaggtgacttaacaactataaatgtagtttatgtgttataatcgaatgtcacgtttttgagaagatagtcatataagttatattgcaaaagggatttgtattaatttaagactatttttgtaaagctctactgtaaat

SEQ ID NO: 6319 - DNA, 192 bp, Homo sapiens
  misc_feature 73: n = A,T,C or G
tggccccgccgcctggtactcaagcccgcggggacattgggaaggggacccccgccccctgccctcccctctntgcaccgtactgtggaaaagaaacacgcacttagtctctaaagagtttattttaagacgtgtttgtgtttgtgtgtgtttgttctttttattgaatctatttaagtaaaaaaaaaattg

SEQ ID NO: 6320 - DNA, 340 bp, Homo sapiens
  misc_feature 211, 233, 302, 323: n = A,T,C or G
ctgatctaaaaatgaaagcaaaatatcttatgtagaaatattttgataatatttttacagtgagctttcccatgtttttatgtcttaagtttccttgctgcgtttatgtaggttgcacaagaacttttactcacttgtaattgtgcctcagactttttgaaagtctaccttctaaattgccccgacgatctagattctacatgttaccatnggtttattcttgtgctttctgnatttaaaactttggctgtactaagcaaatgcaaggttataatttagctaatagtagtttacagacaatnctgatgattatgatttcattnggtttaactaagctgca

SEQ ID NO: 6321 - DNA, 190 bp, Homo sapiens
  misc_feature 76: n = A,T,C or G
cccaattggaccaatctatcaccctatagaagaactaatgttacgtataagtaacatgaaaacattctcctccgcntaagcctgcgtcagattaaaacactgaactgacaattaacagcccaatatctacaatcaaccaacaagtcattattaccctcactgtcaacccaacacaggcatgctcataagg

SEQ ID NO: 6322 - DNA, 292 bp, Homo sapiens
  misc_feature 190, 215, 259: n = A,T,C or G
gtttggagcaaggggaagggttgccagagtcctgggggccccagaggagcaggagtctgggagggcccagagttcaccctctagtggatccaggaggagcagcacccgagccctggagtggcccagtacccttccaagaggccacagtcccagccaggacaaagtatgcggcccatcctggtgcgacagngtgggacaatgtgaacatggactcnaagacatggccccttttctctgtagttgattttttaaatgtgcnattattgttttttaaaaaaaaagggaaaaaaga

SEQ ID NO: 6323 - DNA, 260 bp, Homo sapiens
  misc_feature 215: n = A,T,C or G
gtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctnaggaaattctacaagggcaagaagtacaagcccctggacctgcgg

SEQ ID NO: 6324 - DNA, 264 bp, Homo sapiens
  misc_feature 248, 250: n = A,T,C or G
aattgttttttattttttttaggatttgactataaggaaagaaattccagtatgcaacatgatagcagaaataaacaagctgtcagattttggaaatgaatatgaatttcattttctttggtcctaatatcacataatgattgtttttatacaaaaataccatatggctaatgtggacccaatctcaacatttgtttgctgccttacacacacatttttatttatatttctttttttatatatggatntnggaagtgggatgcc

SEQ ID NO: 6325 - DNA, 193 bp, Homo sapiens
  misc_feature 40, 180: n = A,T,C or G
gttgacatgtggggcccgatcattcttagttgtggagggncgtcctgtgcattacaggatattaagcagcatctctggactctacccactagttgctggtagcattccccttccccaagtgtgacaacaaaaatgtctccagacatggcaagatgtcccctgtgggtcaagttgacccanttaagaactatag

SEQ ID NO: 6326 - DNA, 340 bp, Homo sapiens
  misc_feature 200, 202, 253, 288: n = A,T,C or G
catgtcagcaagggataaagagttacttacagaagttaaagtgaaattaaataactcttgaatccatttgtaaaagtgcctgtattctcagttgaatggtagtaactactgcgtgaaggaagttggtttgccttatggataaggtttttataagtacttaaaatggaattagcatacaccctttaaccatgctgattttngnttatccctgcaacatattttgaaagctttgctctcctgtataagccagtanaaagcacaggcacttgcacagcatttaaaactcanatataaagcatttctagcacattatggatgcgctatggggtttgaagttaat

SEQ ID NO: 6327 - DNA, 253 bp, Homo sapiens
  misc_feature 29, 154, 196, 207, 239: n = A,T,C or G
cttcagggaagccatgcgcattggagcanaggtttaccacaacctgaagaatgtcatcaaggagaaatatgggaaagatgccaccaatgtgggggatgaaggcgggtttgctcccaacatcctggagaataaagaaggcctggagctgctgaanactgctattgggaaagctggctacactgataaggtggtcatnggcatggacgnagcggcctccgagttcttcaggtctgggaagnatgacctggacttc

SEQ ID NO: 6328 - DNA, 169 bp, Homo sapiens
  misc_feature 11, 93, 125, 156, 164: n = A,T,C or G
gaatttctcanagatctttgtgcataagaggtagctaggcttctgtgtcaacaaatactggagcaagtcagccttagaggggagtggcctgancaccatctagtgtaaatgctctcgtaaatgtncttgaaatgataggtatgtacaactgccatntagtgacnatggg

SEQ ID NO: 6329 - DNA, 249 bp, Homo sapiens
  misc_feature 2, 17, 29, 41, 63, 65, 66, 137, 142, 159, 175, 181, 204, 245: n = A,T,C or G
tncccatttaagctgcnacactagtgganccaaagaatttngcacgagcaattaaacacgttngnnttctgaataaattgaactaaatccaaactatttcctaaaatcacaggacattaaggaccaatagcatctgngccanagatgtactgttattanctgggaagaccaattntaacancaaataacagtctgagactcctnatacctcagggggtaaaagcatgtctctcttgagctacagnagga

SEQ ID NO: 6330 - DNA, 320 bp, Homo sapiens
  misc_feature 16, 42, 314: n = A,T,C or G
tcgcgcgcctgcaggncgacactagtggatccaaagaatttngcacgagcgaaaaaaaggagcctggatttctcaaagacctcaggaaatgttcccttgtctcaatagaaggctgacagagctatcttcgagaacatgttaaactcaaagagtaagtagtaaccccagcctccagaaagttatgatttgagttgacttgtctgatttgacagacatgccattccatgggattatcctatgggcaaatgtcctgagacactgctggagcaatctgctcctttttcattttcaaatccagtcaccaaacctagttnatgata

SEQ ID NO: 6331 - DNA, 101 bp, Homo sapiens
  misc_feature 8, 19, 36, 47, 56, 88: n = A,T,C or G
cttgcacngcgacactagnggattcaaagaattttncacgagggaanagtggagantactggattgaccccaaccaaggctgccaacntggatgccttcaa

SEQ ID NO: 6332 - DNA, 209 bp, Homo sapiens
  misc_feature 122, 167, 180, 182: n = A,T,C or G
agcgaacaaagctgaccctcactggcctggcctcagggttaagcacatacaggacaatggaaccttttatacctccaagagtgacttatcatataactcccatgtgtctatagactaaaaangtctctgtcgctttggggcctttgggagttgtattacaaagggcnccctgcctttgtngngcaaaatcaatacgtatccgcctctac

SEQ ID NO: 6333 - DNA, 104 bp, Homo sapiens
  misc_feature 10, 16, 44, 48, 52, 55, 74, 76, 79, 88, 95: n = A,T,C or G
ggcgcttgcnggtcgncactagtggattcaaagaattcttttcnagcngaangcnaagaaaggaagctcctgcncntcntaaagctgnagccacnagcgaaggc

SEQ ID NO: 6334 - DNA, 140 bp, Homo sapiens
  misc_feature 45, 55, 62, 73, 82, 89, 96, 113, 128: n = A,T,C or G
acaatttcaatccaccctaattctgttactgtgtgcttggttcancaatcactgngatcctnctggccgggancaagatccngagaacnaaactantagtgactgtgtagatnaaaaggcaatgaatnctgcttttaagg

SEQ ID NO: 6335 - DNA, 114 bp, Homo sapiens
  misc_feature 14, 27, 37, 39, 43, 50, 52, 60, 65, 95, 106: n = A,T,C or G
gcgcttgcacgccnacactagtggatncaaagaattntncacnacagtgncngagtgagnttctngggggcccagcttcctccataggtggcagnaatggcccggntactaggg

SEQ ID NO: 6336 - DNA, 140 bp, Homo sapiens
  misc_feature 2, 16, 40, 54, 55, 64, 96, 116, 121, 140: n = A,T,C or G
gnacgagcgcaggagnagcccagaataaactgtgcctganacctaccctatttnngtatttttnccagttttaaggaaataaatcccctttattgnatactcagttagaatcaatnatttntatctctttgggattgggn

SEQ ID NO: 6337 - DNA, 195 bp, Homo sapiens
  misc_feature 2, 5, 31, 34, 50, 51, 54, 90, 114, 130, 133, 166, 169, 173: n = A,T,C or G
cntgnatccacacccccctactgccgttatngcngtttaactggcgactnnggnattgagctctgcccttgtcctgcctccggggagggngagccagtcaaggaggtgagggtnagagccaccctgccanatntggaggactactccccgtgtgcactacccccanagnctgnaccgcagatctttcccatgggg

SEQ ID NO: 6338 - DNA, 110 bp, Homo sapiens
  misc_feature 24, 92, 101: n = A,T,C or G
actagtggattcaaagaattcttnacgagggagcttgaaaaaatgcagactggacaaacgcttacacaaaaaaaaactgggaactggcttangatctgagnttacttttc

SEQ ID NO: 6339 - DNA, 140 bp, Homo sapiens
  misc_feature 5, 25, 30, 42, 44, 56, 70, 92, 104, 109, 118, 127: n = A,T,C or G
cgggngcttgcagggccacactagnggatncaaagaattctntncgagcgcatgtncatttgtatttttntattgaaaatctactcactaanacaaaaggatcngaggntttggacancatactagncctaacagtaaag

SEQ ID NO: 6340 - DNA, 104 bp, Homo sapiens
  misc_feature 15, 24, 35, 38, 41, 53, 63, 75, 76, 79, 85: n = A,T,C or G
aaaagtggggagggncaagggatnctgggaagctnganccncccccaaagcantgtgagtccnagagcccgcttnngtncttccncacaattccattactaaga

SEQ ID NO: 6341 - DNA, 101 bp, Homo sapiens
  misc_feature 7, 21, 39, 48, 65, 75: n = A,T,C or G
cgtcagngaagttcatgaganatgaataacataattggnggttgggtnaatcactaccagtctanactagcccanacgcctcaattagagggggctggctt

SEQ ID NO: 6342 - DNA, 178 bp, Homo sapiens
  misc_feature 26, 33, 52, 55, 80, 82, 85, 108, 130, 151, 152, 171: n = A,T,C or G
tcacgagccactgagccaccctaccnccctaanagatatgagagaaattgtnaangaagtcagcacttacattaagaaantnggntacaaccccgacacagtagcatntgtgccaatttctggttggaanggtgacaacatgctggagccnngtgctaacatgccttggtncaaggga

SEQ ID NO: 6343 - DNA, 141 bp, Homo sapiens
  misc_feature 13, 15, 30, 33, 37, 43, 45, 47, 50, 55, 79, 84, 96, 111,122, 139: n = A,T,C or G
agcctcacgaaananaaaaaaccaggatanaanattntatgcnantnccngggangaagacataaagacatagcacatnacatncacagatggcanaaacacaggaggaanagcaggtttgnagaatacaagaatgaanat

SEQ ID NO: 6344 - DNA, 145 bp, Homo sapiens
  misc_feature 24, 38, 58, 72, 83, 88, 90, 122, 127, 129: n = A,T,C or G
tcgagggctcgagggcccaagaancctctgaagcgggnggcacgctccaaagcattgnatgctggataaatngaccggtgggncggcncntcggccatccaccggtccccacaagttgaganagtgncnccccctcatcattttc

SEQ ID NO: 6345 - DNA, 460 bp, Homo sapiens
  misc_feature 350: n = A,T,C or G
agtggatccaaagaattcggcacgagcgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagcccggaggtggcaattcaccgaattcgaatcaccctaacaagccgcaacgtaaaatccttggaaaaggtgtgtgcctgacttgataagaggcgcaaaagaaaagaatctcaaagtgaaaggaccagttcgaatgcctaccaagactttgagaatcactacaagaaaaactccttgtggnggaaggttctaagacgtgggatcgtttccagatgagaattcacaagcgactcattgacttgcacagtccttctgagattgttaagcagattacttccatcagtattgagc

SEQ ID NO: 6346 - DNA, 328 bp, Homo sapiens
  misc_feature 11, 14, 41, 79, 113, 122, 197, 273, 301: n = A,T,C or G
agcaggcgcanccnagcctcgaaatgcagaacgacgccggngagttcgtggacctgtacgtgccgcggaaatgctccgntagcaatcgcatcatcggtgccaaggaccacgcntccatccanatgaacgtggccgaggttgacaaggtcacaggcaggtttaatggccagtttaaaacttatgctatctgcggggcnattcgtaggatgggtgagtcagatgattccattctccgattggccaaggccgatggcctcgtctcaaagaactttngactggagagaatcacagatgtggaatntttgtcataaataaataatgaaaacct

SEQ ID NO: 6347 - DNA, 178 bp, Homo sapiens
  misc_feature 8, 15, 22, 26, 31, 35, 40, 46, 47, 50, 56, 59, 60, 64, 70,89, 94, 98, 128, 137, 147: n = A,T,C or G
cgcctctnatgctgncatgtgnctgnccgtncacncattnacaganngangcctgnatnncagncataantttatatttaaaagtgtcngattntatncatgcaagacagctgcacttatatcgtttnctaaatcantgccatctanaggttcaaaagttaaaaatacggaaatatac

SEQ ID NO: 6348 - DNA, 439 bp, Homo sapiens
  misc_feature 17, 155, 247: n = A,T,C or G
gtttttaaccttgaccntgtattatgtttataattaaaaacccaaagaaccagctcatgtttggaaaaggaatcttccactgaaacatttggatacccgacgttctccctggacacttggcccggcaatagttggggtctcctgggaagctgagngctggcttctagcctctccagttccctcagactctgtcttcagctcgggcccctccgttctgtctccctcgactccaagtcaggaataccgngggcttcctgccctcaccccacacctcaagaccatcccactgcttgcctgcttgccccctgccatctcgcactcagccctgggtgcctgtgaagcctggccccactgcctgcccggggggttccttgcagcacccccctactccaggctccccatctccctgaagcttccagggtagcagcttggtgggaca

SEQ ID NO: 6349 - DNA, 437 bp, Homo sapiens
  misc_feature 75, 166, 292: n = A,T,C or G
tgacagacgacagctttgataagaatgttctggacagtgaagatgtttggatggttgagttctatgctccttggngtggacactgcaaaaacctagagccagagtgggctgccgcagcttcagaagtaaaagagcagacgaaaggaaaagtgaaactggcagctgnggatgctacagtcaatcaggttctggcctcccgatacgggattagaggatttcctacaatcaagatatttcagaaaggcgagtctcctgtggattatgacggtgggcggacaagatccgacatcgngtcccgggcccttgatttgttttctgataacgccccacctcctgagctgcttgagattatcaacgaggacattgccaagaggacgtgtgaggagcaccagctctgtgttgtggcttgtgctgccccatatccttgatactggagc

SEQ ID NO: 6350 - DNA, 404 bp, Homo sapiens
  misc_feature 207: n = A,T,C or G
gaaaaggtcccggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatganatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgcttgaaatccggcatgttcttgtcacacttgggtgagaagatgacagagggaaga

SEQ ID NO: 6351 - DNA, 457 bp, Homo sapiens
  misc_feature 424: n = A,T,C or G
tactggagtgcagcagggaaggggaaatgtgtagtgactgaaaatccaggagggtagtgtgtaggcacctggcctctgcagctacatctcctgcaccccgatcaaatcttcccgtagtcaggagggacttcccgttctggggtaaaggtaagcagaagatccccaccagtcctcaccgccatcacaaacacctacagtccttaccacaggagaatcccatagtcctagcaagccctaagtcaaggtggacagctgctgggaattcaagcagttgcattgctccagatcatgagaataaggtatgcactctccaaccctcacccacctgtaggccaacctgccctgctgcagcatggcaccattgaggccagagccacctctgttgtgcgccccgctctgtgggccagtagtcactgcacctttncagtactaggggtccatcttcattccaccaagc

SEQ ID NO: 6352 - DNA, 264 bp, Homo sapiens
  misc_feature 19, 26, 48, 100, 167, 219, 228, 261, 263: n = A,T,C or G
cggcacgagctcgaacctntgatctnaagtgatccacctgccttaggntcccaaagtgctggaattacaggcataagccgccacacccagctgaaatttntcattgttggattgcatatggaacgataagctggtgggatacaataggtgtcaagggggcggaggtnctataatcctatgagctaaaatacatttagccataaaataatgtttaattgntatcaaatnctttagttccctgacatgttcctatttagcatntnt

SEQ ID NO: 6353 - DNA, 375 bp, Homo sapiens
  misc_feature 200, 291, 322, 335, 371: n = A,T,C or G
ccccaaccaaggctgcaacctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccagttcgagtatggcggccagggctccnaccctgccgatgtggccatccagctgaccttcctgcgcctgatgtccaccgaggcctcccagaacatcacctaccactgcaagaacagcgnggcctacatggaccagcagactggcaacctnaagaaggccctgntcctccagggctccaacgagatcgagatccgcgccngagg

SEQ ID NO: 6354 - DNA, 224 bp, Homo sapiens
  misc_feature 155, 205: n = A,T,C or G
agaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtnaaggtgctcctcttttttcttgtcattgctggacaagattactaatattngggaaggctttaaagcacc

SEQ ID NO: 6355 - DNA, 209 bp, Homo sapiens
  misc_feature 8: n = A,T,C or G
cacaagcncaaactttacacatttgtacaattttgaaatgcactacaataaacaaattagagcaacacatttgaaatacaggcttctttacataaactgagaggttatacaaaactcagtttcacaagggaacaatctatacctttctaaaagttaatatttcaagtctctaataggcagaatattttactctttaaaatcctgccttt

SEQ ID NO: 6356 - DNA, 263 bp, Homo sapiens
  misc_feature 20, 28, 37, 133: n = A,T,C or G
agcccgctgggccaacttcnatcattcnagctagaanagcttccccctgacacccctgtgactgagcctgtgtcctgtctgcctgcccagcccatgctccatcggctgtgagggcagtgcccggagaggccanagggttggagctgcagggacccgtttggacccacagcctctgttctagagatgcttgtataggctgttaattgtgatgaataaacgttcaaccctcggcctgcagccagagtagccaggccgcgcacccc

SEQ ID NO: 6357 - DNA, 182 bp, Homo sapiens
  misc_feature 3, 6, 7, 8, 19, 25, 28, 37, 41, 51, 52, 55, 67, 73, 86, 88,108, 122, 144, 149, 161: n = A,T,C or G
ccnagnnncctctgatganatcttntcnctgtgttgntttnactgataaannagnccactcaatggntgcctngatgaccctgtgncngaagagggcaatgatggtanctgccaggccacantccacccaggactgctcttctnacctnccaccttagggncaccagaagaattcaagaagc

SEQ ID NO: 6358 - DNA, 350 bp, Homo sapiens
  misc_feature 152, 314: n = A,T,C or G
cttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggnagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggntggcttggattcagtaataaatattgtaaggccttt

SEQ ID NO: 6359 - DNA, 397 bp, Homo sapiens
  misc_feature 252, 262: n = A,T,C or G
caaatacataggtatgtagtatgccagtgggccacatgacacagaagaataaaataggctaagtggtcagaatgagagtgagccatggttcttccacagcacggttagagaaggcattctaagatggtaacacttgagcagagataaggatatgagggagaaggttatttaatatttggaaaaatagttatttaatatttgaaaaaagatggaattccagttgcaatggctctcagtcaggagcgtgcttgncttggagcancaggggaggtcgatgtggctaggtcaggaaagcactgctgggctggtctgagtggcccagtagaagagtagtcaaagaccagatcgtaaagagacttatgggccatgataaggttttggcttttattctgtgaga

SEQ ID NO: 6360 - DNA, 418 bp, Homo sapiens
  misc_feature 14, 22, 170, 199, 212: n = A,T,C or G
gtattgttcccagngacacttnggagagctggtagttagtagcatgttgagccaggcctgggtctgtgtctcttttctctttctccttagtcttctcatagcattaactaatctattgggttcattattggaattaacctggtgctggatattttcaaattgtatctagngcagctgattttaacaataactactgtgntcctggcaatagngtgttctgattagaaatgaccaatattatactaagaaaagatacgactttattttctggtagatagaaataaatagctatatccatgtactgtagttcttcttcaacatcaatgttcattgtaatgttactgatcatgcattgttgaggtggtctgaatgttctgacattaacagttttccatgaaaacgttttattgtgttttta

SEQ ID NO: 6361 - DNA, 462 bp, Homo sapiens
  misc_feature 326: n = A,T,C or G
ctgggacaccgtcaagtgaacaaatgttatgtagttaaagaagaaaaggaaatgggaaaagacatagaaaacgtatttaatgaaataataaccaaaaaattccaagccttgggagaaatatggtcatccagattcaaaaagagaatctgtgattcaacccaaaaaggccctctctgaggcaagtcatagtcaaattccaaaaagtcaaagacagaattataaaaacaacaaagaaaagcatcaagtcatatgcaaggaaatatccattagactaacaacagctttctcagcacgacacttacaggtcagtagaaaatgggataatntatttaaagtgctgaaagaaaaaaaactcagccaagaatactatgatcagcaaagctatcattcatatatgaaggagaattaaagttttttagacaagcgaaaactgaggaaattcatcaccactagactagcctt

SEQ ID NO: 6362 - DNA, 320 bp, Homo sapiens
  misc_feature 250, 270: n = A,T,C or G
gaccttttgaccaactccctgtcattcctaacctaaccttagagtccctcccccaatgcaggccacttctcctccctcctctctaaatgtagtcccctctcctccatctaaaggcaacattccttacccattagtctcagaaattgtcttaagcaacagccccaaatgctggctgcccccagccaagcattggggccgccatcctgcctggcactggctgatgggcacctctgttggttccatcagccanagctctgccaaaggccccgnagtccctctcccaggaggaccctagaggcaattaaatgatgtcctgttcc

SEQ ID NO: 6363 - DNA, 388 bp, Homo sapiens
  misc_feature 103, 373: n = A,T,C or G
tctcaatcaagttgattggaatgcctggctctactctcctggactgcctcccataaagcccaattatgatatgactctgacaaatgcttgtattgccttaagncaaagatggattactgccaaagaagatgatttaaattcattcaatgccacagacctgaaggatctctcttctcatcaattgaatgagtttttagcacagacgctccagagggcacctcttccattggggcacataaagcgaatgcaagaggtgtacaacttcaatgccattaacaattctgaaatacgattcagatggctgcggctctgcattcaatccaagtgggaggacgcaattcctttggcgctaaagatggcaactgaacaaggnagaatggaagtttac

SEQ ID NO: 6364 - DNA, 500 bp, Homo sapiens
  misc_feature 16, 20, 42, 44, 45, 52, 85, 117, 190, 311, 350: n = A,T,C or G
cctggagcctccgggngccntgcaggtcgacacctagtggantnncaaaganttcggcaccgagggcaactactactaagtaacnttctagtagcacttgcctgagagacaaattanttgtttgataattttcattgtgaataggaatccaatagatcatattgcttactttgttctttttatactatanaataatattttgttctctagtatatcaaaataccaaaatattatctcatattttctccctctttctcttactcttaccaagttttcctggtggcttggcttccctgactaaagaattaagnctcatttttactttccatttctattttcttaccacttgnctggctccctttgtctctgtacctttaccaacattaggatctcacctctttcttcctcccttaattcataagcaccactcctatcaaagtcccatctcttaaccctgggatcaaacaaactgtgagttttccagaatctgtttcccagtt

SEQ ID NO: 6365 - DNA, 434 bp, Homo sapiens
  misc_feature 50, 60, 109, 228, 231, 244, 309: n = A,T,C or G
caccgcaaatgcttctaaacggactcagcagatgcgtagcatttgctgcntgggttaatngagaatagaaatttgcccctggcaaatgcacacacctcatgctagcctnacgaaactggaataagccttcgaaaagaaattgtccttgaagcttgtatctgatatcagcactggattgtagaacttgttgctgattttgaccttgtgttgaagttaactgttcccctnggnattaacgtgtcanggctgagtgttctgggatttctctagaggctggcaagaaccagttgttttgtcttgcgggtctgncaagggttggaaagtccaagccgtaagacccagtttcctttcttagctgatgtctttggccagaacaccgggggctgttacttgctttgagttggaagcgggttgcatttacgcctgtaaatgta

SEQ ID NO: 6366 - DNA, 153 bp, Homo sapiens
  misc_feature 108, 130, 136: n = A,T,C or G
ggaaaatggtgaagaaaattgaaatctgccagcacgccaagtacacttgctctttctgtggcaaaaccaagatgaagagacgagctgtggggatctggcacttgtggntcctgcatgaagacagtggctnggcggngccttggacgtacaata

SEQ ID NO: 6367 - DNA, 435 bp, Homo sapiens
  misc_feature 39, 147, 324, 432: n = A,T,C or G
gctgagggcaacagcaggttcacttacactgttcttgtngatggctgctctaaaaagacaaatgaatggggaaagacaatcattgaatacaaaacaaataagccatcacgcctgcccttccttgatattgcacctttggacatcggnggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaatngtgggcaaaagagaaaaagaaggattgatcaggagcattgtgcaatacagtttcattaactccttcccccgctcccccaaaaatttgaatttttttttcaacactctnaca

SEQ ID NO: 6368 - DNA, 233 bp, Homo sapiens
  misc_feature 115: n = A,T,C or G
gagacagagaggggaagggagagagagacagagaggggaagggagagagagacagagaggggaagggagagagagacagggagagagctagaaagataaagagaggggccgggcncggtggctcacacctgtaattccagcactttgagaggatgaggcaggtggatcgcctgaggtcaggagttcgagaccagcctggcccactggtgaagccctgtctctactaaaaatac

SEQ ID NO: 6369 - DNA, 276 bp, Homo sapiens
  misc_feature 20, 84, 114, 132, 153, 165, 173, 204, 219, 233, 273: n = A,T,C or G
ttaggctcttcttgcgttgntacaaaccaacacctgagactgcgtaatttattttttaaaaaagatttaattggccctgcgggntgtataagcctggttccaacatctgctcancttctggggaagcctcanggaatatttactcatgggggnagacgaagtggnaacagacncatcacatggtgaaagcaagaacaagagagngagtgggaggtgccncacacttggaaacnaccaaatctcatgagaactcattcacaattacaaggatancac

SEQ ID NO: 6370 - DNA, 433 bp, Homo sapiens
  misc_feature 56, 167, 224: n = A,T,C or G
caggccccagaggacctgttggacccagtggacctcctggcaaagatggaaccagnggacatccaggtcccattggaccaccagggcctcgaggtaacagaggtgaaagaggatctgagggctccccaggccacccagggcaaccaggccctcctggacctcctggngcccctggtccttgctgtggtggtgttggagccgctgccattgctgggattggaggngaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttga

SEQ ID NO: 6371 - DNA, 234 bp, Homo sapiens
  misc_feature 87: n = A,T,C or G
tgaagacgtcattgcccagggtattggcaagcttgccagtgtacctgctggtggggctgtagccgtctctgctgccccaggctctgnagcccctgctgctggttctgcccctgctgcagcggaggagaagaaagatgagaagaaggaggagtctgaagagtcagatgatgacatgggatttggcctttttgattaaattcctgctcccctgcaaataaagcctttttacacatc

SEQ ID NO: 6372 - DNA, 100 bp, Homo sapiens
  misc_feature 16, 28, 71: n = A,T,C or G
aaaagctggagctcgngcgcttgcgggncgacactagtggattcaaagaattcggcacgagaggtcgcggngacatggccaaacgtaccaagaaagtcgg

SEQ ID NO: 6373 - DNA, 102 bp, Homo sapiens
  misc_feature 42: n = A,T,C or G
gtcgacactagtggattcaaagaattcggcacgagccacccnactcttaatctctggtggaagaacggactaacaactgtttgtttgaattggccatttaag

SEQ ID NO: 6374 - DNA, 179 bp, Homo sapiens
  misc_feature 17, 59, 69, 93, 94, 102, 128: n = A,T,C or G
aaaaagctggagctcgngcgcttgcgggtcgacactagtggattcaaagaattcggcangaggccaagnggaggaagaagcgaatgcgcaggnngaagcgcngaagaagaaagatgaggcaggaggtncaagtgaaccgctagcttgttgcaccgtggaggccacaggagcacaaacat

SEQ ID NO: 6375 - DNA, 104 bp, Homo sapiens
  misc_feature 11, 17, 27, 34: n = A,T,C or G
ctggagctcgngcgccntgcgggtcgncactagnggattcaaagaattcggcacgagctcgcgcccaattcggcacgagtgcacaactacgcatggtctgaagg

SEQ ID NO: 6376 - DNA, 134 bp, Homo sapiens
  misc_feature 6, 10, 28, 48, 64, 70, 77, 81, 95, 99, 102: n = A,T,C or G
gcgccntgcnggtcgacactagtggatncaaagaattcggcacgaggncaaaactggacaaggnagcctntcacctncggnagttgatggatgancctncanccccagggagcccggagctctaactcatcatc

SEQ ID NO: 6377 - DNA, 116 bp, Homo sapiens
  misc_feature 2, 7, 8, 13, 15, 32: n = A,T,C or G
cntattnngcacnanaaatcattgcctgatcnaatataatgaactctgcagatttgacttggtgccttttccaggcatctgggctaggggcctggaagatcaagagggcacagggg

SEQ ID NO: 6378 - DNA, 111 bp, Homo sapiens
  misc_feature 16, 17, 29, 57, 67, 79, 90, 96, 100: n = A,T,C or G
aaaaagctggagctcnngcgcttgcgggncgacactagtggattcaaagaattcggnacgagcgccntgacccgcgganaccagcgtganctcgcncgcnagaagaatatg

SEQ ID NO: 6379 - DNA, 111 bp, Homo sapiens
  misc_feature 6, 13, 51, 58, 61, 65, 98, 104: n = A,T,C or G
gcgccntgcgggncgacactagtggattcaaagaattcggcacgagcttgnctcctgnggnggcntgctgggaacgggacttctaaaaggaactatgnctgganggctggg

SEQ ID NO: 6380 - DNA, 100 bp, Homo sapiens
  misc_feature 17, 22, 29, 44, 67, 69, 71, 80, 84, 85, 90: n = A,T,C or G
aaaaagctggagctcgngcgcntgcgggncgacactagtggatncaaagaattcggcacgagcggcncnanctgacctgntganngcagntatcttacag

SEQ ID NO: 6381 - DNA, 128 bp, Homo sapiens
  misc_feature 15, 19, 38, 46, 48, 51, 55, 57, 75, 84, 86, 114, 118, 121: n = A,T,C or G
cgacactagtggatncaangaattcggcacgaggccantgtgcagngngantttntngatcttcagctacatttncggctttgngngaaaccttaccatctaacacgatggccngcancgntaccaac

SEQ ID NO: 6382 - DNA, 102 bp, Homo sapiens
  misc_feature 3, 28, 30, 31, 34, 37, 47, 48, 55, 73, 79, 86, 88, 91, 93: n = A,T,C or G
cgngatcaagcaggctgactatgtgccnanngancangacctgcttnnctgccgngttctgacttctggaatntttganaccaagntncangnggacaaagg

SEQ ID NO: 6383 - DNA, 336 bp, Homo sapiens
cggacccttgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcgg

SEQ ID NO: 6384 - DNA, 334 bp, Homo sapiens
gccgcaagaaccccgcccgcacctgccgtgacctcaagatgtgccactctgactggaagagtggagagtactggattgaccccaaccaaggctgcaacctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccagttcgagtatggcggccagggctccgaccctgccgatgtggccatccagctgaccttcctgcgcctgatgtccaccgaggc

SEQ ID NO: 6385 - DNA, 339 bp, Homo sapiens
ctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttc

SEQ ID NO: 6386 - DNA, 336 bp, Homo sapiens
aacccggacagtggtgaaatacacgaggtgtttccattacacacacagggaaggccagggcctaatgaaaactccccgccaaggagaagctctgtggggtcccggctgcctctttcatgacaaagacagcctgagaagcacagagggctcaccactggctctgccacttcctggctgaggggccctgaccaagtctttgaagtctctgcacctcagtttccgtgttagtacaacaagcgtgattcatgcacgtgcttggagggctgcagttagaataagaaatcccacacaggaagctctgctgtgtggctgggatcccggaagtaacaggcttgt

SEQ ID NO: 6387 - DNA, 204 bp, Homo sapiens
  misc_feature 171, 172, 201: n = A,T,C or G
ctatgaagcagcccaagaactactggatggaaacttaagcgttgttgatgatattccagaattcaaagacttgggtgagaagagcagacaagccaagctggaggagttggtgtgggcaattggaaagctgaccgacatagcctcgccttgtagaactaaacggagacgggnnggggggccctggacttggaaggggggaanagg

SEQ ID NO: 6388 - DNA, 267 bp, Homo sapiens
  misc_feature 1, 2, 3, 6, 9, 10, 13, 126, 186, 212: n = A,T,C or G
nnntanggnngancccaactataatacttataaccccagctgtggtctctgagagactgaagattcgaggctccctggccagggcagcccttcaggagctccttagtaaaggacttatcaaactgntttcaaagcacagagctcaagtaatttacaccagaaataccaagggtggagatgctccanctgctggtgaagatgcatgaataggnccaaccagctgtacatttggaaaaataaaactttattaaatcaaaaaaaaaaaaa

SEQ ID NO: 6389 - DNA, 340 bp, Homo sapiens
  misc_feature 270: n = A,T,C or G
tttaaaagcatagtctctagacacagagtatcagaatttgcattttggatctaatacaaattaatactaatctaatactaattaatactaatttaccatgagcaaattatttaacctttctgtgcttcactgtcttgacctctaaggtgaggattataatggtaccttttttataatttttgtgaagattaaacgagttgatatctttgacacactgaaaatgcggtaagctctataaatgtttgctactgttattatgatcaatgtggngtgtctagtttatgcttacactaagtagccttttgtggtcccagcattatggatggtcggctattgggtt

SEQ ID NO: 6390 - DNA, 335 bp, Homo sapiens
  misc_feature 64: n = A,T,C or G
gtgaaggggggcaaaaaaaagaagcaagttctgaagttcactcttgattgcacccaccctgtanaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccagga

SEQ ID NO: 6391 - DNA, 314 bp, Homo sapiens
  misc_feature 27: n = A,T,C or G
cccaggttcaagcgattctcctgtctnagccttccgagtagctgggattacaggtgcccgccaccacgcctggctgatttctgtatttttagtagagatgaggtttcaccatgttggccaggctagtctcgaacatctgacctcaggtgatccacccgcctcggtctcccacagtgctaggattacaggcatgagccactgcacccagcctatttttaattctctaataggtaaaatcactgatctgtatttcattggaattgggttctggagatttcttcatcttttgtttggaacgtattttctatttcttg

SEQ ID NO: 6392 - DNA, 350 bp, Homo sapiens
tcgcacttgagcttgttaaagcaggtttggcattagcactctttggaggaagccagaaatacgcagatgacaaaaacagaattccaattcggggagacccccacatccttgttgttggagatccgggcctaggaaaaagtcaaatgctacaggcagcgtgcaatgttgccccacgtggcgtgtatgtttgtggtaacaccacgaccacctctggtctgacggtaactctttcaaaagatagttcctctggagattttgctttggaagctggtgccctggtacttggtgatcaaggtatttgtggaatcgatgaatttgataagatggggaatcaacatcaagccttgttg

SEQ ID NO: 6393 - DNA, 335 bp, Homo sapiens
cccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcattt

SEQ ID NO: 6394 - DNA, 115 bp, Homo sapiens
  misc_feature 12, 15, 27, 28, 33, 56, 57, 59, 71, 75, 77, 88, 89, 99, 107,110: n = A,T,C or G
atacatattganatntatgtttatganntcatnaaccacatagcccattctcagtnnanaaattcattgtngganantatgatcaggnnagatatggtntacggggnttnaaaca

SEQ ID NO: 6395 - DNA, 286 bp, Homo sapiens
  misc_feature 196, 213, 257, 276: n = A,T,C or G
ccagctgcagctttccgccgcttgggcgccttgtccggagctgcggccttaggcttcgcttcctacggggcgcacggcgcccaattcccagatgcctacgggaaggagctgtttgacaaggccaacaaacaccacttcttacacagcctggccctgttagggggtgccccattgcagaaagccactctgggctggnttattgctagcttccgnaacgaccttattctgcaccagctttttactaccaggctctgagnggagacccccagcatccanactttggccc

SEQ ID NO: 6396 - DNA, 117 bp, Homo sapiens
  misc_feature 24, 51: n = A,T,C or G
cacttagctactctcttgctagangctccttgctcagcattactaactacnaaatacactgtaaaaattacactgtatatggctatatttttaatttgctggctacctggaaaaaaa

SEQ ID NO: 6397 - DNA, 190 bp, Homo sapiens
ctttagtgtgctatacctatgtgtcttatcgtgggccactgtgccaataaacaaaaacaactgtttggtttacctcagttgcagtagttattttcatttagaagttgttctcagattattgtttcagttatataggaggattactagactagttatgaagaaaccccactacattcaatggaattggggc

SEQ ID NO: 6398 - DNA, 334 bp, Homo sapiens
ggctgccgtgctgctcggcggcgctgaggccaaatagttgcatcacatgtatctaatccgagagtctcatgcttctggtagctcctcagtgaccagctcctgctcactgccctcagaaagcccaaccctcaggcaatggcggccttgttcctgtctgccccaccccaggccgaggtgaccttcgaggacgtggctgtgtacctctcccgggaggaatggggccgcctgggccctgctcagaggggcctctacagggacgtgatgcttggagacctacgggaacctagtctcactggctcttgggaccagaactgagtacaaggagttgacttca

SEQ ID NO: 6399 - DNA, 335 bp, Homo sapiens
  misc_feature 303, 305: n = A,T,C or G
gaaagccacacttattcttttcagtaacctgctagtgcacaggctgtactttaggtacttaaaatatgcactagaataaatttgcaaggccctaaaatatcactgttatttttggagtaattcagtataggttcgtttaaaagagatttttataacttcagacatgcatcagtaggaaataacttgagaaattcatatggttatgttacaaattcatattctgttactacagtaaacgttaagagttttaaacagttaagattgtacaatttttcttcttttctatattacaagggccccagngntaatgtcttagattttcagtatttgaactt

SEQ ID NO: 6400 - DNA, 159 bp, Homo sapiens
  misc_feature 104: n = A,T,C or G
tcaagcccgagatgatcggccactacctgggcgagttctccatcacctacaagcccgtaaagcatggccggcccggcatcggggccacccactcctcccgcttnatccctctcaagtaatggctcagcaatgaaataaatacttgtagaatgttcaaaa

SEQ ID NO: 6401 - DNA, 242 bp, Homo sapiens
gtttgagacacaattctttctcaaaggagtcagctaagctgggtctacttatggacaaacatctaaatgtgtggaagtatctgatatttgacaatggtaaatttccacttagctagctagcattgtcagacttcaatctcctcatggctctggccgtcctgttttaagcatgataattgttggccacatctcacatagttctcattgagtgagttcataaataaacagggtttttttttttt

SEQ ID NO: 6402 - DNA, 330 bp, Homo sapiens
gaacagaaacgagatctccatgatcaattccagcatcagctcaggtgctccaatgacagcttttctgtgattgctgactactttggcagaggtgttttcaacaaattgactctgctgaccgaccctcccacagccagactgacctccagcctggaggctgggctgcaacgcgacctactcatgcactccaggaggggcacttaagcagcctggaggaagatgtgggcaacagtggaggaccgagagaacagacacaatgggacctgggcgggcgttacacagaaggctggctgacatgcccagggctccactctcatctaatgtcacagc

SEQ ID NO: 6403 - DNA, 100 bp, Homo sapiens
  misc_feature 1, 3, 5, 6, 10, 15, 19, 28, 66, 67, 73: n = A,T,C or G
ngntnnaaangggantatnacagtaganctctatgaatgtcatgagccctaactttcaggctttgnnttttgnatatgggaagaaatatgacaatcctag

SEQ ID NO: 6404 - DNA, 211 bp, Homo sapiens
  misc_feature 211: n = A,T,C or G
tttatggttccaaggtcctgatacttatcagctttaaaaaaatcgttttcatttttaggtagttttcttgcttttgggcaccaggtggcgatatggagtgaggtggggagtgcatgggatacacaggttgggttgtcataaagaccaagcatctgtagagccgaactgatgagatttaatattccgtctctctctctctctctctctctcn

SEQ ID NO: 6405 - DNA, 159 bp, Homo sapiens
  misc_feature 5, 50: n = A,T,C or G
gaaanctggagctcgcgcgcctgcaggtcgacactagtggatccaaaganttcgacgagtataaatttactttctcaaattcttgccatgagaggttgatgagttaattaaaggagaagattcctaaaatttgagagacaaaataaatggaacacatga

SEQ ID NO: 6406 - DNA, 329 bp, Homo sapiens
gtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatc

SEQ ID NO: 6407 - DNA, 158 bp, Homo sapiens
  misc_feature 2, 3, 7, 18, 22, 35, 49, 94, 95, 100: n = A,T,C or G
cnnaaanttgtcacagantttngagacccattaanccagttaaatgggnaaatgagaaaaaaaaaaaaaaaaaaaaaaaaaaaaaaaaaaaaannccccnaaaaccaaaaaaaaaaaaaaaaaaaaaaaaaaaaaaaaaaaaaaaaaaaaaaaaaaaa

SEQ ID NO: 6408 - DNA, 334 bp, Homo sapiens
  misc_feature 223: n = A,T,C or G
tcaagacggaggacctgctggcaacgttttctgagttccaagagaaggggttcaggattcagtgggtggatgatactcacgcactcggcatctttccctgccgggcctcagctgcggaagccctgacccgggagttctcggtgctcaagatccggcccctcacgcagggaaccaagcagtcaaagctcaaagccttgcagaggccaaaactcctgcgtctggngaaggagaggccacagacaaatgcgactgtggcccggcggctggtggcccgggccctgggactccaacacaaaaagaaagagcggcctgctgtccggggtccgctgccgcc

SEQ ID NO: 6409 - DNA, 336 bp, Homo sapiens
ggcagttgtcatacctatattatggcactgttttgaagaagaaatgaggtaatgcctaaaagtgtttaacatagtcactggcacagagaagatacttaataaatgttgatttccttcttgttcagcaaaaccttaaggcagaaagctcctaaggcatgattatatatttcattctttcagtagcatttgccaaacatttttaccatattgttgctaagtaggtaaaacagaaagacacatatctaaatatgcagagacatattttgtaatggaggtaccactctgtttttgtaaggcgttgctgattctcacttcgcttctgcatctctgaatatg

SEQ ID NO: 6410 - DNA, 275 bp, Homo sapiens
  misc_feature 274: n = A,T,C or G
gcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttggtgng

SEQ ID NO: 6411 - DNA, 100 bp, Homo sapiens
  misc_feature 2, 4, 5, 15, 24, 25, 27, 40, 43, 49, 61, 76, 79, 94, 98: n = A,T,C or G
angnnaactccctgngaccttggnngntggacattcccangtntggctncgacattttagnctgtgacatggcgangtnaaatcattttgtctngatntt

SEQ ID NO: 6412 - DNA, 100 bp, Homo sapiens
  misc_feature 15, 20, 34, 39, 48, 50, 57, 60, 70, 71, 73, 84: n = A,T,C or G
tttgtattacaattnactgnttccactgggggantcaangatctcggntngagcgtnacnagcgctctannanaccttaggtancctgtacaagacgtac

SEQ ID NO: 6413 - DNA, 100 bp, Homo sapiens
  misc_feature 5, 16, 33, 50, 77, 83, 92, 94: n = A,T,C or G
ctgcngaatattgganaacatgtcacttgaagnctacttgtatctacggnggtgctcctaagggaccacaaatacgngatttngagagaggngnggaaat

SEQ ID NO: 6414 - DNA, 336 bp, Homo sapiens
ctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaagggaaaaagaatgccaaaatcagcagtctcctggaggagcagttccagcagggcaagcttcttgcgtgcatcgcttcaaggccgggacagtgtggccgagcagatggctatgtgctagagggcaaagagttgggagtt

SEQ ID NO: 6415 - DNA, 191 bp, Homo sapiens
gttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaa

SEQ ID NO: 6416 - DNA, 339 bp, Homo sapiens
  misc_feature 330: n = A,T,C or G
ctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtangtgatgctg

SEQ ID NO: 6417 - DNA, 337 bp, Homo sapiens
attagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttattaaggggttccctgctttcacagaattattccagggtttatgtgtcaggggtggtgacttcacacgccataatggcactggtggcaagtccatctatggggagaaattttgaaagatgagaacttcatcctaaagcatacggggtcctggcatcttgtccatggcaaatgctggacccaacacaaa

SEQ ID NO: 6418 - DNA, 119 bp, Homo sapiens
  misc_feature 6, 31, 36, 43, 53, 63, 92, 97, 99: n = A,T,C or G
acattngttaataaaccaatactgatatgcngttgngaagagnggaaatattntaataaaaancattaattggtacaaaatttccggggaanatggnantctaggaaaataaaaaatga

SEQ ID NO: 6419 - DNA, 337 bp, Homo sapiens
taaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggacagggtgcaggcagatgacctggtgaagatgctcttcagcccagaagagatggacctctcccaggagcagcccctggatgcccagcagggcccccccgaacctgcacaagagtctctctcaggcagtgaatc

SEQ ID NO: 6420 - DNA, 331 bp, Homo sapiens
accagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaacta

SEQ ID NO: 6421 - DNA, 338 bp, Homo sapiens
  misc_feature 197, 199, 221: n = A,T,C or G
ggcaggactgcaaacagcaggtcctggctaaaaacccttaatgctgcattgctgccagttgtaaagagatgcctgaatggaggcaagttctgccctgtgggtgaaactgatgatgtactgtactgtcatatataaatccactaaatccagctacctggaactgtggccatgcattttttttttctttaaagaccagngngatagtaggccatgcatctganatacgatattccttggtaactagagggagaaaaaaaaatcaagtaggttcaggcttatgttgtattttgagagtctggttttatttgaacagaaataactctacagaaagctcttgt

SEQ ID NO: 6422 - DNA, 312 bp, Homo sapiens
  misc_feature 2, 8: n = A,T,C or G
antttggntcccatttaccaagttcatatatgggactcgatctcagtataataaaaaaaattactagtaatagtatgaatatatctctcgttttatgcaggactgattttaaatagtgagatatcctgcgcattaaacatgatttatttgagatttgtgggatgtaatttggtgctttcattctcttaaatttattgagaatctagtgattcactggttcatcctttgcctcaggctcatggtcattggagattccaagaaaatgattgaatcagtccctatggatttatttgtatgtgtttttcttttaac

SEQ ID NO: 6423 - DNA, 102 bp, Homo sapiens
  misc_feature 14, 37, 41, 43, 44, 50, 54, 60, 67, 79, 83: n = A,T,C or G
gcgcttgcaggtcnacactagtggattcaaagaattngganannaggccncaanccctgnctctgtnccaagttggggncagntgccctcacttctggggtg

SEQ ID NO: 6424 - DNA, 356 bp, Homo sapiens
gctttattgatagtgatgagattacaaaataacactacatactttttagtttgttgttccttatatagtaccagaatgttttaagcaaagaaagaaattttttgccaaaatttgctgaataaataaaaagtttttaaagaatatccaggacaaataatttatttcaaattccctgagagggcaaattaaatggtctttacccagtgaatgtgctggagggtaaatctttaatattttagattgtttaattcttataattacgaataaaggactgtttggaaaattattctgtaggttttttggcatgaaaagaaatactgaaaagtatttccttttaatgctgccttgtgctggag

SEQ ID NO: 6425 - DNA, 159 bp, Homo sapiens
  misc_feature 124: n = A,T,C or G
gctttggagtcctcttcctgctgctctgggttggcatctacgtgtgagcacccaagggtaacaaccagatggcttcactgaaacctgcttttgtaaattacttttttttactgttgctggaagngtcccacctgctgctcataataaatgcagatgtat

SEQ ID NO: 6426 - DNA, 339 bp, Homo sapiens
gtgcccagggtttatactgggggcgggtcacataggcaccctgtgcttggcagttgccaaattccacagtcccagcttacaggaaagcagatgttcaccataaatcacattgttaatctaaggaaagcaaaacacctttgtcagtatatggaacttttacgaagcttaattcccaagtgccagccaagggtcaaccttataagcaggttcttttttattttatttcatttttataaatagagacagggtcttgctatattatccaggctggtctcgaactcctgtcctcaagaaatcctcctgcctcggtctcacaaagtgctgggattgcaggcgtga

SEQ ID NO: 6427 - DNA, 332 bp, Homo sapiens
  misc_feature 7, 8, 60, 107, 322: n = A,T,C or G
cctgcannagggggcacctcctgccaggtggggagtgtcccaggccgagggaggagccgngcagtggctcaggggcagaaggaggacacctgctgtccagggctcanggagaagtgtggagcaagctgggagggggctctaagacctcctcctctcacccccagggaacctaatgcccctctctggccctgcacccctctactcaggggaaaccagggctcgcctgctgctccaggtgccccgacccagcgatcgggtgcagagctctgcgtttcaggaatgagaggcaggtcttcatgcaagccatatttttgagaatggntctctgttca

SEQ ID NO: 6428 - DNA, 100 bp, Homo sapiens
  misc_feature 13, 28, 44, 66, 73, 79, 87, 95: n = A,T,C or G
aaaaaggctggantctcgggcgcttgcnggtccgacactagtgngattccaaagaattcggacacnagcccgncgatgnggctcttnagggcctnccagc

SEQ ID NO: 6429 - DNA, 315 bp, Homo sapiens
gtggaggagaaagagggaatccccccacaacagcagaggctcatctacagtggcaagcagatgaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtctactggtgggagactgtgaggatcccaggattcagtatt

SEQ ID NO: 6430 - DNA, 308 bp, Homo sapiens
  misc_feature 239: n = A,T,C or G
ccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggaggggagggtgacaagcacaccctgagcaagaaggagctgaaggagctgatccanaaggagctcaccattggctcgaagctgcaggatgctgaaattgcaaggctgatggaagacttggaccgg

SEQ ID NO: 6431 - DNA, 339 bp, Homo sapiens
  misc_feature 177: n = A,T,C or G
atttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggngctttcaaaggagcttgaaggatattgtcagtctttaggggttgggctggatgccgaggtaaaagttctttttgctctaaaagaagaaggaactaggtcaaaaatctgtccgtgacctatcagttattaatttttaaaggatgttgccactggcaaatgtaa

SEQ ID NO: 6432 - DNA, 340 bp, Homo sapiens
ccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatgg

SEQ ID NO: 6433 - DNA, 352 bp, Homo sapiens
  misc_feature 17, 136: n = A,T,C or G
gacaaagaagagaaganagaaagaagaagagaaaaaagaggtgatgcttcagaatggagagacccccaaggacctgaatgatgagaaacagaagaaaaatattaaacaacgtttcatgtttaacattgcagatggnggttttacctgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttctt

SEQ ID NO: 6434 - DNA, 334 bp, Homo sapiens
cagtgactggttactacctgaaccgtgctggctttgaggcctcagacccacgcataattcggctcatctccttagctgcccagaaattcatctcagatattgccaatgatgccctacagcactgcaaaatgaagggcacagcctccggcagctcccggagcaagagcaaggaccgcaagtacactctaaccatggaggacttgacccctgccctcagcgagtatggcatcaatgtgaagaagccgcactacttcacctgagccacccaacctaaatgtacttatctgtccccatgtccccacaccagcctgttttcataataaactttattgtg

SEQ ID NO: 6435 - DNA, 337 bp, Homo sapiens
  misc_feature 298: n = A,T,C or G
cctcgtgccgaattcggcacgaagcacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggttggaagtaccaggcagtgacagccaccctggagggagaagaggaaaganaaaagccaagatccactaccggaagaagaaacagctcat

SEQ ID NO: 6436 - DNA, 106 bp, Homo sapiens
  misc_feature 3, 4, 13, 30, 35, 102: n = A,T,C or G
ttnngcacgaggntggagctcattctgtcnctttnctcttttgctttctggctcttaagggcacacacacgtgcgtgcgagcacacacacacatacgtgcanaggg

SEQ ID NO: 6437 - DNA, 343 bp, Homo sapiens
  misc_feature 103, 105, 111, 153, 190, 196, 225, 263, 265, 289, 315: n = A,T,C or G
cttgaaaagttcgctctgccagaaaccacctagggaccacgttagctgccttccttgagctccccaggagtcggtttccacatctgtgaggtggagggctggngnggaggngctcatggggtgcggtgcttgggagacagccaggcccagggnggctgctgcttcctgctaagtgggggaggtgagacanatctgnaaagccgactccctcacatggtttcattnaatgctttatactgccgagtctgggggcttgatttggntngggggcagccatcctccaccaganagggggagctccttccgctgcggctncagataaatggggatgctgggctccagg

SEQ ID NO: 6438 - DNA, 292 bp, Homo sapiens
ccgagcaggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgg

SEQ ID NO: 6439 - DNA, 249 bp, Homo sapiens
  misc_feature 186, 202, 234: n = A,T,C or G
atgagacaccgctcctccaggtctccataaattgtctttgggggattccaccacacccaatgctctggagccacaaggagtgtcccttcttccccagcagagccgtgggagggtccttgtctgctctcctttgaaccttggcagcccttggatggagggctccctttccctccccttttttttttntttgttcctgggaaangttaatctccgggagttcttcctggttcatgngttctggggggttgg

SEQ ID NO: 6440 - DNA, 115 bp, Homo sapiens
  misc_feature 5, 9, 10, 11, 14, 23, 25, 28, 29, 39, 54, 56, 57, 69, 93,112: n = A,T,C or G
ctgtngaannnggnaatcactangnaannacagatgtgnaaagggaatgtgcgnannatgccttcaaanctgaatgtttctccgtcccagagngatgaagtgattcaatggntgg

SEQ ID NO: 6441 - DNA, 338 bp, Homo sapiens
ccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaa

SEQ ID NO: 6442 - DNA, 332 bp, Homo sapiens
ctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtgggtgggaaccaagaagcgggtgctcacccctccgcaagtccttgctggtgcagacgaagcggcgggctctggagaaagattgaccttaagttcattgacaccacctccaagttt

SEQ ID NO: 6443 - DNA, 120 bp, Homo sapiens
  misc_feature 7, 12, 13, 18, 32, 34, 35, 38, 49, 50, 60, 63, 69, 103, 108: n = A,T,C or G
ggctgancctgnntcgancacacacatctaangnncangctggctccgnntggcgatctncgncttgtntgtctgaatgttggcctaaaataaagattactgntgtanagtatgaaaaat

SEQ ID NO: 6444 - DNA, 100 bp, Homo sapiens
  misc_feature 8, 17, 41, 64, 89, 93, 99: n = A,T,C or G
acactagnggattcaangaattcggcaacgagggaccttcnagactgtctttgctgatctcatnaagtgatgaatgcaagaggggtttntatnagaatng

SEQ ID NO: 6445 - DNA, 243 bp, Homo sapiens
ctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatcca

SEQ ID NO: 6446 - DNA, 335 bp, Homo sapiens
  misc_feature 84: n = A,T,C or G
ggtatgcaaaaagcagctaggacatagaataagcagtgcctgaaaagacacaagaaaggagcccagtgtctcccagtgaggtgntttacttgcattttcacacttgaacatcatcacaaccctgcaccatttcccagctgaggcaactgaggttctgggaggtcacctaactcccttggggttacctgcccatctgtagcccagccgggacttcaaacccaggtctgtctcactcaaaagcctgttttctttccaacatacaatgccgtgtctggagctgaaactagaacacagggccatggattcccttgtgcacacagcggccactctgttgc

SEQ ID NO: 6447 - DNA, 338 bp, Homo sapiens
cctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatg

SEQ ID NO: 6448 - DNA, 333 bp, Homo sapiens
tgagtgactacttttcatcatttcatgttgtagttcaaatatcatcttttcagacaagcattgctacctaaccatccttccagaatgacactagcctcatccccctcaatcccattaccttttttacttaaaaatttcttcaaaccatttatcagtatctgaaattatgtttttatattattttataatctccatactcactagaatataagccccgtgatatcaatgatcttgtctctttttgtttttgtttttgagatagaatctcgctcggtcaccccaggctggagtgcagtggtgtgtgtgatcacggctcactgcagcctggaactc

SEQ ID NO: 6449 - DNA, 161 bp, Homo sapiens
  misc_feature 4, 21, 30, 35, 79, 81, 91, 101: n = A,T,C or G
atgncacatgtacttcagttngaggataanagcanaaaagcgaaagatgcaagcatgcaagactcagatacatttgaantntatgatcctnggaatccagngaataaaagaaggagggaagaaagcaaaaagctgatgagagagaaaaaagaaagaagata

SEQ ID NO: 6450 - DNA, 347 bp, Homo sapiens
  misc_feature 118, 267, 271: n = A,T,C or G
ccatttgcaagggaaaagtctcttgtaatccgaatctctttttgctttcgaactgctagtcaagtgcgtccacgagctgtttactagggatccctcatctgtccctccgggacctggngctgcctctacctgacactcccttgggctccctgtaacctcttcagaggccctcgctgccagctctgtatcaggacccagaggaaggggccagaggctcgttgactggctgtgtgttgggattgagtctgtgccacgtgtttgtgctgngggngtgtccccctctgtccaggcactgagataccagcgaggaggctccagagggcactctgcttgttattagagattac

SEQ ID NO: 6451 - DNA, 338 bp, Homo sapiens
gccccacagacccctccctggggcagagggacagcagattactgggcccgagacgcattaggtggcacatgctggttccctctgtccagcgagcctctcccccagcatcatccagccctgggcctccagcaggcagaggagatcatgaccaggaagcaattcatcaccatccaaggccttagcagactctggctttcctttgaatttccaagaaaactgctccataatttttatcaagacttatcatttgcccatctcaccctacacactagaattttaagcgatgaagtcatgtggagacttactttgtagtcttttaagataatgaccaaatgaac

SEQ ID NO: 6452 - DNA, 313 bp, Homo sapiens
cttgagggctgtcaaaaatgctattgatgatggctgtgtggttccaggtgctggtgccgtggaagtggcaatggcagaagccctgattaaacataagcccagtgtaaagggcagggcacagctttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataacta

SEQ ID NO: 6453 - DNA, 335 bp, Homo sapiens
aaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtacctttggatctgcatttgctacacccttccttgtagtaagacaccaactgcttaaaacataaggatgttttcagttcctccatttaacagatatgaagagcattttaagaggtgcagcctctggaag

SEQ ID NO: 6454 - DNA, 129 bp, Homo sapiens
cttactacagcctcaaacttctgggctcaagtgatcctcagcctcccagtggtctttgtagactgcctgatggagtctcatggcacaagaagattaaaacagtgtctccaattttaataaatttttgca

SEQ ID NO: 6455 - DNA, 111 bp, Homo sapiens
  misc_feature 12, 28, 38, 58, 62, 67, 71, 77, 78, 84, 95, 99, 103: n = A,T,C or G
aaacgctggagntcgggcgcttgcgggncggcactagnggattcaaagaattcgggangagnggctnagangttggnnctgtgngcttgctgganactngctncatcccta

SEQ ID NO: 6456 - DNA, 101 bp, Homo sapiens
ctgaatctcccctcctcacagttgccatgtagaccccttgaagaggggaggggcctagggagccgcaccttgtcatgtaccatcaataaagtaccctgtgc

SEQ ID NO: 6457 - DNA, 318 bp, Homo sapiens
aaatgaacgaaaatctgttcgcttcattcattgcccccacaatcctaggcctacccgccgcagtactgatcattctatttccccctctattgatccccacctccaaatatctcatcaacaaccgactaatcaccacccaacaatgactaatcaaactaacctcaaaacaaatgataaccatacacaacactaaaggacgaacctgatctcttatactagtatccttaatcatttttattgccacaactaacctcctcggactcctgcctcactcatttacaccaaccacccaactatctataaacctagccatggcca

SEQ ID NO: 6458 - DNA, 185 bp, Homo sapiens
  misc_feature 8, 12, 29, 40, 88, 94, 103, 115, 121, 124, 135, 137, 145,156, 177: n = A,T,C or G
ttataagnttgnagcaagggagcatgggnttcaaaggaanctccttcctttttttgtgtgtttgtccttttgtcccaatggggaaccnaaatcngttttaatngcacagacacanggacanaangtcattttgtntntgccaagnggggaaccttnctttgtttatttgctattaanctgtttga

SEQ ID NO: 6459 - DNA, 100 bp, Homo sapiens
  misc_feature 10, 17, 53, 56, 66, 67, 71, 78, 91, 92, 98: n = A,T,C or G
tgaaaccagncccagcngtatccagaggactcacaagccttcaatcctgatantcnttatcatctnntggnagggganagcgtgacattcnnccctanac

SEQ ID NO: 6460 - DNA, 103 bp, Homo sapiens
  misc_feature 8, 21, 43, 57, 58, 69, 76, 77, 96: n = A,T,C or G
cgcttgcnggtcgacactagnggattcaaagaattcggacaangagccggcagaggnngttcccggggncacttgnngaccagccccttgcgtccncaggttt

SEQ ID NO: 6461 - DNA, 313 bp, Homo sapiens
  misc_feature 157: n = A,T,C or G
gggaattcctggtcctgctggtcccttaggtccacctggtcctccaggcttaccaggtcctcaaggcccaaagggtaacaaaggctctactggacccgctggccagaaaggtgacagtggtcttccagggcctcctgggcctccaggtccacctggngaagtcattcagcctttaccaatcttgtcctccaaaaaaacgagaagacatactgaaggcatgcaagcagatgcagatgataatatttctttgattactcggatggaatgggaagaaatattttggttccctcaatttcccttgaaacaagacatc

SEQ ID NO: 6462 - DNA, 337 bp, Homo sapiens
  misc_feature 6, 157, 168: n = A,T,C or G
gggagnctaagtctctttgtaggtcactcagaacttgctttatgaatctgggtgctcctgtattgggtgcatatatatttaggatagttagctcttcttgttgaattgatccctttaccattatgtaatggccttctttgtctcttttgatctttgntggtttaaagnctgttttatcagagactaggattgcaacccctgcctttttttattttccatttgcttggtagatcttcctccatccttttattttgagcctatgtgtgtctctgcccgtgagatgggtttcctgaatacagcacactgatgggtcttgactctttatccaatttgccag

SEQ ID NO: 6463 - DNA, 332 bp, Homo sapiens
ataaagttaacatttataacaatactaccatctaatacatagtttactttcagatttccccaggtgttctaataatgagttcttcatagttgtgtttttaaaaaataacagctttattgggatataatttacatactgtacagttcacctcaagtgtacaattcattggtttttactgtatttggagttgtacagccaccatgagaatcaattttagaacacttatatcaccctaaaaagaaaccccatacccattagcaatcacttgccttccctcccaccatcccaactcccacctcctagcccaaagcaagcactcatctactttcagt

SEQ ID NO: 6464 - DNA, 197 bp, Homo sapiens
gtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattgg

SEQ ID NO: 6465 - DNA, 333 bp, Homo sapiens
  misc_feature 200: n = A,T,C or G
ctggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaagcttatgtccctgatgccaaaaatgcacctactctttcctctaactctggngaggtcattctggagtgacatgatggactccgcacagagcttcataacctcttcatggactttttatcttcaagccgatgacggaaaaatagttatattccagtctaagccagaaatccagtacgcaccacat

SEQ ID NO: 6466 - DNA, 339 bp, Homo sapiens
tcgagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctatt

SEQ ID NO: 6467 - DNA, 131 bp, Homo sapiens
gtggagaggtcctagagccggcgagcgtttgagaagagggcatggcgctggagtgagatgggatttggcgtctcgtttttggctaattgattgtcattggctttttccataaagtttagaaatcgttaaaa

SEQ ID NO: 6468 - DNA, 127 bp, Homo sapiens
  misc_feature 11, 12, 30, 31, 40, 42, 43, 53, 60, 63, 64, 67, 85, 94, 98,99: n = A,T,C or G
ttaaagtcttnngatgtcactatacagttnnactgtctangnnactacaggantctaggnggnnggngggcgtgtgggccttttnatctgatcngcgnntaaagcagtaatattttaagatggactg

SEQ ID NO: 6469 - DNA, 340 bp, Homo sapiens
tctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaaca

SEQ ID NO: 6470 - DNA, 205 bp, Homo sapiens
  misc_feature 2, 15, 79, 82, 155, 170, 178, 194: n = A,T,C or G
cnacactagtggatncaaagaatttgggacgagagatgccgaaaggaaagaaggccaagggaaagaaggtggctccggnccnagctgtcgtgaagaagcaggaggctaagaaagtggtgaatcccctgtttgagaaaaggcctaagaattttggnattggacaggacatncagttttnaagagacctaacccgntttgtgaaatg

SEQ ID NO: 6471 - DNA, 339 bp, Homo sapiens
cgagcccttccttataggcgtcagcgggggaacagctagcggcaagtcttccgtgtgtgctaagatcgtgcagctcctggggcagaatgaggtggactatcgccagaagcaggtggtcatcctgagccaggatagcttctaccgtgtccttacctcggagcagaaggccaaagccctgaagggccagttcaactttgaccacccggatgcctttgacaatgaactcattctcaaaacactcaaagaaatcactgaagggaaaacagtccagatccccgtgtatgactttgtctcccattcccggaaggaggagacagttactgtctatcccgcagacgt

SEQ ID NO: 6472 - DNA, 330 bp, Homo sapiens
  misc_feature 237, 279, 281, 290: n = A,T,C or G
ggcagcccagcatgtgccaggcttttgctgctgaccccaaaccttactggaatcaagccctgcaggagctgaggcgccttcaccatgcgtgccagggggccccggtgcttaggccatccgtgtgcagggaggctggaccccaggcccatatgcagcaggtgacttccagcctcaagggcagcccagagcccaaccagcagcctgaggctgggacgccatctctgaggcccaaggccncagtgaactcacagaagcacacagctggaaaaggactcgatngnagagctggnaaagccaaaccaccacccgacccacagccaacctaccagc

SEQ ID NO: 6473 - DNA, 313 bp, Homo sapiens
attttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcag

SEQ ID NO: 6474 - DNA, 253 bp, Homo sapiens
cttcctcagcctcttctctttaggcccagctgctgggcaaggaattccagtgcctcctacgggggcagcacacttagatattcctggacatccagatagctcacatgtgctgaccacacttcaggctctggactggagctctctggcatgggggtggggcctcagatgctggggcccagtctgccccatcttcattcctgcaccttaaacctgtacagtcatttttctactgacttaataaacagccgagctg

SEQ ID NO: 6475 - DNA, 329 bp, Homo sapiens
gtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagagtc

SEQ ID NO: 6476 - DNA, 130 bp, Homo sapiens
gatctaagagttacctggctacagaaagaagatgccagatgacacttaagacctacttgtgatatttaaatgatgcaataaaagacctattgatttggaccttcttcttaaaaaaaaaaaaaaaaaaaaa

SEQ ID NO: 6477 - DNA, 354 bp, Homo sapiens
cgggaccgtgcgcaccgcgtgcttggtggtggcgatgctgctcagcttggacttcccgggacaggcgcagcccccgccgccgccgccggacgccacctgtcaccaagtccgctccttcttccagagactgcagcccggactcaagtgggtgccagaaactcccgtgccaggatcagatttgcaagtatgtctccctaagggcccaacatgctgctcaagaaagatggaagaaaaataccaactaacagcacgattgaacatggaacagctgcttcagtctgcaagtatggagctcaagttcttaattattcagaatgctgcggttttccaagaggcctttgaaattgttgttcg

SEQ ID NO: 6478 - DNA, 330 bp, Homo sapiens
catttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtaccca

SEQ ID NO: 6479 - DNA, 100 bp, Homo sapiens
  misc_feature 3, 5, 7, 10, 12, 15, 20, 21, 22, 64, 73, 83, 90, 96, 99: n = A,T,C or G
gcntngnctntnagnccttnnntatgggtttaaaggcttgcagtctagaataagtgaacgtcancccaatagnggggttgccngggcctnaagccnatnc

SEQ ID NO: 6480 - DNA, 107 bp, Homo sapiens
  misc_feature 5, 9, 12, 20, 46, 55, 57, 58, 61, 63, 64, 69, 70, 77, 84,93, 98, 104, 105, 106: n = A,T,C or G
gggcngccntgnaggttccngacactaggtggcattccaaaagganttccggacnannagncnngacgnngaaaggnctataanaactattantatanggctgnnnt

SEQ ID NO: 6481 - DNA, 115 bp, Homo sapiens
  misc_feature 7, 9, 37, 39, 43, 46, 60, 61, 62, 69, 72, 77, 79, 86, 88,90, 95, 100, 105, 107: n = A,T,C or G
tgcgcgncnacactagtggattcaaagaattcggcananagcnganacccactttggcannnagccagntgntgccntnttaaggncnanggganatctncctgntnaggagccg

SEQ ID NO: 6482 - DNA, 146 bp, Homo sapiens
  misc_feature 6, 41, 44, 51, 60, 67, 78, 80, 113, 114, 133: n = A,T,C or G
tcgggngcttgcaggtcgacactagtggattcaaagaattnggnaagagcngcccacggngccgagncctgtatcacncnctttatccttacacgcttttatacaatggcatnnaataaagtgcatcgtgtgnctgggtttctggt

SEQ ID NO: 6483 - DNA, 100 bp, Homo sapiens
  misc_feature 7, 14, 33, 47, 49, 51, 64: n = A,T,C or G
tgcacgnctacacnagtggattcaaagaattcngcactagtgggaantncngatgtgcgcattnacaccttgctcaacagagtctgtctgggccaaagga

SEQ ID NO: 6484 - DNA, 100 bp, Homo sapiens
  misc_feature 4, 11, 18, 19, 21, 39, 41, 42, 55, 64, 86, 87, 88: n = A,T,C or G
tgangttgggntgtcaanntnggatctttcctgctttcncnngtgggcttgtagngctataaanctccctctacacactgcttcgnnngagtcccagaga

SEQ ID NO: 6485 - DNA, 100 bp, Homo sapiens
  misc_feature 2, 4, 28, 30, 32, 33, 42, 48, 50, 55, 58, 67, 70, 84, 86,90, 91, 94: n = A,T,C or G
gncnacactagtggattcaaagaattcngnannagcctcagngctttnantctgncanggtggggcnctntaacccacatagangncagnntgnctggcc

SEQ ID NO: 6486 - DNA, 100 bp, Homo sapiens
  misc_feature 4, 6, 14, 17, 30, 33, 36, 47, 52, 54, 66, 71, 81, 82, 85: n = A,T,C or G
taangntagtaaantanattactcatggcntanggngtaatgcctanagccngncgggtccaactnatgtnccctagtaannttngacagtcattcagtg

SEQ ID NO: 6487 - DNA, 100 bp, Homo sapiens
tctctggcgcttgcagcgtctacactagtggattcaaagaattcagcactagagtggatcagtctgaacgactggaccatcgaagggtacttccggtgtt

SEQ ID NO: 6488 - DNA, 124 bp, Homo sapiens
  misc_feature 1, 3, 4, 6, 7, 8, 10, 11, 14, 25, 33, 37, 41, 43, 47, 56,61, 63, 66, 68, 73, 74, 78, 81, 84, 86, 89, 109, 121: n = A,T,C or G
nannannnanntgnggattcaaagntctcaaantaancctnantaangggattttnttgtnanttntnttatnntgcngtngtntnctnctgttaatctaaaaatttanaatatctttatntgt

SEQ ID NO: 6489 - DNA, 126 bp, Homo sapiens
  misc_feature 1, 18, 30, 43, 44, 48, 59, 89, 100, 102: n = A,T,C or G
nagctttctgccccagtnccctaaagaganggctcacagatgnnggcngctactaccgngctgatgatgccaatgtggctcgggaccgngacctcgaggngnacaccaccctcaagagcctgagac

SEQ ID NO: 6490 - DNA, 121 bp, Homo sapiens
  misc_feature 10, 19, 32, 33, 39, 48, 50, 51, 54, 55, 60, 61, 64, 69, 73,79, 82, 83, 92, 98, 109: n = A,T,C or G
ggtttttctnagtttcttntgaggctgtgagnntgcttnggaggggantnngcnngcttnnatnggcancctnatgtgnttnnccccaacancgaaantacaatttaanaattttattaac

SEQ ID NO: 6491 - DNA, 100 bp, Homo sapiens
  misc_feature 5, 8, 10, 16, 27, 28, 30, 31, 33, 35, 36, 37, 51, 57, 84,86, 88, 98: n = A,T,C or G
attcngananagagcntcgcgagcatnntnncnannnggttaaaagcaggnttctgngcttaagagccccccagacctcctganangngaggctctgntg

SEQ ID NO: 6492 - DNA, 116 bp, Homo sapiens
  misc_feature 7, 11, 36, 38, 42, 49, 84, 93: n = A,T,C or G
cactagnggantcaaagaattcgacacgagcgggantnctgntggcttngtgtgaaagagatctcagaacttgcattacctcancccctctgnctgtacattctggggcaagaagc

SEQ ID NO: 6493 - DNA, 100 bp, Homo sapiens
  misc_feature 17, 18, 28, 30, 32, 56, 65, 68, 69, 70, 72, 80, 81, 91, 93,96: n = A,T,C or G
aaaagggctggagctcnngcgcttgcgngncnacactagtggattcaaagaattcngcactagcngannngngcaaagtnnatgaaacctngnaangtgg

SEQ ID NO: 6494 - DNA, 142 bp, Homo sapiens
  misc_feature 16, 18, 24, 31, 73, 89, 99, 116, 117, 128, 132, 134: n = A,T,C or G
tcccaaagtgctgggntngcgggngtgagcnaccacgcccagcctagaaatgattcttagagctgtaggcctntacttcatcatttttnagtttaaatnaatcagttgcttataanntgcttacatgnatanantaattttt

SEQ ID NO: 6495 - DNA, 100 bp, Homo sapiens
  misc_feature 2, 17, 24, 44, 51, 58: n = A,T,C or G
gncctctgaagccctgnaggctgnccgaatttgtgccaataagnacatggnaaaaagntgtggcagaagatggcttccatatccgggtgcgggtccaccc

SEQ ID NO: 6496 - DNA, 100 bp, Homo sapiens
  misc_feature 2, 6, 8, 15, 20, 36, 40, 79, 91: n = A,T,C or G
gnaagngngttggtnttttnaaaaagaaagtgtatntggnaataaagtcagatggaaaattcattttttaaattcccgntttgccactttntctgataaa

SEQ ID NO: 6497 - DNA, 100 bp, Homo sapiens
  misc_feature 4, 13, 32, 41, 43, 44, 54, 57, 63, 67, 78, 79, 90, 95, 96,99: n = A,T,C or G
ggtncaagatagnctatttcattggcatatcnccccccagncnntgaggctcanggntggaangttnatgccttaatnnctctatggcanacatnnaana

SEQ ID NO: 6498 - DNA, 100 bp, Homo sapiens
  misc_feature 3, 16, 34, 36, 50, 54, 56, 66, 67, 74, 75, 76, 86: n = A,T,C or G
tanaatggccttctgngcctctttggcctttgantnttatattttgaccntaanangccatggagnngaccttnnngccttgtatnctatgtgggtatct

SEQ ID NO: 6499 - DNA, 100 bp, Homo sapiens
  misc_feature 3, 15, 38, 41, 53, 93: n = A,T,C or G
ggngcttgcgggtcnacactagtggattcaaagaattnggnacgagctgaacnctggaggcctacccatcaccccatcccgcaattccgccanagccaag

SEQ ID NO: 6500 - DNA, 113 bp, Homo sapiens
  misc_feature 15, 18, 28, 30, 47, 53, 57, 69, 72, 79, 83, 86, 96, 97, 99,102: n = A,T,C or G
aaaggctggagctcnggngcttgcgcgncnacactagtggattcaangattcngacnagagccccctgnctntgggtgntggnttnctgggattgnngnatngactcaaatgc

SEQ ID NO: 6501 - DNA, 101 bp, Homo sapiens
  misc_feature 5, 13, 18, 21, 32: n = A,T,C or G
aatangaggaagncctgncgntctctaatganaaatatgcatttatggcatctctcaaccgtcctggatgtctgattggtagagttgtaattttgaaacac

SEQ ID NO: 6502 - DNA, 101 bp, Homo sapiens
  misc_feature 33, 38, 39, 61, 74, 82, 98: n = A,T,C or G
aaataataagtttgctacctagatgattgcctnattgnntaggtcactatgaaattccttnaaatgttgatatntgccattnggggaaacgacgtaanttc

SEQ ID NO: 6503 - DNA, 100 bp, Homo sapiens
  misc_feature 20, 23, 28, 30, 33, 40, 44, 49, 55, 58, 62, 77, 83, 89, 96: n = A,T,C or G
aaaagggatggagctcgggngcntgcgngncgncactagnggantcaangtaaangtntaanagaccacaaatatcncatganagactnaaagggnacat

SEQ ID NO: 6504 - DNA, 100 bp, Homo sapiens
  misc_feature 3, 5, 29, 31, 43, 68, 74, 81, 82, 88: n = A,T,C or G
ggncnacactagtggattcaaagaattcngnacgagatgctgncaccgaacaaaagacctgtgaatcngactgnggcatgnnctgctncaccagctcgcc

SEQ ID NO: 6505 - DNA, 100 bp, Homo sapiens
  misc_feature 8, 12, 16, 22, 27, 36, 37, 39, 49, 50, 53, 55, 62, 67, 79: n = A,T,C or G
aactgcancatnccanaggttnttacngagcttctnngntgccctaatnnacnangaccccnaggcngcgttggagganctgactaacgctttggagctt

SEQ ID NO: 6506 - DNA, 100 bp, Homo sapiens
  misc_feature 13, 22, 29, 32, 34, 51, 57, 58, 60, 63, 67, 83, 97: n = A,T,C or G
aaaaaagggatgnagctctggngcttgcncgncnacactagtggattaaangaattnngnaanagcnacctaccaacctcgcngcactgtaccctgnggc

SEQ ID NO: 6507 - DNA, 100 bp, Homo sapiens
  misc_feature 20, 29, 41, 88: n = A,T,C or G
gctacactggtggattcaangaattcagnacgaggtcttancgacccttaaactattaatgctgaaccttttactcatgagatttagncattggtaaaat

SEQ ID NO: 6508 - DNA, 110 bp, Homo sapiens
  misc_feature 9, 10, 14, 23, 40, 41, 47, 63, 75: n = A,T,C or G
ccggatagnnggancccaggaantggagaggctggcacanntgcacnaatgcctgcaagctgncctgattttctncggcttggagatagccaccacttttgagctttatt

SEQ ID NO: 6509 - DNA, 106 bp, Homo sapiens
  misc_feature 2, 10, 21, 24, 27, 29, 30, 36, 37, 38, 42, 46, 47, 50, 52,63, 64, 67, 68, 105: n = A,T,C or G
gntctcaaancaacgcctcantancgngnntctctnnnaatnctgnntanangatgggaacanncgnncagcactgcccctctgcctaagacacatgtgactgtng

SEQ ID NO: 6510 - DNA, 100 bp, Homo sapiens
  misc_feature 3: n = A,T,C or G
ganacagcccaagggaccagacccacacagccttacttcacagtttatggcgtttttggaacagcggcgaatctctcatgaggtagtgcacagattgaag

SEQ ID NO: 6511 - DNA, 101 bp, Homo sapiens
  misc_feature 3, 6, 25, 63, 75, 89, 91: n = A,T,C or G
canaangcgaaaatgacaacagaanaacaatacttattccgagctttccagcaacttttttgngtatgtacttanctgctctataagtngntgggttgtat

SEQ ID NO: 6512 - DNA, 100 bp, Homo sapiens
  misc_feature 13, 19, 32: n = A,T,C or G
acactcatctgancaggtntggaggacatagngacaggctgacatacctttatgccatattggcggagttgcaaggtgcaaggctgatagctccccaagt

SEQ ID NO: 6513 - DNA, 110 bp, Homo sapiens
  misc_feature 3, 18, 75: n = A,T,C or G
tcnggcgcttgcgggccnacactagtggattcaaagaattctgcacgagattttaaggttgtaaaggtgctggcngtgtgtcacatgccatttgaaatccggttgcccga

SEQ ID NO: 6514 - DNA, 122 bp, Homo sapiens
  misc_feature 11, 15, 36, 40, 45, 55, 63, 65, 73, 97: n = A,T,C or G
aagcttgtaancttnatcttttataaagttagaagngcanatgtngaaatgtacntaagcaananatcatttnacagttcatcaaaatgtatagctnatttgccaaggaaaagtggaactga

SEQ ID NO: 6515 - DNA, 111 bp, Homo sapiens
  misc_feature 8, 26, 29, 47, 48, 49, 53, 59, 62, 64, 66, 71, 77, 79, 82,86, 91: n = A,T,C or G
gaagcccnaaatcccaaggtactggnagnggggcgggggcacgtggnnnaacnagccgnccngnangatcngcagangnaangacnggaangccaaggagcgccaggatcg

SEQ ID NO: 6516 - DNA, 199 bp, Homo sapiens
  misc_feature 11, 13, 15, 31, 33, 127, 132, 148, 153, 155: n = A,T,C or G
actacctaaanantnccaaacatataactgnantcctgacacccaattggaccaatgtatcaccctatagaagaactaatgatcgtatgagtaacatgaaaacattctcctccgcttaagcctgcgngagantaaaacactgaactgncgatnancagcccaatatctacaatcaaccaacaagtcattattaccctca

SEQ ID NO: 6517 - DNA, 106 bp, Homo sapiens
  misc_feature 2, 22, 28, 54, 61, 75, 78: n = A,T,C or G
gngagtgacagagggaaagggnccaatngccactgaggacaccaggcaataaancatcctnccctggcatcaggnggntggacgaatccccacttcctgagtaagt

SEQ ID NO: 6518 - DNA, 100 bp, Homo sapiens
  misc_feature 9, 21, 40, 63, 65, 90: n = A,T,C or G
cgatccgcntcatgtggtctnagagggatccatgtttganaaaatctggagagggaaacgggnanatcaagaacctggacaaatgtatanataacaaggc

SEQ ID NO: 6519 - DNA, 100 bp, Homo sapiens
  misc_feature 12, 32, 41, 51, 58, 72, 76, 85: n = A,T,C or G
caaagaattctnttcgagtcaaggagaatganaccattcanattgatttanagactgncaagaattactganttcntcaagttcnacactggtaacctgt

SEQ ID NO: 6520 - DNA, 100 bp, Homo sapiens
  misc_feature 10, 12, 28, 32, 41: n = A,T,C or G
acactatatntntttctaaattcaactngaanatgtgtatntcccctgaccttcaaaaaatgttccaaggtaagcctggtaaaggtcatcccaccatcac

SEQ ID NO: 6521 - DNA, 100 bp, Homo sapiens
  misc_feature 11, 18, 32, 35, 36, 42, 49, 54, 67, 69, 73, 80, 84, 89, 98,99: n = A,T,C or G
gacgagtaggncagttcntttccttgggtccnggnnactatngagctgnagcanaagatcagagcananatgnggctaancagntgcanggcaattgnng

SEQ ID NO: 6522 - DNA, 113 bp, Homo sapiens
  misc_feature 1, 6, 27, 38, 49, 50, 72, 75, 82, 94, 96: n = A,T,C or G
ntatcnttcgggcgccttgcaggcccncactagtggantcaaagaattnnttacgagtggacatgagagccnctnggcgccncaggagggctgngngttactagaaacaacgc

SEQ ID NO: 6523 - DNA, 107 bp, Homo sapiens
  misc_feature 12, 18, 25, 29, 41, 55, 56, 65, 66, 67, 71, 76, 79, 86: n = A,T,C or G
gggcgcttgcangacccncactagnggantcaaagaatttnttcgagggcaaatnnagattatgnnnctcnaattntgntacttgnttggctgttcatgtggtcacg

SEQ ID NO: 6524 - DNA, 150 bp, Homo sapiens
  misc_feature 6, 24, 46, 120: n = A,T,C or G
actctncctctttcctggtatacnaagatggaagtaggagagcttnttttctaactaccatctgaccagacaaggaatgaagcaatgactgtgggccgggaaactggacctacctctctncccactgcaaatttgtgggatagaccaaaa

SEQ ID NO: 6525 - DNA, 100 bp, Homo sapiens
  misc_feature 16, 20, 35, 44, 67: n = A,T,C or G
ccggaaaacttgaatnggcnaaacggtctaatatnccattaaanctttaaaaagactagcccactancttagcaatttaaagaaaggatactacgcacta

SEQ ID NO: 6526 - DNA, 100 bp, Homo sapiens
  misc_feature 15, 24, 31, 36, 49, 57, 63, 73, 84: n = A,T,C or G
tatagagtaccgggnacagaaganctcacgnctccncatcattgacatngcagcccntggacntaggagggcncgagcgggaantcggggaggacatagg

SEQ ID NO: 6527 - DNA, 114 bp, Homo sapiens
  misc_feature 10, 17, 31, 35, 71, 80, 81, 87, 94: n = A,T,C or G
cttaacttancacttcnccagtggcacaatnagcnctcaggcaatgtttattggagtgaagaccaattccngatttgaanntagggntggaganatgccaaacaccgggctgat

SEQ ID NO: 6528 - DNA, 110 bp, Homo sapiens
  misc_feature 14, 18, 20, 21, 38, 41, 45, 50, 59, 69, 70, 82, 85: n = A,T,C or G
tactatcccactgncccnannatctagttgagaaaacngangctnagagncttacgacntggccaaagnnacatagcttctnagnggcaaagtgggattgtatgccaggc

SEQ ID NO: 6529 - DNA, 120 bp, Homo sapiens
  misc_feature 9, 13, 15, 27, 58, 89, 95: n = A,T,C or G
cgaggggcnaagntnttacggccgctnggtcaggagctgccctctcatggggtacccnggataaaccatctatagagaggacatacccngctggnctgctgggcagaggataagattttg

SEQ ID NO: 6530 - DNA, 149 bp, Homo sapiens
  misc_feature 9, 10, 33, 35, 39, 53, 60, 65, 70, 77, 85, 86, 87, 91, 120,138: n = A,T,C or G
caacagctnntaaaattcatgcctagcagcggntntctnaatgaaatgcatgngggggantgggnaaacntgcaaanggaaactnnnccantaagagccccagcacaaaggaggacgggngaatcggtcccatgaaanccaaggagggg

SEQ ID NO: 6531 - DNA, 135 bp, Homo sapiens
  misc_feature 16, 17, 30, 39, 41, 47, 52, 58, 70, 75, 77, 78, 80, 90, 99,101, 102, 119: n = A,T,C or G
aaactcctgggccgcnngaaggccttaaanaggcactgnancatggngctgnagaacntgaaagagatgnggacngnngnacccaagagnggcaagggnannaagaagtccaagccagncaacaaagaccgctac

SEQ ID NO: 6532 - DNA, 113 bp, Homo sapiens
  misc_feature 3, 20, 30, 32, 33, 35, 36, 39, 56, 62, 65, 84, 85, 110: n = A,T,C or G
cancgggatattaagttggnctaaatgctntnncnncanaggattatcacggggcntctacncantgaaaaaccgtgataattnnttgtttctaaaataaacatttgaanatt

SEQ ID NO: 6533 - DNA, 118 bp, Homo sapiens
  misc_feature 6, 12, 17, 21, 30, 34, 42, 49, 56, 66, 67, 68, 69, 74, 99,105, 110, 114, 116: n = A,T,C or G
tacagngacaancagancatnctgccttanaggngctagatncccgaanttagaanaccctttctnnnncagtnatgaagttataaatatcagcttgtncatccnagccnctgncnga

SEQ ID NO: 6534 - DNA, 100 bp, Homo sapiens
  misc_feature 14, 18, 39, 55, 73: n = A,T,C or G
aagccgacactagnggantcaaagaattttggacgaggncaactgtgcctctcanaacatcacctaccactgnacgcaacaggcatagcatacatggatg

SEQ ID NO: 6535 - DNA, 103 bp, Homo sapiens
  misc_feature 2, 5, 37, 44, 48, 55, 61, 62, 67, 82, 86, 92: n = A,T,C or G
gnacnagcctcctagagttttcctcggaaacactctngaatgtntgantgagggncctgcnnacctntttggcctgtgagangctnagaaantttttattttt

SEQ ID NO: 6536 - DNA, 129 bp, Homo sapiens
  misc_feature 13, 21, 34, 41, 50, 58, 61, 76, 78, 79, 82: n = A,T,C or G
caaggacgggaancctgacantgagacctacctncaccggntcgggcgcncgggccgnttnggcaagaggggcctngnngcnaacatgggggacagcaagcacagcatgaacatcctgaacagaatcca

SEQ ID NO: 6537 - DNA, 101 bp, Homo sapiens
  misc_feature 12, 39, 97, 98: n = A,T,C or G
ggaattcggggnggacgtggggccggacggcttgttggnaaaacctgaacccagaaacaacacaatccgtagcaaacccgaaggacccaaggacttnncaa

SEQ ID NO: 6538 - DNA, 141 bp, Homo sapiens
  misc_feature 8, 13, 17, 33, 37, 40, 50, 53, 66, 67, 80, 89, 92: n = A,T,C or G
cacgagtnttgcngatntaatggcctagaggantcanaanacctgaagtnacnaaaggctcaacgnnaacaagctatcanggctgctanggnagcaaaaaaggctaagcagggcatctaaaaagactgcaaatggctgctg

SEQ ID NO: 6539 - DNA, 101 bp, Homo sapiens
  misc_feature 2, 4, 6, 22, 25, 36, 38, 39, 42, 45, 64, 70, 77, 91: n = A,T,C or G
cncntnacaagcaatgcagatnatntgcccaaaggngnnctnttnttcagattcagcatttganctttgncagtctnattttcatcttctnccatggttcc

SEQ ID NO: 6540 - DNA, 114 bp, Homo sapiens
  misc_feature 1, 12, 38, 62, 68, 87, 96, 102: n = A,T,C or G
naatttgagganatcccaattgcacacattaaagcatnccacaacaacacacagatccaggnagtctntgctagtaatgagcccctngcctttgcntcctgnggcacatgaggg

SEQ ID NO: 6541 - DNA, 246 bp, Homo sapiens
  misc_feature 15, 30, 33, 35, 37, 52, 78, 96, 97, 98, 106, 150, 152, 178,197, 207, 212, 236, 242: n = A,T,C or G
tctgcaatggatggncgggcggaactgctncantntnctgatcaagaggaanaagcggacctacagccctgagcccantaacttgaaggcccgaannnccttccgntacaacggactgattcaccgaaagactgtgggagtggagccggnanccgacggcaaaggtgtcagaggtggncattaagcggatatccggncagcggaagnctgcnaccttctatgtgcggaccaccatnaacaanaatg

SEQ ID NO: 6542 - DNA, 200 bp, Homo sapiens
  misc_feature 1, 8, 24, 30, 45, 49, 60, 61, 63, 82, 98, 125, 154, 156, 177: n = A,T,C or G
nacgaggnaacattgaactcccangagcanatccacattcctctngagntctgcagcttnngngtaaataggggcagctggngactatgccgtaaaancacatgatctgaggaccattcatggangctggtaaatagcctaatctggggagttntncataaagttttgcatggagcnaacaaacaggattaaactaggtt

SEQ ID NO: 6543 - DNA, 101 bp, Homo sapiens
  misc_feature 17, 21, 25, 40, 42, 53, 55, 66, 67, 72: n = A,T,C or G
tgggggtcggacggtgngggnagancgcaaggcctacacnanaaaacgctgancngcggtatggtnncttgnaacttcatgtaccagcgtaaagatgaaag

SEQ ID NO: 6544 - DNA, 100 bp, Homo sapiens
  misc_feature 2, 9, 31, 38, 40, 59, 64: n = A,T,C or G
cnctacganagtacaaggaatgcggggcagntgggtgncnacccgcaaatgccacacgncgacnctctaccgcatgcgaatctgtgagcctaagcatgta

SEQ ID NO: 6545 - DNA, 100 bp, Homo sapiens
  misc_feature 28, 46, 52: n = A,T,C or G
taaggagttagcttttcatgattacccnattccattacaagcatangaatgnatgtgagttcaagcctactgagtgggcctttggcctattcaaggagca

SEQ ID NO: 6546 - DNA, 100 bp, Homo sapiens
  misc_feature 11, 20, 27, 49, 69, 85, 95: n = A,T,C or G
gccacactagnggattcaangaattcntttcgagatttaaattgctgangggctggcggtgttgcttcntagacacagtatcatnacattccctngagtt

SEQ ID NO: 6547 - DNA, 100 bp, Homo sapiens
  misc_feature 59: n = A,T,C or G
gccccactgggggattcaaagaatctcttttcgagcctaaaaagcggaggtgggtccgnaaccttaagacattagcaagaaatcacaacttcatgacaag

SEQ ID NO: 6548 - DNA, 112 bp, Homo sapiens
  misc_feature 3, 14, 29, 42, 43, 44, 47, 48, 58, 65, 67, 84, 88, 103: n = A,T,C or G
aanactccgatggnagacaggactctccngctggggaactgnnnaanncggtccaacngcccacngngcaacacagatatctgnttgnagaagacaatctttnacggtctac

SEQ ID NO: 6549 - DNA, 104 bp, Homo sapiens
  misc_feature 13, 15, 17, 41: n = A,T,C or G
cgggcgcttgcangncnacactagtggattcaaagaattcntttcgagccttgtaggcctaactgccctgatccaagtgccaatggatggcaggaatgcctaca

SEQ ID NO: 6550 - DNA, 426 bp, Homo sapiens
  misc_feature 325, 357: n = A,T,C or G
aacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgntaactgtgaacatacttgtttttaagtggttntgggttcaaagccaatttggagacctagacattcagctcactgcttaactcaacattaaattttatgat

SEQ ID NO: 6551 - DNA, 100 bp, Homo sapiens
  misc_feature 2, 12, 46, 80: n = A,T,C or G
cnggcgcttgcnggcccacactagtggattcaaagaattcggttcnagctcatgtctgttttcacctgcctgtctgagtntctgaaccacatgttaagga

SEQ ID NO: 6552 - DNA, 122 bp, Homo sapiens
  misc_feature 3, 15, 30, 41, 44: n = A,T,C or G
cgngcgcttgcaggncgacactagtggatncaaagaattcnttncgagagaaagatcgattgagcccaggagtttgagaccagcctgggtaatatagcgagaccccgcctctacaaataatt

SEQ ID NO: 6553 - DNA, 101 bp, Homo sapiens
  misc_feature 16, 31, 80, 91, 96: n = A,T,C or G
ggattcaaggaattcntttcgagcagaaaanggagatttaatcctaaaactgtgactcggggaggtgaggcgtttacagntagacctgtgnctctngactt

SEQ ID NO: 6554 - DNA, 100 bp, Homo sapiens
  misc_feature 99: n = A,T,C or G
ggcccactagtggattcaaagattcggtagagcttgctagcttacttgttcctgagaacctaatattttctcatagttatggagctataatatcatatnt

SEQ ID NO: 6555 - DNA, 100 bp, Homo sapiens
  misc_feature 3, 11, 68, 75, 81, 95, 99: n = A,T,C or G
ggngcttgcgngtcgacactagtggattcaaagaattcggcgagcgcgaatcttacagaccggacaanaagcacngaacangagccggagccggngcang

SEQ ID NO: 6556 - DNA, 100 bp, Homo sapiens
  misc_feature 29, 34, 43, 48, 52, 59, 68, 73, 79, 88, 92, 95: n = A,T,C or G
caaaaagtattcaaaatttgatatgctgnttagncgctacggngcccncaangggcacnaaggtgcanccttntttatnttgcctgcnagantgngaagt

SEQ ID NO: 6557 - DNA, 154 bp, Homo sapiens
  misc_feature 7, 23, 25, 39, 41, 59, 66, 67, 72, 107, 153: n = A,T,C or G
ttcgagngcacacctatagtccnanctataaggctgganantcacttgaacctgggagnctgaggnngaggngagccgagatcgcgccactgcgctccaacctgggngacagagtgagactccatctcaaagaatatccatttcaactatggnc

SEQ ID NO: 6558 - DNA, 100 bp, Homo sapiens
  misc_feature 3, 21, 28, 33, 73: n = A,T,C or G
ggnatcacacagctagaaagnggggggnccgtnccacacctaaggctttctgactccagaactcccctttcancctcttctctagtacgtaaggagccga

SEQ ID NO: 6559 - DNA, 101 bp, Homo sapiens
  misc_feature 13, 19, 26, 30, 31, 42, 45, 50, 56, 57, 60, 66, 69, 79: n = A,T,C or G
cgggcgcttgagngtccgncactagngganncaaagaatacnttncgagngagctnnggntctccngantgtaagaaancaaaatctaaaacaacaatctg

SEQ ID NO: 6560 - DNA, 100 bp, Homo sapiens
  misc_feature 8, 13, 31, 38, 54, 84: n = A,T,C or G
tacgaggntcagncagccaatattccgttanccaaagntaccaaatgtgacttngtgcccacacactgtacaatatgatgtgtnaatgctgcgtgccgga

SEQ ID NO: 6561 - DNA, 140 bp, Homo sapiens
  misc_feature 42, 60, 64, 77, 80, 82, 91, 101, 110, 129: n = A,T,C or G
atgatgttagctggttatttggcttgttagctgatgcagttnctccctagcatctatggncttnaccatttggcatnttntngcagtggcngggatcaggngttcctttncatgtttagagcttccttnaggagctcttt

SEQ ID NO: 6562 - DNA, 101 bp, Homo sapiens
  misc_feature 17, 25, 40, 42, 50, 61, 63, 68, 72: n = A,T,C or G
cgggcgcttgcaggccnacactagnggattcaaagaattntntacgagcnctactgagcancngagcnctgncggacactgctggcgggggctcagggagc

SEQ ID NO: 6563 - DNA, 102 bp, Homo sapiens
  misc_feature 57, 67, 93: n = A,T,C or G
ccgcaggctcctcaataggttaggcatggacaaaatctatgaaggcctaaaggccgngactggggangaatacaatgaggaaagcattgatgntcagccagg

SEQ ID NO: 6564 - DNA, 100 bp, Homo sapiens
  misc_feature 9, 39, 51, 66, 80, 84: n = A,T,C or G
ctgtgtttntaagaagaaataattaggttccagatgtgnaaaaggatcttntgtactgaggttctnaacactttacttgngttnaccaagcctcaactgg

SEQ ID NO: 6565 - DNA, 186 bp, Homo sapiens
  misc_feature 15, 17, 30, 44, 55, 73, 78, 81, 82, 83, 84, 87, 91, 95, 116,164: n = A,T,C or G
cgggcgcttgcaggncnacactagtggatncaaagaattctttncgaggctgccnggaaaattctcggatatnaccgntgnnnngcnggcnggcnggcggatggcagcgtccgctnccccatctctaggcctagaaggcgctgaggccctactgaggctgcggngcgcttcgggggtttcccagat

SEQ ID NO: 6566 - DNA, 100 bp, Homo sapiens
  misc_feature 17, 25, 44, 55, 89: n = A,T,C or G
cgggcgcttgcgggtcnacactagnggattcaaagaattcgttncgagctgccgntcttttcagtttttgcttatacagcaattcactnctttgctgctt

SEQ ID NO: 6567 - DNA, 104 bp, Homo sapiens
  misc_feature 8, 23, 36, 40, 43, 51, 76, 82, 93: n = A,T,C or G
acactagnggattcaaagaattntttacgaggcgantggngangatgtacnatttcgggctgacaacttgaacaanctgaanaacctatgcanctagacaatcg

SEQ ID NO: 6568 - DNA, 113 bp, Homo sapiens
  misc_feature 15, 17, 29, 30, 41, 43, 54, 70, 72: n = A,T,C or G
cgggcgcttgcaggncnacactagtgganncaaagaattcntnacgagatcgcntgagtgtgtgtgactntnattttttctttctttgtctataagaaggaaacataccatag

SEQ ID NO: 6569 - DNA, 100 bp, Homo sapiens
  misc_feature 12, 15, 80, 83: n = A,T,C or G
cgggcgcttgcnggncgacactagtggattcaaagaattctgcacgagctgaatacttcttccctgccaggccgcgctgnganctggcttcactgcctcc

SEQ ID NO: 6570 - DNA, 104 bp, Homo sapiens
  misc_feature 11, 12, 34, 41, 43, 50, 69, 72, 92, 95, 96, 97: n = A,T,C or G
cgggcgcttgnnggccgacactagtggattcaangaatttngnacgaganttattataactttgttccnganaacactggacacactgaagnggnnnacagcgt

SEQ ID NO: 6571 - DNA, 100 bp, Homo sapiens
  misc_feature 2, 4, 28, 30, 43, 45, 56, 63, 66, 73, 77, 79, 97: n = A,T,C or G
gncnacactagtggattcaaagaattcntncacgagggcaccngngatccccgctnctcgggnggntgaggcnctanantcatttgaaccctggagncct

SEQ ID NO: 6572 - DNA, 100 bp, Homo sapiens
  misc_feature 28, 31, 55, 56, 73: n = A,T,C or G
ggccgacactagtggattcaaggaattntgnacgagtgtaattagaaaacacagnntataagaacagtcaatnttttaaattttccaaattaaaaaattg

SEQ ID NO: 6573 - DNA, 100 bp, Homo sapiens
  misc_feature 5, 14, 55, 63, 65, 67, 87, 98: n = A,T,C or G
gcgcntgcacgccnacactagctggattcaaagaattctgcacgaggcgatgggnatatgtgngnanatctggcacaatcgccgaanaaccgggggcnag

SEQ ID NO: 6574 - DNA, 102 bp, Homo sapiens
  misc_feature 2, 4, 62: n = A,T,C or G
gncnacactagtggattcaaagaattcttcactacaagccaagacgggaactgaaggtgtgngtgtcgagccctctggcccagggttaacactgggtcaaat

SEQ ID NO: 6575 - DNA, 100 bp, Homo sapiens
  misc_feature 2, 40, 71, 94, 97: n = A,T,C or G
gnccacactagtggattcaaagaattcggttctagggctncaaggctgtggtgtctgggaaactccgaggncagagggctaaatccatgaagtntgngga

SEQ ID NO: 6576 - DNA, 100 bp, Homo sapiens
  misc_feature 6, 13, 39, 41, 61, 98: n = A,T,C or G
ggcgcntgcaggncgacactagtggattcaaagaattcntnacgagcccgacactgcgggntggcacaacggcaccctcccgctttctctctgcctcnga

SEQ ID NO: 6577 - DNA, 145 bp, Homo sapiens
  misc_feature 11, 13, 27, 33, 36, 39, 54, 56, 63, 66, 67, 72, 76, 80, 84,90, 127, 132, 137: n = A,T,C or G
gacatggccanangtaccaagaaagtngggatngtnggntaatacgggacccgntntggggcnttnntgcgnaaantggngaanaaaatngaaatcatgccagcacgccaagtacacttgctctttntgtgncaaanccaagatg

SEQ ID NO: 6578 - DNA, 100 bp, Homo sapiens
  misc_feature 53, 93, 99: n = A,T,C or G
gtcatataggtacattgaggcgatggcttacttaatacttctgaaaaatgganaaagggagaaacggaaatgctgcaatgtgaacctcccatngggccnt

SEQ ID NO: 6579 - DNA, 100 bp, Homo sapiens
  misc_feature 12, 46, 55, 70, 74, 84, 98: n = A,T,C or G
tggcgcttgcangacccacactagtggattcaaagaattcttttcnagctcttgntttgaggggacctanaggngacttggganaaaagggggagcgngg

SEQ ID NO: 6580 - DNA, 100 bp, Homo sapiens
  misc_feature 4, 28, 31, 35, 45, 48, 58, 64, 68, 75, 80, 89, 91, 92, 98: n = A,T,C or G
aacngttccccacatccttactggctgnctnattntatggatgtntgnacgtggtctntaccgnttgncggaganaaagngaaagaaangnnggtaantg

SEQ ID NO: 6581 - DNA, 100 bp, Homo sapiens
  misc_feature 2, 40, 45, 55, 59, 62: n = A,T,C or G
cnggagcttgcaaggcgacactagtggattcaaagaattntttangagtgacctncacntcnccgccctgcgtgcaagtgaagcggaatgactacgtgcc

SEQ ID NO: 6582 - DNA, 126 bp, Homo sapiens
  misc_feature 7, 10, 13, 30, 38, 40, 56, 73, 90, 92, 97, 112, 123: n = A,T,C or G
gcttgcnggnccnacactaggggattcaangaattctntncgagggcaaaagaggnatgcatgtgtgcccatnccttctgtctgtctgananaatcnataatgcctctaaanccttgagcgcncgt

SEQ ID NO: 6583 - DNA, 100 bp, Homo sapiens
  misc_feature 2, 4, 26, 28, 41, 50, 76, 82: n = A,T,C or G
ananccactcctcaaccttgtgctgnanggcaccattgagnacatgcganaccctgacgaccagtacaagctcacngagganacccggaaactgggcctc

SEQ ID NO: 6584 - DNA, 169 bp, Homo sapiens
  misc_feature 7, 14, 29, 30, 55, 65, 71, 80, 83, 89, 112, 156, 158: n = A,T,C or G
gggcgcntgcaggncccacactagtgganncaaagaattttttacgagaacgggnacaaacgagncctggncttgtgtgnggngacggnttacaccttcccacttgctgaanaggtcaaggccttcttggctgatccatctgcctttgtggctgcngnccctgtggctg

SEQ ID NO: 6585 - DNA, 101 bp, Homo sapiens
  misc_feature 2, 8, 18, 44, 47, 48, 55, 59, 64, 67, 70, 76: n = A,T,C or G
cnggcgcntgcaggcccnacactagtggattcaaagaatttttncannagggaangagngaggnacnggngacgtnaagctcctgaagcacaaggagaaag

SEQ ID NO: 6586 - DNA, 106 bp, Homo sapiens
  misc_feature 12, 30, 41, 44, 49, 56, 58, 66, 70, 92, 94: n = A,T,C or G
gggcgcttgcangacccacactagtggatncaaagaatttntangagcnggatagntntatgcggntctnacagcacatcacctctttgccncngacggctgtgac

SEQ ID NO: 6587 - DNA, 100 bp, Homo sapiens
  misc_feature 92: n = A,T,C or G
tccatcgttcaccggaaatgcttctaaacggactcaccggatgcgtagattctgctgcttgggtgaatggagaatagaaatttgcccctggnaaatgcgc

SEQ ID NO: 6588 - DNA, 140 bp, Homo sapiens
  misc_feature 2, 9, 11, 23, 28, 30, 37, 43, 48, 68, 73, 75, 84, 89, 95,98, 116, 121, 129: n = A,T,C or G
anttgacananaggggaaacccngaaangnggttggntgcagntgtgnagtatgttaaggactatggnacggngnctcaggccnaggangtcatngangagtatttcaaatgcaanaaatnaagaaatnaatctttggct

SEQ ID NO: 6589 - DNA, 100 bp, Homo sapiens
  misc_feature 6, 13, 28, 53, 56, 65, 78, 82: n = A,T,C or G
ggcgcntgcaagnccacactagtggatncaaagaattcttttacgagccttgnagnattcttggncttttgctgcctncctnactctcacggtaattaat

SEQ ID NO: 6590 - DNA, 120 bp, Homo sapiens
  misc_feature 16, 33, 38, 46, 48, 62, 71, 84, 92, 101: n = A,T,C or G
cactagtggattcaangaattctttttcgagcngaaangctgcatncntgtccaagtgcctnggagaactnacagacactcacnccttaatnaaaggtttnaccaggcccttggacacta

SEQ ID NO: 6591 - DNA, 100 bp, Homo sapiens
  misc_feature 1, 14, 33, 36, 37, 52: n = A,T,C or G
ncatcttcttaccntggcttccacagaagctcnganncttgggcaagcgganaaactaaattgtacctatgttgcttatgtgagatggtgaaataaattg

SEQ ID NO: 6592 - DNA, 170 bp, Homo sapiens
  misc_feature 1, 12, 14, 41, 44, 45, 54, 55, 58, 68, 79, 82, 83, 107, 118,120, 128, 131, 135, 151, 161, 168: n = A,T,C or G
nggcgcttgcangnccacactagtggattcaaagaattcgntannaggacctgnntgnctaagtggcngaggccagcgngcnntgagctggcctgcctggaccttgntccctgggggngngggcgctngcncacnagagggaccaaagggngcacccacancctgctnca

SEQ ID NO: 6593 - DNA, 100 bp, Homo sapiens
  misc_feature 2, 17, 32, 37, 41, 60, 90: n = A,T,C or G
gnttcccctttgaactnccagaagggatgccntaccntgcncccttaggacccggactgnccgagtgcacaaactttacgagccaaaatnctaaaagaat

SEQ ID NO: 6594 - DNA, 199 bp, Homo sapiens
  misc_feature 18, 41, 65, 68, 108, 129, 135, 142, 154, 160, 177: n = A,T,C or G
acgagtccattgaaagantgggtggcatgatataaggcccnaaggccttttcttttagagtttanatntaatatgacagattagcccttatttctcgatgctgggaancactgacagaaaccaagctangacgcngggaaanggccaataaganatagtntaaatctctctctgctntgtggcaaataaaaagtaaata

SEQ ID NO: 6595 - DNA, 101 bp, Homo sapiens
  misc_feature 16, 17, 39, 40, 67, 70: n = A,T,C or G
ggcgggagaaaaagtnnaaaagccgaatactaaagagannaaacccgaagccccgaaggttgatgcnggnggcctggtgaaaaagggtaacctgaaagctt

SEQ ID NO: 6596 - DNA, 100 bp, Homo sapiens
  misc_feature 3, 19, 31, 35, 38, 40, 45: n = A,T,C or G
cgncactagtggattcaangaattcttttcnaggntangngttgnaagatggttagacgtacctatggcgcttgggcacaaggtgccaatgggattctgc

SEQ ID NO: 6597 - DNA, 100 bp, Homo sapiens
  misc_feature 11, 15, 42, 45, 67, 82: n = A,T,C or G
ggcgcttgcangccnacactatgtggattcaaagaattttgnacnagaaagccttacccactacccntcccactctcctgtnatccaggtggtccaggag

SEQ ID NO: 6598 - DNA, 101 bp, Homo sapiens
  misc_feature 41, 63, 65, 81: n = A,T,C or G
gatgaggcttccaagaatgaggcaaaactggattgaggcancttctgaagataaaacctgaanangtgctgggagcctggnattctatattatgactgctt

SEQ ID NO: 6599 - DNA, 116 bp, Homo sapiens
  misc_feature 79, 108: n = A,T,C or G
acgaggccaggatgagatgtgcagagatgcgtaagagatgtccaaggcatataggcaactcttcatcctactttatctnacttcaattacttcatcctactatgctanaaggaagg

SEQ ID NO: 6600 - DNA, 122 bp, Homo sapiens
  misc_feature 3, 10, 36, 39, 46, 52, 63, 70, 71, 81, 85, 99: n = A,T,C or G
tgnacgagcntcaaagctacacagacatgggcctangtntgtacanctgtantaatttataanttactgnntggctggaangtanaagtacagaaaatntgttaaagggaattaagatggag

SEQ ID NO: 6601 - DNA, 105 bp, Homo sapiens
  misc_feature 2, 7, 16, 31, 34, 44, 48, 55, 67, 71, 75: n = A,T,C or G
tnctccnaccgttcgnctgcttggcaaggcngtncaggacgtgnactnccccaantcggcactgagnggcncagnaccgcatagccctgcaaccctactgcccta

SEQ ID NO: 6602 - DNA, 100 bp, Homo sapiens
  misc_feature 9, 27, 28, 83: n = A,T,C or G
aaacagccnccgaaaacgctacgtganntgggccctgggccccaggcccaaaacggacggaagaaaaggtctggccgatgggnctcactctgtcacccag

SEQ ID NO: 6603 - DNA, 100 bp, Homo sapiens
  misc_feature 2, 19, 46, 52, 92: n = A,T,C or G
cnacactagtggattcaangaattcttttcgaggctacaacgtggnggcctnctggagacaggctgaactcatctacatccgatactcccanatttgtgc

SEQ ID NO: 6604 - DNA, 100 bp, Homo sapiens
  misc_feature 2, 14, 31, 52, 61, 63, 70, 82, 92: n = A,T,C or G
gngcttgcacggcnacactagtggattcaangaattcggcacgagctcactntctgcgtgnangccatcnacttctactctnaagacctgcnagctgggg

SEQ ID NO: 6605 - DNA, 100 bp, Homo sapiens
  misc_feature 3, 4, 48, 65, 71: n = A,T,C or G
ganngaaaggcagaacaggagaaagggagttcccagacagcgctaccncccagccaggaaatggngattgntttctcaacaagaaaatgagaggcaggta

SEQ ID NO: 6606 - DNA, 100 bp, Homo sapiens
  misc_feature 8, 11, 29, 43, 46, 47, 54, 61, 65, 69, 76, 78, 82: n = A,T,C or G
gctgcagnganctatgattgcaccactgnaccccagcctgggnganngatcganaccctgnctcnctgntacccancngccnctacgaagtttccaaatg

SEQ ID NO: 6607 - DNA, 140 bp, Homo sapiens
  misc_feature 3, 5, 20, 100: n = A,T,C or G
aancntgaacccctaaacancacaatccgttgctaacccgaaggacccaaggactttccaatctcagacactctaggactctgcgctgaatggctgaccngacctgatgtccattcatcccaccctctcacagtttggac

SEQ ID NO: 6608 - DNA, 100 bp, Homo sapiens
  misc_feature 4, 11, 47, 52, 57: n = A,T,C or G
catnccacccnctacctccatatgggaccttgcaagccatcccacangctgnactgncaggaagaggaccctgggccccagcactgggcttcagctataa

SEQ ID NO: 6609 - DNA, 100 bp, Homo sapiens
  misc_feature 11, 15, 29, 31, 36, 45, 54, 57, 60, 75, 76, 92, 96: n = A,T,C or G
accccatgggnactnagcacatcaaggangngaggnagtggggancaaggaagnctngcnggggccaggcaccannggctcatgcctgtaangctngcac

SEQ ID NO: 6610 - DNA, 106 bp, Homo sapiens
  misc_feature 37, 42, 86, 98: n = A,T,C or G
ctcgcgacgtgagattatccacatcctctcttctccnctacnggtggagagggggagaggcagccatgttgatatggactgataangctcagacaggngtgtcccc

SEQ ID NO: 6611 - DNA, 103 bp, Homo sapiens
  misc_feature 25, 26, 42, 51, 52, 55, 57: n = A,T,C or G
gacactagtggattcaaagaattcnntacgagcttcttactnctgaaggcnntananagaacccagactagcacatgccgagatttgagacttagccacccag

SEQ ID NO: 6612 - DNA, 100 bp, Homo sapiens
  misc_feature 2, 4, 62, 66, 75, 81, 84: n = A,T,C or G
gncnacactagtggattcaaagaattctgcactagcgaggctggtggatcacttgaggcctngagnctgggaccntcctgnccnacatggcaaaacccca

SEQ ID NO: 6613 - DNA, 101 bp, Homo sapiens
  misc_feature 30, 81: n = A,T,C or G
gtctatgtgtgtgcgcgtgcgcctgagggngggcatgagtcttgccatattgtgagtgtgagagtgataatgcgggggtgngtgtgagagggactgcgttt

SEQ ID NO: 6614 - DNA, 100 bp, Homo sapiens
  misc_feature 13, 20, 21, 24, 39, 59, 66, 72, 86: n = A,T,C or G
atttaaaggaacngcggtanngcntcctctgtagagctntgaaaaggttgactatatanaggtctngagtgnttgtacttggtcangtgtttctcacatc

SEQ ID NO: 6615 - DNA, 100 bp, Homo sapiens
  misc_feature 2, 4, 53, 63, 68, 72, 77, 91: n = A,T,C or G
gncnacactagtggattcaaagaattcttttcgaggctcccagctgccctganctcggggggntggcnttcngcccngggaaaagcggaanaggtctgca

SEQ ID NO: 6616 - DNA, 100 bp, Homo sapiens
  misc_feature 18, 24, 33, 45, 47, 57, 62, 70, 74: n = A,T,C or G
aagagctccttaccatcnctgccncaggcgganatgaaattcacncnctttcctggncactnaggacctnaatnctttttcatttgagaagtaaacaaaa

SEQ ID NO: 6617 - DNA, 171 bp, Homo sapiens
  misc_feature 71, 130, 151: n = A,T,C or G
gacaaacagagatatcatttgtcagattgcttatgcccgtatagagggggatatgatagtctgcgcagcgnatgcacacgaactgccaaaatatggtgtgaaggttggcctgacaaattatgctgcagcntattggactggcctgcctgcngggcccgcaggcttctaaat

SEQ ID NO: 6618 - DNA, 264 bp, Homo sapiens
  misc_feature 15, 92, 221, 224: n = A,T,C or G
tccatacggcgttgntctggattcccgtcgtaacttaaagggaaattttcacaatgtccggagcccttgatgtcctgcaaatgaaggaggangatgtccttaagttccttgcagcaggaacccacttaggtggcaccaatcttgacttccagatggaacagtacatctataaaaggaaaagtgatggcatctatatcataaatctcaagaggacctggganaancttctgctggcagctcgtgcaattgttgccattgaaaacc

SEQ ID NO: 6619 - DNA, 176 bp, Homo sapiens
ggtgtgcaccaccatgcctggctaattttttttgtatttttagtagagacagggtttcaccatgctggccaggctggtcttgaactcctgacctcatgatctgcccatctcagcctcccaaaatgctgggatgacaggcgtgagccactgcacccagctccttcagatttttttgg

SEQ ID NO: 6620 - DNA, 294 bp, Homo sapiens
  misc_feature 70, 185, 188, 258: n = A,T,C or G
gttttgtcagttcccagcttcttcgtttagaataaattagaccaaaagaagaaacgtgcttgtctctgtntacccgcagaatgaagttactgttgttaaaactggattttttcattttactaggttccgaagagtccagatgcttggtagatgttcaatacgtgattttttttttaattgaatgngtncatttaaaatcctccttaacatttctagaaagacttctttcaataaataatggaatcttagaggaaaagnggttttttaaaagctagggaactcctccactaaaag

SEQ ID NO: 6621 - DNA, 125 bp, Homo sapiens
  misc_feature 33: n = A,T,C or G
cctacaagaatctggtatgtggctgggcatggntgctcacacctgtaatcccagcactttgggatgctgaaacgggcagagcccaggagctcgagaccagcctgagcaacatggcaaaatcctgt

SEQ ID NO: 6622 - DNA, 227 bp, Homo sapiens
  misc_feature 60, 198: n = A,T,C or G
gtctccctggcctcagggctctgactctgccagggtggggctctctaacccacaggtgtnggctgcctggcccatgtgcccactgtctcttccacttggtctgggtttggcaggcactgcctgctacttgagggccaggatgctcccccagggaagaaacggaatagtgtggggtgtgtgcagggctgcatcccgcanatggctggaatattaaaattcttctatat

SEQ ID NO: 6623 - DNA, 373 bp, Homo sapiens
  misc_feature 69, 303: n = A,T,C or G
ccaaccttcaccatgttctcgtgacaggcaggggcctggagcgcctgagtggggtggggaagggcgtgnagaggacaacaatgagcgccctctccgggatcggtgggtgcagccacctactgactggtggaacactgaaagctctgctgcaggtggggttataggtgggaaactgagtcacagaaaggttgagtgacgggcccaagctcacacaggaagtaaaacagggctgtgggccggaagcagtggctcatgcctgtaatcctggtactttgggaggccgaggcgggcagattgcctganctcatgagtttcaaaccagcctgggtaacatggtgaaaccccgtctctactaaaaatacaaacaaattag

SEQ ID NO: 6624 - DNA, 375 bp, Homo sapiens
  misc_feature 37, 113, 188, 306, 362: n = A,T,C or G
gagggccaggtggtggcggaggggaatgacggtgganggggagcaggaaggccaagcctgggcagcgagaagaagaaagaggacccaaggagagcacaagtcccaccaaccanagagagtcgggtgaaggtcctgagaaaactggccgccactgcaccagcttttccccaacctccctcaacccccanagccaccacccttcctcctgccccagccacaacagtgactcggtccacgtcccgggcggtaacagttgctgcaagacctatgaccaccactgcctttcccaccacgcaaaggccctgnaccccctcaccctcccacaggccccctacaaccactgaggtgatcactgccagganaccctcagtttca

SEQ ID NO: 6625 - DNA, 228 bp, Homo sapiens
  misc_feature 27, 72: n = A,T,C or G
ggcattttaccaagtccggctgaaagngcttcttaccacatctggcatgtagaatggcagaagactattttngctagattccttgttgctgcagccgtttctgatgtccttttccccttcacacctttcgtgttacacatgtctgagatgacatgatgctaagtaaccaaagtactgctgcgatggaattgctctgatgtttttttccagagtgaaagctgctattac

SEQ ID NO: 6626 - DNA, 292 bp, Homo sapiens
  misc_feature 257: n = A,T,C or G
cggagaaagcgctgcaggaataccgcaaaaagcaccgggaggagtgagatgtggatgttgcttttgcacctacgggggcatctgagtccagctccccccaagatgagctgcagccccccagagagagctctgcacgtcaccaagtaaccaggccccagcctccaggcccccaactccgcccagcctctccccgctctggatcctgcactctaacactcgactctgctgctcatgggaagaacagaattgctcctgcntgcaactaattcaataaaactgtcttgtgagctga

SEQ ID NO: 6627 - DNA, 133 bp, Homo sapiens
  misc_feature 34, 78, 82, 104, 132: n = A,T,C or G
gcctaccaaaagtcacgcacgaccatctttcaanacaagaagagggtcctgctgggagaaactggcaaggagaagctnccgnggtactacaagaacatcggacngggcttcaagacacccaaggaggctatng

SEQ ID NO: 6628 - DNA, 351 bp, Homo sapiens
  misc_feature 199, 220, 223, 240, 339: n = A,T,C or G
gccaatttcaaattgtgaacccagagacactcccatccacccttctccatgctcatccccaaactggggcctggagcaaggcactctcaaatcttgaaccctggaccaaagcttttccagaccccaccctaccttccaacccaggtcaagacattgccaaatcttgaactcagaacccaagtgttccatgcccctgtgnggatggagtcgggtatcctgnacntggttgggacccctggnccaggtgatcccgaccctcaccagtcccatttgcctccctccagctctgcttaggcattttgcccctcaccccaatgttccacaccatcgacaaccaangggtgaaggggg

SEQ ID NO: 6629 - DNA, 404 bp, Homo sapiens
  misc_feature 12, 32, 55, 325: n = A,T,C or G
gcgcaacagccntggcttttaaggataccggnaaaacacccgtggagccggaggnggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcantattgagccaggagttgaggtgggaagtcaccattgcagatgcttaagtcaactattttaataaattgatgaccagttg

SEQ ID NO: 6630 - DNA, 365 bp, Homo sapiens
  misc_feature 52, 262, 321: n = A,T,C or G
gtcatcattgagagcgacctggaacgtgcagaggagcgggctgagctctcanaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttanaagagaaagtggctcatgccaaagaagaaaaccttagtatgcatcagatgctggatcanactttactggagttaaacaacatgtgaaaacctccttagctgcg

SEQ ID NO: 6631 - DNA, 465 bp, Homo sapiens
  misc_feature 349: n = A,T,C or G
gaattgaagtggttggtacatggatacctgttctttaaaaggaatgtgggagatgagtcaagggtgaggccgattgttctgcccatgccctaccataccaatttcaataacaatcttgcctgtcattgcactcagaatcttaagatcatgtttcaaatatgttgattcaaacttgcttctaagcctgagtccagggatagcaatggtactgaccagctatggactgggagaacattgagtcctgttttccattggcttcagggcgcatccatgtggatataggaaaagcctctttccacagacttaggaagccccccgaccacgcggacgctcgctgggctgcactcancaggctgcttgagtgggagctgactccaacatgccctgccctggctgggactaggcatgcttccagcccttcccgtgctctccctgctgtcaacacttgcgtacaaacctgcctag

SEQ ID NO: 6632 - DNA, 347 bp, Homo sapiens
  misc_feature 100, 143, 220, 274, 314: n = A,T,C or G
catctgccaccctctccgatatttcatacatcatgacctggaaagtctgcatcactctggccatcacttcctggacatgtggctccctcctggctatggnccatgtgagcctcatcctaagactgcccttttgtgggcctcgngaaatcaaccacttcttctgtgaaatcctgtctgtcctcaggctggcctgtgctgatacctggctcaaccaggtggncatctttgcagcctgcatgttcatcctggtgggaccactctgcctggtgctggnctcctactcacacatcctggcggccatcctgaggatccantctgggggagggccgcagaaaggccttctccac

SEQ ID NO: 6633 - DNA, 469 bp, Homo sapiens
  misc_feature 15, 218, 423, 444: n = A,T,C or G
agtggatccaaaganttcggcacgagggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgngtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatctnctttataattctactttgagngctggctccatgtttgatgtatctg

SEQ ID NO: 6634 - DNA, 108 bp, Homo sapiens
  misc_feature 4, 18, 23, 32, 46, 53, 64, 75, 81: n = A,T,C or G
accntgcgtggctgtccntgacncaccgacgngatgcccagggaanacagggngacctggaaanccaactacttncttaanatcttccaactattggatgattatccg

SEQ ID NO: 6635 - DNA, 100 bp, Homo sapiens
  misc_feature 3, 5, 31, 58, 61, 81, 99: n = A,T,C or G
gtnantgaaggatgggatgaaggaatcgagntgattcaatgaaaagtatcacaagaanagngattgatcaacaaggagaantaaaaaagcccaagaggna

SEQ ID NO: 6636 - DNA, 404 bp, Homo sapiens
  misc_feature 7, 155, 242, 256, 314, 322, 324, 391, 395: n = A,T,C or G
gtcgcgnggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctancacgtggaattcgcgaagctgccaaagccttaaacaagcgccaagcccatctttgtgtgcttgcatccaactgtgatgagcctatgnatgtcaagttgggnggaggcccttttgtgctgaacaccaaatcaacctaattaaggttgatgacaacaaganactagganantggggtaggccttttgtaaaattgacagagaggggaaaccccgtaaagtggttggttgcagttgtgnagtngtttaagga

SEQ ID NO: 6637 - DNA, 436 bp, Homo sapiens
  misc_feature 228, 325: n = A,T,C or G
caaatccgatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagnccaccaggagacgcaatccaccaccacgaactcttcatccgatcagcacgagccattcatgtgctgaaacaccaagatctgtggaagaaatcctcanaggagcccgagtcccagtggcacccgactcgctctcctctccctcaccgacgcccctgagtcgaaataatctgctaccacctattggcacagctgaagtggaacatgtgag

SEQ ID NO: 6638 - DNA, 126 bp, Homo sapiens
  misc_feature 89: n = A,T,C or G
cctcgtgccgtgaaagcaaagaaataattttaatactctggcattcataaattttattgatgagattatttattttaaaggtttgaggnaacatctctggttgtaccaaagaagaaataaatatgg

SEQ ID NO: 6639 - DNA, 104 bp, Homo sapiens
  misc_feature 2, 13, 17, 23, 71, 82, 90: n = A,T,C or G
anatgatccttgntgantatctnaaggttttttggttgaaagaagaaaaaccgacaaacaaagcttatttnctcattaaaangaaacctnttttgctacttaag

SEQ ID NO: 6640 - DNA, 100 bp, Homo sapiens
  misc_feature 2, 5, 7, 28, 29, 43, 45, 63, 75, 81: n = A,T,C or G
cnttnangatttaatgcttgcttgctcnntttatacgctaatngngaaatctacaaaccatanacaacgcaactnttaaanctgggatttaaattaaaga

SEQ ID NO: 6641 - DNA, 373 bp, Homo sapiens
  misc_feature 303: n = A,T,C or G
ggtgtctggaggctgtggccgttttgttttcttggctaaaatcgggggagtgaggcgggccggcgcggcgcgacaccgggctccggaaccactgcacgacggggctggactgacctgaaaaaaatgtctggatttctagagggcttgagatgctcagaatgcattgactggggggaaaagcgcaatactattgcttccattgctgctggggtactattttttacaggctggcggattatcatagatgcagctgttatttatcccaccatgaaagatttcaaccactcataccatgcctgtggngttatagcaaccatagccttcctaatgattaatgcagtatcgaatggacaagtccgaggtgatagttaca

SEQ ID NO: 6642 - DNA, 162 bp, Homo sapiens
  misc_feature 5, 11, 12, 24, 27, 50, 61, 69, 84, 101, 139, 143: n = A,T,C or G
cctcnaactgnngctgttcaccantgnatataattgtattccctaggagnaaccctaaaanactcattncagaaaagctcctanaatctttattaaaaagnaatttcagttaaattttttcaaaatttctggaaaaacntttngggactttttttgggttgg

SEQ ID NO: 6643 - DNA, 167 bp, Homo sapiens
caaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaagt

SEQ ID NO: 6644 - DNA, 455 bp, Homo sapiens
  misc_feature 204, 326, 423, 432: n = A,T,C or G
cattgtttctaagttcttctatgtttgtaatttccaaacagagcaccggtctttttctcttcctttaagaaaaaaacaataaaaacgaaattcactggctgagtcaatagactccgtgggtcatggaagcaaattacaaagctagtacaatggatttgagaaattgctaatgtaatcagattttgaacaaactttggaaatggnccctatttcacagcaccaagggtatttttataaactgttcattgctttcaacaaccccattataagaccaactaaaagtgagaaaagcaaattcagcagcaacctatcttgtcaagacaaanaaaccttcctcactgttttcagagaaatattcaataccgaataatcctatttgaattttgccactcatagaagtttagaaagagggacttacataanaaattgcancagggcagggaatgaagagtgca

SEQ ID NO: 6645 - DNA, 117 bp, Homo sapiens
  misc_feature 27, 38, 69, 73, 86, 93, 95: n = A,T,C or G
tgatattcactacactgccctctttgnagaatgctttnttgcactttttactgagtctcccagactagnaaantctcaacttctgngctcaantncattaagtgttcaaagaaatag

SEQ ID NO: 6646 - DNA, 364 bp, Homo sapiens
  misc_feature 40, 294, 340: n = A,T,C or G
ggccaggaggcggaagagaggagcacagaagggcagtggntccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagangctgtcccaagagctagatgaagccattatggcggaagagagtggngacattcgtctctctcattcatga

SEQ ID NO: 6647 - DNA, 400 bp, Homo sapiens
  misc_feature 336, 351: n = A,T,C or G
cagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgangagatgactcgctgnggcttctcgttggccttgggcgcccttccaggcttccttctgaaaggcc

SEQ ID NO: 6648 - DNA, 262 bp, Homo sapiens
  misc_feature 190: n = A,T,C or G
cccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgnggccgcaccgtgggtgtgtccaagaagaaataagtctgtaggccttgtctgttaataaatagtttatatacc

SEQ ID NO: 6649 - DNA, 361 bp, Homo sapiens
ctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaaagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgtcttaaatg

SEQ ID NO: 6650 - DNA, 357 bp, Homo sapiens
  misc_feature 153, 252, 307, 314, 347: n = A,T,C or G
cagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctnctatgtgcggaccaccatcaacaagaatgctcgcgccacgctcagcagcatcagacacatgatccgcaagaacaagtaccgccccgacctgcgcatggnagccatccgcagggccagcgccatcctgcgcagccagaagcctgtgatggtgaanaggaaancggacccgccccaccaagagctcctgagccccntgcccccaga

SEQ ID NO: 6651 - DNA, 373 bp, Homo sapiens
  misc_feature 117, 245, 251, 258, 292: n = A,T,C or G
gagggacagtctgcccatcgacggctggaggagtccctggacgccctgccccgcatctttgggcctggcagcatggccagcacagcattctaaactattcacccatgggttcctggngcccctttccccccactttcagggctcaccaggcactggcagggagggtaagggctggctccatatacccctcccccacagattcctagcaatgaaaatctaatatattcttctgttgcccctggggntggagnagtcagngcctgcagtcaagtgcctcccagcctcggctcancacatcccttgccacaaatcagtgtctggggcttggccaccctgccgctgcccagccacatcccttggttttgtattttat

SEQ ID NO: 6652 - DNA, 436 bp, Homo sapiens
  misc_feature 13, 219, 303, 384, 399, 412, 434: n = A,T,C or G
catacggcgttgntctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctggganaagcttctgctggcagctcgtgcaattgttgccattgaaaaccctgctgatgtcagtgttatatcctccaggaatactggccanagggctgtgctgaagtttgctgctgccactggagccactccaattgctggccgcttcactcctggaaccttcactaaccanatccaggcagccttncgggagccacggnttcttgtggttactgaccccangg

SEQ ID NO: 6653 - DNA, 255 bp, Homo sapiens
ggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcat

SEQ ID NO: 6654 - DNA, 366 bp, Homo sapiens
  misc_feature 188, 353: n = A,T,C or G
ggaggccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttncacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggnaaaaggaccaaga

SEQ ID NO: 6655 - DNA, 419 bp, Homo sapiens
  misc_feature 208: n = A,T,C or G
caaggctgaagacagagagctgatgagattttctgaccacggggctgctcttaacactgagaagcgttttccatgtgaattttgtggacgggcgttttcacagggctctgagtgggaaagacatgtgctgagacacggcatggcattgaatgacaccaagcaggtgagcagagaagaaatccacccaaaagagatcatggagaacagngttaaaatgccctccatagaggaaaaggaagatgacgaggccattgggatagacttttccctaaagaatgaaacagtagccatctgtgtagtaactgccgacaaatctctcctggagaatgcagaggccaaaaaagaatgagcgtttggtgaaattcttaatcaaaccttacttgaacagtgatgaaaaagtgggagggcttggctttggg

SEQ ID NO: 6656 - DNA, 369 bp, Homo sapiens
  misc_feature 109, 206, 231, 312: n = A,T,C or G
ctagttcttacttcaaaagaaaaataaacataataaaataagttgctggttcctaacaggaaaaattttaataattgtactgagagaaactgcttacgtacacattgcngatcaaatatttggagttaaaatgttagtctacatagatgggtgattgtaactttattgccattaaaagatttcaaattgcattcatgcttctgtgnacacataatgaaaaatgggcaaatnatgaagatctctccttcagtctgctctgtttaattctgctgtctgctcttctctaatgctgcgtccctaattgtacacagnttagtgatatctaggagtataaaagttgtccgcccatcaataaaaatcacaaagttg

SEQ ID NO: 6657 - DNA, 403 bp, Homo sapiens
  misc_feature 7, 60, 62, 312, 329, 337: n = A,T,C or G
ctcctgngggcctggcctcagggctatggacagactcctgtcccatcccagagacccctngngatcgtgccctggtgggtgttgcccccgcctgcctttgcctccgccgtggccctgagagtcctgggctctgccccgcccggtcccttgcttcccactcagctctggatttggggctgcccctaacccagcccgttgctgctttgcaccttttcctgtcattgggcatcccccagtagtcaccccactccaccgaaaagtaaactgcaggcacgtgggccgtggcccggctgggtcggctgaagaactgcngatggaagctgcggaanaggccctngatggggcccaccatcccggacccaagtcttcttcctggcgggcctctcgtctccttcctggtttg

SEQ ID NO: 6658 - DNA, 353 bp, Homo sapiens
  misc_feature 251: n = A,T,C or G
gaccagagatgtctttggaatgcacagaggtgtagtgacacgcagggagggagttttgtttttgaactctttggaataagattccttccaacataaaaatctcaagagattaagcaggaagtgattctggccttggcatgagttcagaggaacatgaaccgagtgtgggtaaatgtaaaatcacactgtggggagaggctggggtatttgagggcttctaccaggagaagagttctcagatgcctgatggnagttgagcaggggtggaattaaacctttttcctgtggcacttggaggtagaacaaggaggcatattggactctgtataaggaaggctttttgaatggtaaga

SEQ ID NO: 6659 - DNA, 320 bp, Homo sapiens
  misc_feature 34, 41, 111, 160, 166, 184, 274, 287: n = A,T,C or G
ggatccccaggcctaccaggtaaactgggttctntgggtanccctggcctccctggcttgcctgggccccctggacttcctggaatgaaaggtgacaggggtgtagtcggngaaccgggtccaaagggtgaacagggtgcctctggtgaagaaggtgaancagganaaaggggggaacttgganatataggattacctggcccaaagggatctgcaggtaatcctggggaacctggcttgagagggcctgagggaagtcgggggcttcctggantggaaggaccaanaggaccacctggaccccggggtgtgcagggaga

SEQ ID NO: 6660 - DNA, 440 bp, Homo sapiens
  misc_feature 5, 6, 7, 8, 10, 12, 16, 17, 27, 29, 33, 38, 112, 279, 306,399: n = A,T,C or G
cctcnnnngngnttcnntacgatatcngntcancccangagttcaagacctgcctggacaacatggagaaaccctgtctctacaaaacatataaaacttagatgagtgaagngccatgtgcctgtagtcccagcttctcaggaggttgaggcgggaggattgcttaaacccaggaagttgtggctgcagtgagctaagactgcaccactacactacaacctgggctatagagccagaccctgtctcaaaaaacaacaaaaatgttcgtcagcatatggngactcaaaaagcctggttgctcttggnaagaatcttcaaggaaagatgcgaaagagacgtgttgggagttctgagctgttttctttcagggagcaccctgtgtctcagaagacagcagantgggctccaaggtgaagttctgaaataggcaacagtgcttg

SEQ ID NO: 6661 - DNA, 299 bp, Homo sapiens
cggcacgagcgtgggtggactctgcccacaggaaaagcagggttacccctgcctccctgatccccttttttccaaaggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagagggg

SEQ ID NO: 6662 - DNA, 336 bp, Homo sapiens
  misc_feature 94, 114, 140: n = A,T,C or G
agtggatccaaagaattcggcacgagtgtgagttctgatcacttttgagctctgaagctttgaatcattcagtggtggagatggccttctggtnactgaatattaccttctgtnggaaaaggtggaaaataagcatctanaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaataagtctgtttcaatcttaaaaagaatcaataaaaacaaacaaggg

SEQ ID NO: 6663 - DNA, 354 bp, Homo sapiens
  misc_feature 7, 138, 179: n = A,T,C or G
tgttggncaggatggtcttgatctcttgatctcatgatctgcctaccttggcttcccaaagtgctgggattacaggtgtgagccaccacgcctagcctgagactttcaagtaaagccacaatggaccacagagcttanacatcagggctaacatggaatctctgtcattaaatcttganatcttattatctttgctcaaagaaaaaaataatcacaattgacattttggggacaagacatctgaatgtaaacttgatcttacaggatattaaggaattactggtaattttattaagggtatgacagtgatcatataaaaaatgccctcatgtttttagagggaaagtaaattac

SEQ ID NO: 6664 - DNA, 100 bp, Homo sapiens
  misc_feature 17, 24, 36, 99: n = A,T,C or G
acactagtggattcaangaattcngcactaggtgangaggcctggagtggtggctcacgcctgtaatcccaggactttgggaggccgaggcagcgcagnt

SEQ ID NO: 6665 - DNA, 249 bp, Homo sapiens
  misc_feature 144, 170, 187, 206: n = A,T,C or G
atcacaagctctcaataaacagttgtagtattgttattcaaattggtacacaggcctatcacttctccttccttttagatctttttttccctctgttctcgcctctgagtgccccaacccaatctctcttcctctgtcaccttnttaggaaatccatgcccacccaactnaccccaccactcctaanattccttaattcctttctntcctacccctggcctccaccacagctcctccattccccacctg

SEQ ID NO: 6666 - DNA, 299 bp, Homo sapiens
  misc_feature 44, 80, 157, 173, 255, 257: n = A,T,C or G
gggccttactggggaccctgcccccttccacccaggactctgtntgcctcctgctgccattcatggccctggggcttggncccaaccccactccaagatcagagagcaggcaactctgagcctgcagggacagggggtctttcctgggacacccganggtgctgactgcaganacgcccaggtgctgcatgcctaggagggcagccacagctgcaccccagagctcccaccccaccaactcagaagaggcagggntnccccttttcccgtcccctgcctgctttgtggaacgggaggcc

SEQ ID NO: 6667 - DNA, 353 bp, Homo sapiens
  misc_feature 77, 351: n = A,T,C or G
ctaggtcgcggcgacatggccaaacgtaccaagaaagtcgggatcgtcggtaaatacgggacccgctatggggcctncctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtncc

SEQ ID NO: 6668 - DNA, 434 bp, Homo sapiens
  misc_feature 180, 277, 325, 382, 389, 402: n = A,T,C or G
cctgactgaccctctgcttgtccacaaaggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgancaggcctcctcgtcggagagtgaccccgagggacccattgctgcacaaatgctgtccttcgtcatggatgaccccgactttgagagcgagggatcanacacacagcgcagggcggatgactttcccgtgcgagatgacccctccnatgtgactgacgaggatgagggccctgccgagccgcccccaccccccaagctccctntccccgncttcagactgaanaatgactcggacctcttcgggctggggctgga

SEQ ID NO: 6669 - DNA, 438 bp, Homo sapiens
  misc_feature 75, 120, 165, 232, 395: n = A,T,C or G
ggcatctctcgggacaactggcacaagcgccgcaaaaccgggggcaagagaaagccctaccacaagaagcggaantatgagttggggcgcccagctgccaacaccaagattggcccccgncgcatccacacagtccgtgtgcggggaggtaacaagaaataccgngccctgaggttggacgtggggaatttctcctggggctcagagtgttgtactcgtaaaacaaggatcntcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggnataagagattttaaacaaaaaacgatctaaaaaaattcagaag

SEQ ID NO: 6670 - DNA, 366 bp, Homo sapiens
  misc_feature 16, 23, 30, 139, 143, 270, 339: n = A,T,C or G
cctcactgttacctgntttgggnttctggnctactttgactttcaaagtacctccagcctcctcatacgcacagcttttggatgacctcagcttgagtttctccatatgtgcatgtacatctagcattctgcctacagntcanacagaagtcacaaaaaggccttcaactcaccaaaggtaaatatctgtatctattaggacattttttacatagacttcagttgagatgtatacttagcaaaattatttttaaattgaaacagcacagnaaatacttaatataaaatgtcccttggattttgcttcccatgtaaatctattgtattattacacttgtnataattttaactataaaggtccaattg

SEQ ID NO: 6671 - DNA, 365 bp, Homo sapiens
  misc_feature 157, 357, 365: n = A,T,C or G
gtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagngatgtggagctaggattgtgagtgacctgcaggccattatcagtgcctcatctgtgcagaagtcgcagcagagagggaccatccaaatacctaagagaaaacagacctagtcaggatatgaatttgtttcagctgttcccaaaggcctgggagctttttgaaaagaaagaaaaaagtgtgttggctttttttttttttanaaagttan

SEQ ID NO: 6672 - DNA, 356 bp, Homo sapiens
  misc_feature 144, 160, 355: n = A,T,C or G
cggcacgagtgttggccgagtggagactggtgttctcaaacccggtatggtggtcacctttgctccagtcaacgttacaacggaagtaaaatctgtcgaaatgcaccatgaagctttgagtgaagctcttcctggggacaatgngggcttcaatgtcaanaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaana

SEQ ID NO: 6673 - DNA, 251 bp, Homo sapiens
  misc_feature 178, 195, 205, 215: n = A,T,C or G
gcgtggaaagcttggtcggggcttctcacagccgcgcgcacagactggttctccccccgcgtctcccgggagcgtcgccgccacctgcacgcgtgcggcacacaaacgtcggtctcaccccttagtttctggaagagaaaaaaggaaaaagccaccgagaggcctgaccctgaggggncgggggggagatgcggncccgtagtanaagggaagcnactgaggagccggggactggggcagcattttgaatg

SEQ ID NO: 6674 - DNA, 427 bp, Homo sapiens
gctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatatt

SEQ ID NO: 6675 - DNA, 439 bp, Homo sapiens
  misc_feature 414: n = A,T,C or G
tcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtgtgggcggcgggcgcatctcccaccagagtcaggacaagaagattcacgtgtacggctattccatggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgnctttgcctgcactcctcttgcaggg

SEQ ID NO: 6676 - DNA, 354 bp, Homo sapiens
  misc_feature 105, 168, 169: n = A,T,C or G
gtgagaagccatgagcagcaaagtctctcgcgacaccctgtacgaggcggtgcgggaagtcctgcacgggaaccagcgcaagcgccgaaagttcctggagacggnggagttgcagatcagcttgaagaactatgatccccagaaggacaagcgcttctcgggcaccgnnaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctggccaagaagtatgatgcgttttttggcctcagagt

SEQ ID NO: 6677 - DNA, 222 bp, Homo sapiens
  misc_feature 145, 149, 175, 200, 209, 210: n = A,T,C or G
ggaatgcttataacctagtgaatatttctgctgagccttagttgtcttgtctaaaggaaaaaagagggaattgtggaataaaagtatttgttagtggaaattattgacctgaaaccctatcatattgttagtgtaactgaatgtntcanaaattgttcctatgtaggtattctgngaaactggtttctaaaatgttacangaaactgtnncctttttttttg

SEQ ID NO: 6678 - DNA, 131 bp, Homo sapiens
  misc_feature 12, 14, 38, 53, 59, 60, 71, 75, 90, 96, 100, 127: n = A,T,C or G
gcgcttgcacgncnacactagtggattaaaagaattcngcactagcagggagngaaggnnataacacgganccanctccacccttcctcncttgangcanaaaggactcaagattgccaaaggcctnttgt

SEQ ID NO: 6679 - DNA, 258 bp, Homo sapiens
  misc_feature 17: n = A,T,C or G
ggcttctgggtcctggngacggggctggcatgaccccgggggtcgtccatgccagtccgcctcagtcgcagagggtccctcggcaagcgccctgtgagtgggccattcggaacattggacagaagcccaaagagccaaattgtcacaatttgtggaacccacattggcctgagatccaaaacgcttcgaggcaccccaaattacctgcccattcgtcaggacacccacccacccagtgttatattctgcctcgccgga

SEQ ID NO: 6680 - DNA, 289 bp, Homo sapiens
  misc_feature 132, 222, 244: n = A,T,C or G
cagaacaggggcttccccaagttgcccagaaagactgtctgggtgagaagccatggccagagcttctcccaggcacaggtgttgcaccagggacttctgcttcaagttttggggtaaagacacctggatcanactccaagggctgccctgagtctgggacttctgcctccatggctggtcatgagagcaaaccgtagtcccctggagacagcgactccaganaacctcttgggagacagaagangcatctgtgcacagctcgatcttctacttgcctgtggggagggga

SEQ ID NO: 6681 - DNA, 402 bp, Homo sapiens
  misc_feature 112: n = A,T,C or G
cagcctcctgagtagctgagactacaggtgagtgccaccacactcagctaatttttaaattttttgtagacagggtctccctatgttgcccaggctggtcttgaactcctanactcaagtgatcctcctgtcttggcctcccaaagtgctgagattacaggtgtgagccactgtgcccagcagtttcccagaatatatttaaatgcaaagttacatgaggggaaaacatgtatgtttgctcctgttgttactgggtaggttctgaacagcagaaacccatgtgcagggtgggctggtgaaggcccctctccgcaaggtggtagcaggaaaaggtccttgacttgatgaatttggtctgcctctgagccactggaggaagctgttttgagccagggttttttg

SEQ ID NO: 6682 - DNA, 295 bp, Homo sapiens
  misc_feature 2, 30, 164, 179: n = A,T,C or G
anagagtcaccatctggggctgggcatggnggctcacacctgtaatctcagcactttgggaggccaaggtgggtggatcacaaggtcaggagatcgagaccatcctggctaacacagtgaaaccccatctctactaaaaatacaaaaaattagctgggcgtggnggcacatgcctgtantcccagctactcgggaggctgaggcaggggaatcacttgaacccaggaggcggaggttgcagtgagctgacatcgtgtgccactgtactccagcctgggtgacagagcgagactcc

SEQ ID NO: 6683 - DNA, 100 bp, Homo sapiens
  misc_feature 2, 8, 17, 21, 24, 26, 28, 54, 79, 85: n = A,T,C or G
gnacgatnctctggtcnttgngcntntncaagtgaacaaagcacctaagatgcnccgacggacctacagagctcatggncggatnaacccatacatgagc

SEQ ID NO: 6684 - DNA, 207 bp, Homo sapiens
  misc_feature 40, 177: n = A,T,C or G
tcagcctgtctcccccaacaccccgcctgcctcctggctnaggcccagcttattgtgtgcgctgcctggccaggccctgggtcttgccatgtgctgggtggtagatttcctcctcccagtgccttctgggaagggagagggcctctgcctgggacactgcgggacagagggtggctnggagtgaattaaagcctttgttttttaagg

SEQ ID NO: 6685 - DNA, 427 bp, Homo sapiens
  misc_feature 230, 275, 284, 336, 370, 396, 406, 416: n = A,T,C or G
cggcacgagccggccacagcctaacgctcttcgctgtcgtttgtggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcanaacagagatggcttcatcgacaaggaagatttgcatgatatgctngcttctctngggaagaatcccactgatgcataccttgatgccatgatgaatgaggccccanggcccatcaatttcaccatgttcctgaccatgtntggtggagaagttaaaatggcacaanatcctgaaanatgtcatcanaaacgcctttg

SEQ ID NO: 6686 - DNA, 437 bp, Homo sapiens
  misc_feature 358: n = A,T,C or G
ggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccantctgtttcaaataaatgaactcaatctaaattaaaaaagaaagaaatttgaaaaaactttctctttgccatttcttctt

SEQ ID NO: 6687 - DNA, 230 bp, Homo sapiens
  misc_feature 88, 145, 160, 199, 203, 222: n = A,T,C or G
gcaggagccgcagggccgtaggcagccatggcgcccagccggaatggcatggtcttgaagccccacttccacaaggactggcagcggngcgtggccacgtggttcaaccagccggcccggaagatccgcagacgtaaggcccggnaagccaaggcgcgcngaatcgctccgcgccccgggtcgggtcccatccggccantcgngcgctgccccacggttcgntaccacac

SEQ ID NO: 6688 - DNA, 219 bp, Homo sapiens
  misc_feature 212: n = A,T,C or G
cggcacgaggtcacatttgggaccgtgcgggcctgtggctccttcaagctgcccgtgagagccatctgtgccggctgggaaagtcctttccttgctagacgtttttccgtggcagcgtcgagctgggtgctgttcatgtgtccccggggaacgggtgctgtgcggaacaggaggagagcgaggtcctggtgcttgctgcggggaggcccggngctggga

SEQ ID NO: 6689 - DNA, 441 bp, Homo sapiens
  misc_feature 3, 7, 11, 18, 25, 80, 156, 204: n = A,T,C or G
cgnacanactnaggagtngcagtanagggtgggaagggcatgccgggtggaggacacagtttgaaccaaggcaaggtggntggaaaatactaaactgtataaactgtaagaaagtcaatttggctagagcaggaaaatgtgtttgagggcacagtnggaggtataaagggcagagagtgtaagcgtttacattccaaatgatanaatttgcacaatatttagtaataatctgaagcctctgggaaagctatttttcttctgatttaaatactgaagttcaaagaggatagtgggtgggctttgcatcttggaaaagtctatcagaaactgcctagctcgctcagcccactttcctttccaaggtaagaaacacacattcatgcatggaaataaagcagggaggcccttggcaactgtccagttccattgaagttctcattt

SEQ ID NO: 6690 - DNA, 456 bp, Homo sapiens
  misc_feature 82: n = A,T,C or G
agtggatccaaagaattcggcacgagctggattcagacctctgaggagagttcctggttgttacaggaacatgctgcctgtngtcctggtgccaaggaaacttgctgaagggtacccgctgttaaactgcatagggcagcctgccactgctgtaaaccctgaccgggataaccgcgtgccgatctgcctgccactatatgggaaaacagaaaactagatgaagaagaaaaaggcctctgtcttccagccatgcattgttccttccacactccttattgtcaaagcctaacatggagccagctggcaaaggaaaagtgtggcctgtagagttcagccccagtattacaaagcaggatgaagaaatcgggattggagcttgaaagacaataaattaataactgatacagatggaaagtacatttttcaacccaaggatagaaagaagccccaaacatc

SEQ ID NO: 6691 - DNA, 381 bp, Homo sapiens
  misc_feature 15, 31, 65, 146, 224, 244, 345: n = A,T,C or G
agtggatccaaaganttcggcacgagagagnccttaattctggagaagctgtcaagattcatggngctgattacaaggtttctagaattttagtttgtaacttgaaagcttgaattttatcattggcaacaagtactgtcagttgntttccttgaaatgacagggtcactttgttcatgttcacgtgtatctgttgaatatctaagtctgaataaccatagttngtcagttaatactttccagnaaaagtgtttagtgaaaaaaagtgtctaggtctgcttggaactaaaacagtcacaggagtgctttcctttgcgacaaccattgtactttgggatggagcangagtgctttgtgggcatttccattttatcatgtaga

SEQ ID NO: 6692 - DNA, 136 bp, Homo sapiens
  misc_feature 14, 25, 29: n = A,T,C or G
aaacaggagaagangctggattaanagangtcacctgtggaacataaaaaggacatcagcaaacaggatcagttaactattgcatttatatgtaccgtaggctttgtattcaaaaattatctatagctaagtacac

SEQ ID NO: 6693 - DNA, 151 bp, Homo sapiens
  misc_feature 27, 78, 84: n = A,T,C or G
cggcacgagaaaaactaccctcagaantatttttaaaagaagtagcaaattatcttcagtataatccatggtaatgtntgcagnaattcaaattgatctctctctcaataggtttcttaacaatctaaacttgaaacatcaatgttaattt

SEQ ID NO: 6694 - DNA, 454 bp, Homo sapiens
  misc_feature 396, 407, 412, 432: n = A,T,C or G
gtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgaagaagttcttgaatgaatttnttcttaaatgngaaanatatccttcgcgctcctgtngacatcactggtcagtttgaga

SEQ ID NO: 6695 - DNA, 138 bp, Homo sapiens
  misc_feature 11, 15, 20, 32, 47, 57, 69, 79, 82, 85, 88, 113, 125: n = A,T,C or G
aagtgaccagnggangaagnctacagcccaanaagaagagggaagancctactgccnagactaaagaancgggcactgntantcnaantatagttgatgatgggaaatctcanaaacttactcangatgacataaaag

SEQ ID NO: 6696 - DNA, 111 bp, Homo sapiens
  misc_feature 3, 6, 12, 17, 20, 37, 51, 58, 80, 83: n = A,T,C or G
ggnganatgganggcgnggngggatttgctcctgggntccctaggccctantgagggnggaagagaaaccatcctctccnttnttacaccgtgaggccaagatcccctcat

SEQ ID NO: 6697 - DNA, 120 bp, Homo sapiens
  misc_feature 27, 34, 48, 61: n = A,T,C or G
cggcacgaggtaaccaatagtccacantgtcccnggcattctgttcanaagcagtgtgcanaatgtaatgctcttttgtaagaaacgttttatgatttttaaaataaatttagtgaacct

SEQ ID NO: 6698 - DNA, 386 bp, Homo sapiens
  misc_feature 8, 9, 15, 35, 36, 119, 197, 233, 251, 296, 317, 332: n = A,T,C or G
agtggatnnaaaganttcggcacgagattttgtcnnagttcacagtagagtagggtagaaggaaagcatgtctctgcttccatggcttcctgagaaagcccacctgggctgggcgcggnggctcacgcctgtaatcccagcactttgggaggccaaggtgggcggatcacaaggtcaggagttcgagaccaacctanccaacatggtgaaaccccgtctctactaaaaataanaaattagccgggtgtggnggcacgcacctgtagtcccagctacttgggagcctgaggcagganaatcgcttgaacctgggaagnggaaggttgagtgancccgggaccgtgccattgtactccagcctgggtgacagagcgagattccgtctc

SEQ ID NO: 6699 - DNA, 389 bp, Homo sapiens
  misc_feature 8, 11, 15, 35, 73, 93, 126, 151, 215, 340, 346: n = A,T,C or G
agtggatncanaganttcggcacgaggccagaagntctgtgaacccctggggggctattacccatggccttantaattatctaggctgccgtncggcctgcagagtcatcatgccatgtagctggngggtggcccgtatcttgggcatggngtgaaatcacttcatatatcatgtgctgtaaaataagaactagctgaagagacaaccaaagaancattaaggcaggttgatgctgatgggaccataaaatatttttacactcaacctgagcggttattcttgacactcttaacagaattttttcaattgttttccagaactttagtatatgcaaatgtnctgaanggggtagttcaagtctaaaatgccataacccctttattatttg

SEQ ID NO: 6700 - DNA, 168 bp, Homo sapiens
  misc_feature 2, 34, 46, 76, 124, 161: n = A,T,C or G
gncttggcgaacggtcttcggaagcggcggcggngcgatgaccacnctacgggcctttacctgcgacgacctgttncgcttcaacaacattaacttggatccacttacagaaacttatgggatncctttctacctacaatacctcgcccactggccagagnatttcat

SEQ ID NO: 6701 - DNA, 396 bp, Homo sapiens
  misc_feature 8, 138, 232, 334, 340: n = A,T,C or G
agtggatncaaagaattcggcacgagcacgaaggagcccattgtggcctaagaggctgccctcctgtgctcagccctgaggacagatgcctccttcctcttttccttcccaaagcaagcaagaggccgtggctgctgngggaaatggtactgtacagctggctctacttccccatggccctgagcgagtggagtctgccacccaggatccccaaggcacttgaggggggaangattctgctggcctctgcgagtggtttcttgtgcactggcaccaagtgcgggtccggcagcttctgccccctgcagaaccggagagccagctaaggggtggngctgcngggggttccggtgtccacccccatacatttatttctgtaaataatgtgcactgaat

SEQ ID NO: 6702 - DNA, 405 bp, Homo sapiens
  misc_feature 32, 338, 379, 389: n = A,T,C or G
cttggctaaaatgtttggctttaagcttgtanaattattttaaaaagcatgtcttttataaccaactagtgaagcagtgaggatgcctctttgatttaaatagggttaatacttttccaagtctaaccttctactatgaaaggccaacatcaggccaggtgcagtggcgcacgcctgtaatcccagcactttgggaggcggaggcgggtggatcacgaggtcaggagatggagaccatcctggctaaccccgtctctactaaaaatacaaaaataaaattagctgggcgttgtggcggccacctgtagtcccagctacttgggaggctgaggcggganaattgtgtgaactcgggaggcggagcttgcagtgagctganatggcaatanagcaagactccatctc

SEQ ID NO: 6703 - DNA, 146 bp, Homo sapiens
tcaattcttgctctgtggtgttaaacatataatgaacagtcattaagaattaagtcactgtttgccataaacaaggttgatgttctttttgttgttgttaaggaaaccctagggctcggctttactcttgattaataaaggctgac

SEQ ID NO: 6704 - DNA, 449 bp, Homo sapiens
  misc_feature 17, 45, 48, 66, 144, 235, 327: n = A,T,C or G
ctgagctctccgcgtcncctctgtcgcccgcgcctggcctaccgnggnactcccggctgcacgctntgcttggcctcgccatgccggtggacctcagcaagtggtccgggcccttgagcctgcaagaagtggacgagcagccgnagcacccgctgcatgtcacctacgccggggcggcggtggacgagctgggcaaagtgctgacgcccacccaggttaagaatagacccaccancatttcgtgggatggtcttgattcagggaagctctacaccttggtcctgacagacccggatgctcccagcaggaaggatcccaaatacaganaatggcatcatttccttggtggtcaacatgaagggcaatgacatcagcagtggcacagtcctctccgattatgtgggcttcggggcctcccaagggcacaggcctccaccgctatgtctggc

SEQ ID NO: 6705 - DNA, 317 bp, Homo sapiens
catttggattcagaactcattttggtggtggcaagacaactggctttggcatgatttatgattccctggattatgcaaagaaaaatgaacccaaacatagacttgcaagacatggcctgtttgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaacta

SEQ ID NO: 6706 - DNA, 350 bp, Homo sapiens
  misc_feature 4, 10, 24, 26, 27, 75, 86, 335: n = A,T,C or G
attngccaancattcattcaccanannaccatggatacgaaggctttctctggaataattctagactgaaatttntggattctggncttaaggctgtcttattgtagtacaaccagtgaacagattaagactgattattattagcagctgttttctgaataaggccttaagatattttccctgactgaaagcctacagaggccccactttactcatcctactaggtttcttctttccattcctggaaacttgaaaattataatttattgtgtaggacaatttaatcctctatttcatagattctctttttaatcatgccttgagaactatattgncagagccaaatgtcc

SEQ ID NO: 6707 - DNA, 431 bp, Homo sapiens
  misc_feature 262, 296, 310, 406: n = A,T,C or G
cattttgcacctgcagccaagcaaatgcctgccaaattttagatttaccttgttagaagaggtggccccatattaacaaattgcctttgtgggaaacttaaccacctacaaggagataagaaagcaggtgcaacactcaagtctattgaataatgtagttttgtgatgcattttatagaatgtgtcacactgtggcctgatcagcaggagccaatatcccttactttaaccctttctgggatgcaatactaggaagtaaagngaagaatttatctctttagttagtgattatattncacccatctctcangaatcatctcctttgcagaatgatgcaggttcaggtcccctttcagagatataataagcccaacaagttgaagaagctggcggatctagtgaccanatatataagaaaggactgcagccac

SEQ ID NO: 6708 - DNA, 323 bp, Homo sapiens
  misc_feature 56, 117, 167, 272, 315, 317: n = A,T,C or G
cctcgaggactggccgggaaccgaggcgtgccaggacagcccgggagacagggcgnggagggccgggatgccactgaccagcacatcgtggatgtggcgctgaagatgctgcaagancaactggcagaggtcgccgtgagtgccaagcgggaagccctgggtgcggngggcattgatgggtcctccaggacctcctgggccccctgggtacccaggcaagcagggcccccatgggcaccctggccctcggggcgttcctggcatcgtggganccgtgggtcagatcggcaacacggggcccaagggaaaacgtgnanagaagg

SEQ ID NO: 6709 - DNA, 159 bp, Homo sapiens
tgggattacaggcacccgctaccaagcccagctaatttttgtatttttagtagagacagggtttcaccagcctgggcaacatggtgaaaccccatctctaccaaaaatataaaacttagccaggcatggtggcttgctcctgtactcccagctacttgg

SEQ ID NO: 6710 - DNA, 237 bp, Homo sapiens
  misc_feature 9, 123: n = A,T,C or G
cggtctcanaactgtttgtttcaattggccatttaagtcttagtagtaaaagactggttaatgataacaatgcatcgtaaaaccttcagaaggaaaggagaatgttttgtggaccactttggntttcttttttgcgtgtggcagttttaagttattagtttttaaaatcagtactttttaatggaaacaacttgaccaaaaatttgtcacagaattttgagacccattaaaaaagtt

SEQ ID NO: 6711 - DNA, 212 bp, Homo sapiens
  misc_feature 206, 208, 211: n = A,T,C or G
cggcacgagaggagatctatctcttctccctgcccattaaggaatcagagatcattgatttcttcctgggggcctctctcaaggatgaggttttgaagattatgccagagtacttctagagcggccgagggcccatcgattttccacccgggtggggtaccgggtaagtgtacccaattcgccctatagtgagtcgtatacatttncnccng

SEQ ID NO: 6712 - DNA, 338 bp, Homo sapiens
  misc_feature 313: n = A,T,C or G
gtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctncctgaaataaagaacagcttgacag

SEQ ID NO: 6713 - DNA, 432 bp, Homo sapiens
  misc_feature 78: n = A,T,C or G
gcagaaaatagtgttttgtagttcaacaactcaagacgaagcttatttctgaggataagctctttaaaggcaaagctntattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagaagatgctatatgatacaactgtggccatgactgaggaaaggagctcacgcccagagactgggctgctctcccggaggcc

SEQ ID NO: 6714 - DNA, 322 bp, Homo sapiens
  misc_feature 35, 115, 126, 159, 255, 300: n = A,T,C or G
ccttggggctctcagccctcctcctggatcctggncaggccgaaccaccgctgcctctccttcctccgcatgagcctctggcatggtccttcctccagctggccccaggctgggnagagcctcctnctgccggggcccctgcccaccccctcctttgcntggagtgagggtgttcataccaaagacggaaccatttcgcctttaaagaaaatatatccagaagcagccgctgcctcggagccctggcccgtgggnccccctctcgcctggttggttcggtctaacgccccggagagtcangggcttcccaggaccctgggga

SEQ ID NO: 6715 - DNA, 317 bp, Homo sapiens
  misc_feature 7, 53, 96, 112, 302: n = A,T,C or G
agctggngcgcctgcccgggaacatcctcctggactcaatcatggcttgtggnctggtcgccagcaacctgaatctcaaacctggagagtgccttngagtgcgaggcgaggnggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggccttgggggaccgagcagcgggaaggctgtctttcccttccagcctggaagtgttgcanaaggtgtgcaatcac

SEQ ID NO: 6716 - DNA, 347 bp, Homo sapiens
  misc_feature 52, 62, 124, 154, 189, 243: n = A,T,C or G
gctgggatcactggagcacggggtcttgcaggaccaccaggcatgccaggtnctaggggaanccctggccctcagggtgtcaagggtgaaagtgggaaaccaggagctaacggtctcagtgganaacgtggtccccctggaccccagggtcttnctggtctggctggtacagcttggtgaacctggaanagatggaaaccctggatcagatggtcttccaggccgagatggatctcctggtgncaagggtgatcgtggtgaaaatggctctcctggtgcccctggcgctcctggtcatccaggcccacctggtcctgtcggccagctggaaagagtggtgacagagg

SEQ ID NO: 6717 - DNA, 418 bp, Homo sapiens
catagcttaagaaagaaattgagtccctatctcattatcaatttgaaaaatgctcagtgaggaatattggcccagttgctgatacttagagcaattaactctgcctaagaagacagggttaaagtaagcaaatgacttccaattagagtcacatatttggagtagtggtaggagtagcccccatagaaggatgggggcaacagtaggtgtctacttactgcaagatctaatggaaatttactagattttggtaaaaatggcaaactggcatacacacacctcactggtgacagaatgaactgtgcaaatcttattgaaaacaatttggaaagttatttcaacagtcagaaggatgttcacactttctttgactcatcaatgcatcttgataatgaatatgaatattattcatcttatg

SEQ ID NO: 6718 - DNA, 417 bp, Homo sapiens
  misc_feature 2, 5, 48, 267, 307, 377: n = A,T,C or G
gnggntttcctgaagcagctggctagtggcttattacttgtgactggncctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatatgagattacggagcagcgcaagattgatcanaaagctgtggactcacaaattttaccaaaaatcaaagctnttcctcagctccagggctacctgcgatctgtgtttgctctgacgaatggaatttatcctcacaaattggngttctaaatgtcttaagaacctaattaaatagctgactac

SEQ ID NO: 6719 - DNA, 437 bp, Homo sapiens
  misc_feature 323, 419: n = A,T,C or G
ccaaacaatactatcttataaaatagtactgttgaattattccaagcctccctaggtttgctctcaaatgtcatttacagattgggctaacgacctaaaatctatatataaagactttctgaagaactctgtattatagcaataccaaacgagtgctgtgtgtgcaaacagtctggcgttgctttttatgttgatatttatcctagaacactgaaagagaatatgccagtgataactcactttacttcagtcatttcaacacagaaaatgcttctctagcatttttcttttgtagtgttaacattttgaaattcatgtttcanaggcttcatcatcacagaatttactcttgctccatgaaaaaaaattaaataccttcagaggaatatttaagttggtaaactatgaaacttgagaantcctcttgagataaaagg

SEQ ID NO: 6720 - DNA, 435 bp, Homo sapiens
  misc_feature 334: n = A,T,C or G
gacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggngcttctttctgatctctagaggagatctctttgactgctgtagtactaaagtgtacttaatgttactaagtttaatgcctggccattttccatttatatat

SEQ ID NO: 6721 - DNA, 264 bp, Homo sapiens
  misc_feature 156, 173: n = A,T,C or G
aaacagttaacaaaacaagactcacgaggtggccctgttattggaactatcgaggcaaaacagttaacaaaacaaggctcagaggtggccctgttattggaactatcagacaaagatttgaaaatagctctggctaagatattgaaaggatctagngggaaacatagcatgcntgaattaatggggaatttagctgatagatggaaataatgagtcaagttgaaatggtagtaataaaaaaaaaacagaggtaaataattcctt

SEQ ID NO: 6722 - DNA, 247 bp, Homo sapiens
caaggaagtatgaaattagggcaatacagtaaattttcatgttactcttttatcagatcacaaactcctagagtctacatgcaagactagtaaagtcttatggagtcttatgatggatttttaacttcccgtggaaaaaaaaataaaggctgtatctaaaatatcaaaggttctatatgtcacacaatcgtaattccaaaagccattatggataataaagggtgtaaagccttcagatatttcccca

SEQ ID NO: 6723 - DNA, 439 bp, Homo sapiens
  misc_feature 116, 120, 182, 198, 248, 358: n = A,T,C or G
ggacttgataacctggctacagcgttttctatgaaatctacttggatcccatgcctgaaatttggaagcatatgtacaaaaatcatttttacgttttatttttaataaatcattgngttngaccgtacatgtctaacattttttttctaggatccattcgtaccgttttttaagggatattngtttaagactttacgngttaattctttattcttgatgtgtacttagagaaacttaagaggtcctgnggtttttttcccctctcctgttgccctgctagttgcgtgttgaattatatcccttacaggcaaaacttttgaagtggtggatgtggctttttaaactcttaagtttctgngcatccatctcttgtactaagcgaattgtttatcatcttgacatggttggtcatttctatgacaatttacttcaaactgtg

SEQ ID NO: 6724 - DNA, 247 bp, Homo sapiens
  misc_feature 92, 123: n = A,T,C or G
gtttgcaaaggccctggccaacgtcaacattgggagcctcatctgcaatgtaggggccggtggacctgctccagcagctggtgctgcaccancaggaggtcctgccccctccactgctgctgntccagctgaggagaagaaagtggaagcaaagaaagaagaatccgaggagtctgatgatgacatgggctttggtctttttgactaaacctcttttataacatgttcaataaaaagctgaacttta

SEQ ID NO: 6725 - DNA, 246 bp, Homo sapiens
  misc_feature 90: n = A,T,C or G
ggcttaccaacattgaacacgtatattgacttcccaatacagacactgaggatttaactactagctttctgataggatttacactacagnagtgagtattcacactactttgtttttcccatttcctctggtgtttattggtatattattatttgttattctcttggttacccttttgagacctggaccgaaatctttattacttgttatattactttgttcctagaggtgtgttcttaaagtctc

SEQ ID NO: 6726 - DNA, 366 bp, Homo sapiens
  misc_feature 15, 102, 125, 197, 203, 246: n = A,T,C or G
tatacatacgaggtnattaacaatacagatgcccagtgctacagaatgtgaaagaaggaagaaccccttgtgaattggagtcaataaagaagactccatggntgagcgaggaggagcagtattanataaatggagagaaaagaaggaaagacatagtgtgactgggtgaggtttggcacagagttcttgggaatggnctttgntgtgctagagtttatcatccattgctgaggggtgagtgtgtcntcccctctaggacctttagccagcccagctggtggctgacattggagggctgtgctgtgaaaagtgacactgggtttagagcaggagtcacaaacttatagggctccagaagccagagtg

SEQ ID NO: 6727 - DNA, 402 bp, Homo sapiens
  misc_feature 74, 223, 332, 352: n = A,T,C or G
tggaacctttgtgaagctcaacaaggcttcgattaacatgctgaggtttgtagagccatatattgcatgggggnaccccaatctgaagtcagtaaatgaactaatctacaagcgtggttatggcaaaatcaataagaagcgaattgctttgacagataacgctttgattgctcgatctcttggtaaatacggcatcatctgcttggaggatttgattcatganatctatactgttggaaaacgcttcaaagaggcaaataacttcctgtggcccttcaaattgtcttctccacgaggtggaatgaagaaaaagaccacccattttgtagaangtggaaaatgctggcaacanggaggaccagatcaacaggcttattagaagaatgaacttaaggtgcctac

SEQ ID NO: 6728 - DNA, 416 bp, Homo sapiens
  misc_feature 8, 9, 290: n = A,T,C or G
atcaaatnncatttgccccctttggtaaaatatcggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgnggaggaattgcgtctgggttaacagatcagcttatgagacagacattctcaccatttggacaaattatggaaataaggagttttcccagaaaagggctattcatttgtcagattttcaacccatga

SEQ ID NO: 6729 - DNA, 329 bp, Homo sapiens
  misc_feature 9, 14, 50: n = A,T,C or G
gttttgttntgttntgtttttgtatttttaatagagatggggtttcgctnggttacccaggctgatctcgaactcctgacctcagatgatccacctgcttcggcctcccaaagtgctgggattacaggcttgagccaccacaccagtccgagattgacccaatttttaactctcctgataataataatgtcaaacaccatcttccaaaagaatgttttaccacttaattaattttcctcctttagaaaataatttttctctctcttcaaaggctggccatggggcgggggtgagggatcaaacctacaggacttcaaattggatggaga

SEQ ID NO: 6730 - DNA, 430 bp, Homo sapiens
  misc_feature 148, 189, 260, 315, 403, 417: n = A,T,C or G
tcaccgcactgagatcaacaagaagatttataagattggccagggctaccttatcaaggacggcaagctgatcaagaacaatgcctccactgactatgacctatctgacaagagcatcaaccctctgggtggctttgtccactatggngaagtgaccaatgactttgtcatgctgaaaggctgtgtggngggaaccaagaagcgggtgctcaccctccgcaagtccttgctggtgcagacgaagcggcgggctctggagnaagattgacccttaagttcattgacaccacctccaagtttggccatggccgcttncagaccatggaggagaaagaaagcattcatgggaccactgaagaaagaccgaattgcaaaggaagaaggagcttaatgccaggaacanattttgcagttggngggggtctcaata

SEQ ID NO: 6731 - DNA, 351 bp, Homo sapiens
  misc_feature 59, 188, 206, 343: n = A,T,C or G
cataaaacaatggtctctaacttttaataattcatattccagtaagagcatataaggcntataaaaatgaactctaattcagtttctagtatataataaattccatagagctatatagataaaatattatgggaatttactagatagaaaaattacttctgccttggaagccattggaaggttctgtngggaaatgggtcttagtnggtcttggagaatgaaaggatttatatagacagaaattgagaggagaaacatttcaggcagaaagaataggcagaggactttaaaacggccaatagttcaggttctaaattaaaaaaagaagatgcgtatgggattntaagactg

SEQ ID NO: 6732 - DNA, 398 bp, Homo sapiens
  misc_feature 32, 93, 232, 261, 360, 363: n = A,T,C or G
ctggtctgccttgtgggtcctggacggagccnctacctctgcaaagatgacttggagacaggccgtcctgctgtcttgcttctccgccgtggngctcctgtctatgctgagagagggaaccagtgtatctgtgggcaccatgcagatggcgggagaagaggcgagtgaagatgcaaaacagaagattttcatgcaggaatcagatgcctcgaatttcctcaagaggcgcggnaagcggtcccccaagtcccgagatgaggncaatgatggagtctcactctgtcgcccaggctggagtgcagtggcaggatcttggctcattgcaacctccacctcccaggttcagtggaaaacaggcanaancttcgggttgatgagctgcggagagaattttacga

SEQ ID NO: 6733 - DNA, 296 bp, Homo sapiens
  misc_feature 37, 234: n = A,T,C or G
ctcagtctggtcaagttgtttcttatttgtgagcagntcaggctatctcctgatggggatgaggccaaggctttcttatcttttggttgtctctgcttaatggaggagcctggcctaggatggaggcctggcttagatctttcattccacctcaggaatgaggttgtgatctttcctgtcctgaccctctctgaattatgtttcaatagtactcttgattgtctgccatgttgntgaagcaaatgaattatttttaaatgttaagtaagtaaataaaccttagcccgtctactgtt

SEQ ID NO: 6734 - DNA, 439 bp, Homo sapiens
  misc_feature 29, 38, 131, 232, 323, 387, 420, 430: n = A,T,C or G
gtgatcctgaaatgctgaagatcgtgtangtgggttgnggggtcagcagagctgccatctgcccacgtctggaaaacaacacacggtgagtcaccggttggccatgagatctccccacttaaaggtgctgngagcttgtctctaagatatatacctcttccttttgtcttttgctgtaagctttgaccttttgcagatctgatgaaaatacaacctcttattgtattagttngccttgattataagccatagtaaatcgagctgttcgcatttttgcaggccttgcattttctactgggaggttcatcaaaccttccacttancaatagccctgactcaggcagaatgcctcataaattagccttcgaaagaaaagtgcacgctcanacagtgtgtaggaggggcaggagcgtgatgcanacaaggactnagtcatgac

SEQ ID NO: 6735 - DNA, 103 bp, Homo sapiens
  misc_feature 46, 78, 88: n = A,T,C or G
ctggaactgcacaaactggccactgacaaaaatgacccccatttgngtgacttcattgagacacattacctgaatgancaggtgaaanccatcaaagaattgg

SEQ ID NO: 6736 - DNA, 123 bp, Homo sapiens
tcgtaggatgggtgagtcagatgattccattctccgattggccaaggccgatggcatcgtctcaaagaacttttgactggagagaatcacagatgtggaatatttgtcataaataaataatga

SEQ ID NO: 6737 - DNA, 444 bp, Homo sapiens
ggaaggagtgttgctgtaattagagaccattaggcattgcttgagccatttgtctattactttttgatatattggattttctggtaactcccaggttagagaagtggtccctccttctactctaatttctttgtaatcacagaatcagcatcttgtctctagagagttttgctagataattgggctgctccatgcctagcctagaggctttgggagtagaacccagacttatctaagctttgtcttccaaatgttgcatcactcaattactgtatgaattcttgccttgttgatgtgtcatttaagaaacagcttatatacaaatgatgaagtgtatatataaatcttcctagttgccaatttcataagattgaagaaactgcaagttttgagaacacttttaagcaatttatttaacctctaattggctaccttattcggtat

SEQ ID NO: 6738 - DNA, 225 bp, Homo sapiens
  misc_feature 142: n = A,T,C or G
ggatcacgaggtcaggagatcgagaccatcctggctaacacgatgaaaccccgtctctactaaaaatacaaaaaattagccaggcgtggtggtgggcgcctgtagtcccagctacttgggaggcagaggcaggagaatggcntgaacccaggaggcagagcttgcagtgagccgagatcgcgccactgccctccagcttgggcaacagagcgagactccgtctcc

SEQ ID NO: 6739 - DNA, 204 bp, Homo sapiens
acttgggcttaggagttgctaagtatgagcaataatctggaatcagcatcatcataattcatcataagtttagaatatcttagggcaagccaaggttgatgttagaatatgtggtgttatgggtcaggttgcttttcttatgcattttacccagtggaataaatttattttaaacagacactatggcagataggaataatggag

SEQ ID NO: 6740 - DNA, 234 bp, Homo sapiens
gcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatg

SEQ ID NO: 6741 - DNA, 312 bp, Homo sapiens
caaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagc

SEQ ID NO: 6742 - DNA, 180 bp, Homo sapiens
attcctggacatccagatagctcacatgtgctgaccacacttcaggctctggactggagctctctggcatgggggtggggcctcagatgctggggcccagtctgccccatcttcattcctgcaccttaaacctgtacagtcatttttctactgacttaataaacagccgagctgtccctt

SEQ ID NO: 6743 - DNA, 274 bp, Homo sapiens
cccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatatttttatttttttgtcctggatatttggggattatttttgattgttgatattctcttttggttttattgttgtggttcattg

SEQ ID NO: 6744 - DNA, 291 bp, Homo sapiens
ccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatt

SEQ ID NO: 6745 - DNA, 350 bp, Homo sapiens
ctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtgggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatg

SEQ ID NO: 6746 - DNA, 385 bp, Homo sapiens
acagcacacaccagtggttggacggctcagactgtgtactccaggcccctggcaacacttcctgcctgctgcattacatgcctcaggctcccagtgcagagcctcccctggagtggccattccctgacctcttctcagagcctctctgccgaggtcccatcctccccctgcaggcaaatctcacaaggaagggaggatggcttcctactggtagcccctctgtcattttgcaggacagatactcaggctagatatgaggatatgtgggggggtctcagcaggagcctggggggctccccatctgtgtccaaataaaaagcggtgggcaagggctggccgcagctcctgtgccctgtcaggacgactgagggctcaaacacaccac

SEQ ID NO: 6747 - DNA, 442 bp, Homo sapiens
  misc_feature 96: n = A,T,C or G
ctggagtcttacattaatgctcatttgagctaattagtaatctgtttaaacagatttggcaatactttaaagatactgtagactatttatgtatangatagatcatattacccattaaagtctgggggaaaaaattttttaattttactcttcttatgtactgaaaactttttttaaaaaaggtgatgatgaagtgcattctgtagcagcagcgcagctatgctttaaaccacacaaaaggctgtgtccaggtgcagcctccttcacccttcctgcccacggtgaggattgaataaccaggacttggggatattgtttgttgtcagggttattctgtgtggtaaggaatatttgtttcacatttatacattttctttttccactcacgtaagtttctatcttgagagcatagtccaaagtgcaaaacttggtgtttacaagg

SEQ ID NO: 6748 - DNA, 303 bp, Homo sapiens
cggacctggtacctcttttgtgaagcggcagctgaggagactccggcgctcgccatggccgacgaaaagcccaagggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgatttgacgggcaaccaatcaatgaaacagacacacctgcacagttggaaatggaggatgaagatac

SEQ ID NO: 6749 - DNA, 346 bp, Homo sapiens
ccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggagggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattc

SEQ ID NO: 6750 - DNA, 319 bp, Homo sapiens
  misc_feature 295: n = A,T,C or G
taggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtcttggagggtcaaatttaccctggccaagatccgcaaggccgcccgggaactgctgacgcttgatgagaaggacccacggcgtctgttcgaaggcaacgccctgctgcggcggctggtccgattggggtgctggatganggcaagatgaagcttggattacat

SEQ ID NO: 6751 - DNA, 232 bp, Homo sapiens
ggatgttgaaatctttgcctcctcagtcgggaagagtcctgctaaaaatcaggctaaaaatcaggccaaaaatcaggccaaatgacttggcaaataattgacaaagtggttttcacagtgtgtctatctttgctagcagcttgtatacctcaggccaggtgagctccccaaatttcttttttcatttactccagtgagtttctgctgtctttttcaagtatgtaccatagga

SEQ ID NO: 6752 - DNA, 439 bp, Homo sapiens
aaagagtaagtcctattatcagttggagaaagcagaatggagtccagccagctaacaatggaaataacatgggatctggtgcagtaatgggaaacggagaaggaaaaaaataaatcccaggcacttaaataagaagtgaaccctgggttatttggcaaaaacaagagaaaatgatagtgtagggtgatagaataaatgtttattacatttcacagtattttcgtaaagtgatttgcagtggacgtgagtctgaaaagtgggagcaaattctaaaacctctgtccttgggactaaaggaaggtaatgtcacagtagttactgaagaggatctaattgagtgtgcataattatatttctgaacaccatatctgaattttacataggagtttcactttggtgatttcagctagtgattttcagtctgtcctgcagaggtgga

SEQ ID NO: 6753 - DNA, 408 bp, Homo sapiens
  misc_feature 286: n = A,T,C or G
gaaagagaagaagaagaaagacaaagagcacaggcggccagctgaggccacctcctctcccacatctcctgagaggcccaggcaccaccaccatgactccgactccaactccccctgctgtaagaggaggaagcggggacacagtggggacaggaggagcccgtctcgcaggtggcatgacagaggctctgaggcctgatggctggaccctgctcactgctgttgtgggaccctgaaccctcccttcaccttgcttgcctcctgcctcggaagctccttgggtgtngggtgaagcccgaggctgctcctgtggaagtggctctgggcaccagcctgtggggctaaagacttgacagctagctctggagcagccggcttcctggaaaacctccaggtttcgcataccag

SEQ ID NO: 6754 - DNA, 499 bp, Homo sapiens
  misc_feature 19: n = A,T,C or G
cgactagtggatccaaagnaattccgcacgaggctagaggtatttcatttgatatttagcttctgaaagccctttgttataaagggaagtgattttctaaatttggtagcagcttgaaaacaagcaccacaaatgtaaaattgcatggttctttttttactaatttaatttttttgccaagttatgtgctagcaaaatgtttgaaattgctattctttttctgttagcttggtatatatgacttagactaagtatatgtatgtgatataatatatgtgtacatgtggctaaactgctaatgggcaaagattgttggttcttctgatgctgagtatacatcaagttcatcccatgattattttttattacgagctattgctgatgtgatgctactcttagctgcaccaccagtataaagcttaactgagaaagaacacccctccctcttagttccgtgccagactggtttgttagctttagttgtttcttagtgctctag

SEQ ID NO: 6755 - DNA, 417 bp, Homo sapiens
actttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatgggaaagtcacccgtaaggatggcaatgccagtggaaccacgctgcttgaggctctggactgcatc

SEQ ID NO: 6756 - DNA, 443 bp, Homo sapiens
  misc_feature 372: n = A,T,C or G
gatggtcgaggccatctcctgggccgcctggcggccatcgtggctaaacaggtactgctgggccggaagggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccatctcaaggtgtttgacggcatcccaccgccctacgacaagaaaaagcggatggtggttcctgctgccctcaaggtcgtgcgtctgaagcctacaanaaagtttgcctatctggggcgcctggctcacgaggttggcttggaagtaccaggcagtgacagccaccctg

SEQ ID NO: 6757 - DNA, 404 bp, Homo sapiens
gaaaacatcccagccaagaactggtataggagctccaaggacaagaaacacgtctggctaggagaaactatcaatgctggcagccagtttgaatataatggtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttg

SEQ ID NO: 6758 - DNA, 408 bp, Homo sapiens
caaaaggaacccctctcccaccgcttcaacgagttcatgacctccaaacccaaaatccactgcttcaggagcctaaagcgtgggctttctctcaagctgggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggtttgaaggccggctcccagcacgcagcgagcaggcgcgccggcagagcgg

SEQ ID NO: 6759 - DNA, 268 bp, Homo sapiens
  misc_feature 267, 268: n = A,T,C or G
gatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaacccttcnn

SEQ ID NO: 6760 - DNA, 435 bp, Homo sapiens
  misc_feature 421: n = A,T,C or G
gtcctatgttggataaagaaattccacccagtatttcaagagtcacttctttacttggtgcaggaaggcagtctttgctacgtacagcaaaaggtaccttaatttgaagaagtgttctgctttgtattaatagcctaataattattataattgtgaagtaatgtaagcattgtggaagaaaggtgataatgtaactataaatcatgctgtggactataaaattctctgcatttagcatagaacattgaattttattacataagtgtttaatgggtccttctgcattaaaaagttgataaagatattagatgttaagctaaaaagcttgaatttattctgagatgttgtttgaggttttatcaatgtgagttcttaattttccattttgtagctcactcataacttcattgaatgtaattgnatgtgtctaataaa

SEQ ID NO: 6761 - DNA, 462 bp, Homo sapiens
ccttctgttcctgtctcagtacaaactaaggatgatgtctatgaggctttcatgaaagagatggaagggctactgtgacagcttttgatgccagaaaaggcttctgttcacaacagtggcccatggagaaagaggctcttattaaacttagatgaaagagctgcttccattgtcagggtattttctaatttcagttcaaggaatatcctaaaatttagccttgttcagaatttactgcacataaaaaagggtatttcatccagaatagatcagttattgaagcagtgctgctaacatccattccctttcataccaccattttcaccctgtttcttcccctcctccagttctttggaaatttgtgatcgggggatcttagttgcttatttgttttgactcttgtgtgctgtgggcactggagtagagatttctggagaaaaaaaaacagtttatttcatcttg

SEQ ID NO: 6762 - DNA, 419 bp, Homo sapiens
tccacaaggaacatactccaagattaaccacatgctgaatcataaagcaagtctcaataaattttaaaaatttgaaatcataccaccaatacactcagaccacagtggaatgagaataaaaataaataccaagaaaatccccccaaactacaaaattatatagaaattaaacaacttgcttctaaatgacttttggatagacaacaaaattaagtcagaaataaaaggattctttgaaattaataaaaacagagacacaatataccaaaatctctcaggtggagcaaaagtagtgtaaggagggaaagtttatagtgccaaatacctacctcaaaaagttgaaaagttttaaatttgtgatctagcatcacatctagaagaactacaaaaacaagaacagtatagtcccaaagctaata

SEQ ID NO: 6763 - DNA, 440 bp, Homo sapiens
ctcgtgccgaactgagactttcagaagaaaaaatttcattctgaatatggaaaaatgggaaaccaaatggtgcagaagtagagacaattcttgcgattgaataaaataactggtcagaaatattcatccaactaacaaatggtttccagggacccttcactgcagcttactgtgtagaatttaaactaagtaacttaacaattgagaacataacctgtatgtaccctttgtcccctgcccccactccaaatattactgctaattagaagcacatgttgaaggaaaaactctaataagacattccagtataagatctgggtttgctttaaatcccccaagcagcctaaagcccaacagaaggtatttagccttttgccttttgtttaaatggagattattttggagttatcaatagtgcaatactcccatcctgctgtcct

SEQ ID NO: 6764 - DNA, 183 bp, Homo sapiens
  misc_feature 92: n = A,T,C or G
cacctgtgttggtgacttccaaatttgtatttctagtcctgggctagagatcctctttgtcttctggccatcagcattttgatgtttatcangctcttgcaaagtctgcacccgcaaagtaaactcattaccttcccttcaaaatcttggctctgtccaaatttcctagtttggtgaatagcc

SEQ ID NO: 6765 - DNA, 421 bp, Homo sapiens
cagctttgggcttttttaaacattaaacaggtagcagatcaaccttatgttcaacagacattcagccttttacttccactgttgggatttttcattcaaactctagatcctaaactgatacttcaggcagtaactttgcagacctcgctacttaaattagagcttcctgactatgttcgtttggcaatgttggattttgtatcttctttaggaaaactttttatacctgaagctatccaggacagaattctgcccaacctgtcctgtatgtttgccttactgctagctgacaggagttggctgctagaacaacataccttggaggcgtttactcagttcgctgagggaacaaatcatgaagagatagttccacagtgtctcagttctgaagaaactaagaacaaagttgtatcctttctgg

SEQ ID NO: 6766 - DNA, 415 bp, Homo sapiens
gttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgtttgaaggcacaagcacagagtcagaaagctaaataaaaaaatgaaacttttttgagtaataaaaatgaaaagacgc

SEQ ID NO: 6767 - DNA, 239 bp, Homo sapiens
ggaaatagggcaacgaggggtgtaaatttgcagttaggtggaatgctgatagcaagttttccaggtaggagagttagttggggtgggggatgctaatgttagcttatctctgtatatatatttaattttatatgttatttatttttgagatgggatgtaactctgtagcccaggctggagtgcagtgagccatggtcacaccactgcaccccaacctgggccacctagcaagatcctgt

SEQ ID NO: 6768 - DNA, 241 bp, Homo sapiens
gtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaaagttggactaaatgctcttccttcagaggattatccggggcatctactcaatgaaaaaccatgataattctttgtatataaaat

SEQ ID NO: 6769 - DNA, 171 bp, Homo sapiens
taacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaag

SEQ ID NO: 6770 - DNA, 383 bp, Homo sapiens
  misc_feature 23: n = A,T,C or G
cagactaccacctttcgagatcnggaccaacctggaaaatgccagagttggctatgccttttcagacattgatttggacagctcaccaacccctgaaggggccgttcagcctggttagttttctacctactccgagtgtcctcccctgccccaccagattgctgcaggggcgcggtgtgcctggcagccaaattgttgacacttcttttttcctatgcactggttttacacagctgtcatttttctttcaaaattgcagcagtcccacagatgtgtgcatttggacaaatagtacttaaaaacaaaacaaacaagcactcagcccagctcctcaatactacctggaaaaagcattggcattattttcaataaatatcaaagca

SEQ ID NO: 6771 - DNA, 423 bp, Homo sapiens
cacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttgaaactaggcggctatggtataatacgcctcacactcattctcaaccccctgacaaaacacatagcctaccccttccttgtactatccctatgaggcataattataacaagctccatctgcctacgacaaacagacctaaaatcgctcattgc

SEQ ID NO: 6772 - DNA, 328 bp, Homo sapiens
cgcgagcgaggtgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagt

SEQ ID NO: 6773 - DNA, 100 bp, Homo sapiens
  misc_feature 5, 12, 30, 35, 42, 46, 47, 59, 62, 63, 66, 67, 68, 73, 76,78, 79, 80, 82, 87, 91, 93, 94: n = A,T,C or G
actangggggtnccaaagaaattttgggcnagagnctcgcgnacanncacagcaagaanggnntgnnngcctnccntnnncnccgcncganannctgatc

SEQ ID NO: 6774 - DNA, 387 bp, Homo sapiens
ggaatttgaaagtagttgttctttcatagatctaaggtttataccagatgatattacttttgatgatgagcctaaggatgtagcctcagaagtgaatttaacagcatataaaccaaaatatttcacttctgctgcaatgggaacatcaacggtggaaatcacttgggatgagactgatcatgaaagaattacaatgctcaacaggaagtttaaaaaggaagagcttttggacatggattttcaagcctacttagcttcctctagtgaagatgaagaggagacagaagaggagctacaaggtgatgatggagtcaatgtagaagaagatgggaaaacaaagaaaagtcagaaggatgatgaagaacaaattgctaaatacaggcagct

SEQ ID NO: 6775 - DNA, 414 bp, Homo sapiens
aaaaactggttctccacccctcccccatacaaaatccacaacaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcata

SEQ ID NO: 6776 - DNA, 100 bp, Homo sapiens
ctgaaaactcgctctttataaacgaggcaaaagcatttaattcccacccccccaccccccgctcccttctgctccttcaataaaccgaaagatgggtttt

SEQ ID NO: 6777 - DNA, 112 bp, Homo sapiens
aagtacttctagagcggccgcgggcccatcgattttccacccgggtggggtaccaggtaagtgtacccaattcgccctatagtgagtcgtattacaattcactgggccgtca

SEQ ID NO: 6778 - DNA, 461 bp, Homo sapiens
  misc_feature 1, 430, 460: n = A,T,C or G
naccaccaccaccaccaccccttctggggtcactccatccatgctctctccagccagccatctcaaggagaaacatagttcaactgaaagactcatgctctgattgtggtggggtggggatccttgggaagaattactcccaagagtaactctcattatctcctccacagaaaacacacagcttccacaacttctctgttttctgtcagtcccccagtggccgcccttacacgtctcctacttcaatggtaggggcggtttatttatttattttttgaaggccactgggaggagcctgacctaaccttttagggtggttaggacatctcccccacctccccacttttttccccaagacaagacaatcgaggtctggcttgagaacgacctttctttctttatttctcagcctgcccttggggagatgaanggagccctgtctgcgtttttggatgtgagnt

SEQ ID NO: 6779 - DNA, 437 bp, Homo sapiens
  misc_feature 426: n = A,T,C or G
gtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcangattgaaaatg

SEQ ID NO: 6780 - DNA, 443 bp, Homo sapiens
tgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaag

SEQ ID NO: 6781 - DNA, 450 bp, Homo sapiens
ccagactgaggaagacccggaaacttaggggccacgtgagccacggccacggccgcataggcaagcaccggaagcaccccggcggccgcggtaatgcctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcgggctactacaaagttctgggaaagggaaagctcccaaagcagcctgtcatcgtgaaggccaaattcttcagcagaagagctgaggagagattaagagtggttggggggggggccctgggtccctggggggcttggaag

SEQ ID NO: 6782 - DNA, 391 bp, Homo sapiens
gaaagtgttggactttgtcaattaccatgcctgatatcaatgtgtcttacctgactatatcactcctaaaaatttcactgcgggccgtggtccctggatttcctgagggttgattgcccatccccattcctgtagacgagcacacaatggtataagactttcctgtaacacattacagtcttcagaggttaacgtgatgtcatcaatataatgaaaccagggccaggtcagatggctcatgcctgtagtcccagtgactcaagaggctgatgcatgagaatcacttcagcccaggtgttcaaggctgtagcgaggtatgactgcatcactgcactctagcctgagtgacacagcaagacccaccctgtcaaaataaattagatagatagat

SEQ ID NO: 6783 - DNA, 399 bp, Homo sapiens
tgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatc

SEQ ID NO: 6784 - DNA, 359 bp, Homo sapiens
  misc_feature 296: n = A,T,C or G
gctgttgtaggtactaaggattcaaaactgaacagattgagtccctggcctcacattttcttgggggagaaagacagtgaacaagacagatagaatgtctggtcacgcaggggtggtgtgggaagacatgcagaaggggccgcctgctggagggagcatggccagaggatggtgtttctcagtctgtaataagagccataaaggtgctcctgcttgattctgcactaagaatctcctcttgccaggcgtggtggctcacacctataatcccagcacttagggaggcagaagcaggnaggattgctggaacccaggagttggagaccagcctggttaacatagtgagaccccatctctgc

SEQ ID NO: 6785 - DNA, 410 bp, Homo sapiens
gttctggacccagcccctggagacaccattcacttttactgctttgtagtgactcgtgctctccaacctgtcttcctgaaaaaccaaggcccccttcccccacctcttccatggggtgagacttgagcagaacaggggcttccccaagttgcccagaaagactgtctgggtggagaagccatggccagagcttctcccaggcacaggtgttgcaccagggacttctgcttcaagttttgggggtaaagacacctggatcagactccaagggctgccctgagtctgggacttctgcctccatggctggtcatgagagcaaaccgtagtcccctggagacagcgactccagagaacctcttgggagacagaagaggcatctgtgcacagctcgatcttctacttgcctgggg

SEQ ID NO: 6786 - DNA, 409 bp, Homo sapiens
  misc_feature 245: n = A,T,C or G
caaaagacaatgtgctttatgttatacctatagctttggtcccatctttaattgagaaacatttatctgtataaaacatatttttggataaatatatatatatatatttgtatcgctacagaaaggctctaaaaagcatttgaggaaaatatttggttcccttttctataatcatcctttaagattcttatagctacatttggtttattcatcatatttacagtatatatattgttcttttcagngttcacatcttgttccccatttctcacttgtgtcaccagctgtttgtgccatttttagtgtaaaagttgcagacctattagatctgcagtttaagttgccatgctgctaggaaattgtcctttttctttctagctgttaacctacttcctggaaaaagtagtag

SEQ ID NO: 6787 - DNA, 346 bp, Homo sapiens
ctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatcaggaggcatcactgaggccaggagctctgcccatgacctgtatcccacgtactccaacttccattcctcgccctgcccccggagccgagtcctgtatcagccctttatcctcacacgcttttctacaatggcattcaataaagtgcacgtgtt

SEQ ID NO: 6788 - DNA, 101 bp, Homo sapiens
gaaaaatatctgtaaagtgagatgaagcaaagtgaagtaacatgaggtatgtctgtagctgttgctgtagtggtttccaaatggtggttttcttttccttt

SEQ ID NO: 6789 - DNA, 393 bp, Homo sapiens
  misc_feature 392: n = A,T,C or G
ggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaaggattattng

SEQ ID NO: 6790 - DNA, 450 bp, Homo sapiens
cagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgaatattttcacactggtaaatg

SEQ ID NO: 6791 - DNA, 441 bp, Homo sapiens
ctcacttgtttttctttagatttataaatttgagctattttttttagaggtgctttttaaaaatccaatagatacaagagatgtttcctttggttttctgccagtcatccagctgatacacacctgatgattttaaagaaagccacacagagctgaatgggcagtgtaatcaataatttaaaagacatgaatgtcattagatcctttataacgtagatcgaagccaaagcagctcatttgtgacaacatttcatatcaccagacacaccaggcaacagaagttgaagcacaaccactgtagcaaaataccttgactgcttgtgagaccattagcattgcaggccaaaccgtactgtatttccttctcataacctcaaggaaccatatgtgctacccacaacacctcattcttacccagggtgcgctgcgtcctcatggtac

SEQ ID NO: 6792 - DNA, 443 bp, Homo sapiens
tgtattttggggaatagcaaaatctacatcacaaattttgacacattacagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattac

SEQ ID NO: 6793 - DNA, 309 bp, Homo sapiens
gttagtgcatcaacgggatacagttccatattgccttaaacctccttgttttagacacactaacatttataccaaattgcagattattctgcagagagggaattgcatgtttgtgttgtatatttagtatgaacttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaatttg

SEQ ID NO: 6794 - DNA, 255 bp, Homo sapiens
  misc_feature 75: n = A,T,C or G
gaaaaatcaggaggctggtattctggaagccatcagaagaaaatgtttcacaaaaggaaggtagtattgaatggngtgaaatgttacctatatacctggaaaaaagcaacttcagctgctttttaagtaaatgtgatagtttgtactgcaaataactttccatattgcttttcagatcatgatattttggtccttaagatcatgtagaactttccattgtgagaagggagttgattattttatcattaaagaaac

SEQ ID NO: 6795 - DNA, 156 bp, Homo sapiens
  misc_feature 8, 18, 24, 42, 81, 96, 128: n = A,T,C or G
ctccgtangacaccgttntatganttccacctggcccacggngggaaaatggtggcgtttgcagggttggagtctgccaangcacctccgggacantcacactgactcgcacctgcacacacgccagnactgctcggtctttgacgtgtctcatat

SEQ ID NO: 6796 - DNA, 438 bp, Homo sapiens
  misc_feature 335: n = A,T,C or G
ccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaaagaagtcttacaccactcccaagaagaataagcacaagagaaagaaggttaagctggctgtcctgaaatattataaggnggatggagaatggcaaaattagtcgccttcgtcgagagtgcccttctgatgaatgtggtgctgggggtggtttattggcaagtcactttgacagacattattg

SEQ ID NO: 6797 - DNA, 420 bp, Homo sapiens
gacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagta

SEQ ID NO: 6798 - DNA, 218 bp, Homo sapiens
caaactccgggccacaggaggaaataggaccaagacccctggacctggggcccagtcggccctcagagcccttgcccgctcgggtatgaagatcgggcggattggaggatgtcacccccatcccctctgacagcactcgcaggaaggggggtcgccgtggtcgccgtctgtgaacaagattcctcaaaatattttctgttaataaattgccttcatgt

SEQ ID NO: 6799 - DNA, 435 bp, Homo sapiens
  misc_feature 415: n = A,T,C or G
ctgaccctcttggacctttcttctttgccgacaaccactgcccagcagcctctgggacctcggggtcccagggaacccagtccagcctcctggctgttgacttcccattgctcttggagccaccaatcaaagagattcaaagagattcctgcaggccagaggcggaacacacctttatggctggggctctccgtggtgttctggacccagcccctggagacaccattcacttttactgctttgtagtgactcgtgctctccaacctgtcttcctgaaaaaccaaggcccccttcccccacctcttccatgggggtgagacttgagcagaacaggggcttccccaagttgcccagaaagactgtctgggtgagaagccatggccagagcttctcccaggcacaggtgttgcaccanggacttctgcttcaagtttt

SEQ ID NO: 6800 - DNA, 458 bp, Homo sapiens
  misc_feature 455: n = A,T,C or G
gttaggctgcagatggaatcaaggctgataatcagctgacctcaaatgagggagattgtctccgattatctggttgggcccaatatcatcacaagcgtcctcaaaagtggaaaagggaggcagaggaaatcagagtggtgtgatgtgagaggacttgagcatccttgtttgctagctttgaaaatagacgaaggggccacaagccaaggaatgcaggcagcctctggaagctgcaaaaggcaaggaaactgattttcccttaaagcttccagaaagaaccatggtctgctgataccttaatttttatctcagtaagacctgtgttggacttctaacctccagaactgtaagataaaaaaacttgtgttgatgtaagccactaagtttgtggtaagtttgttatagcagcattggaagataaatacagccttctactccttagtgtggcatttgangcc

SEQ ID NO: 6801 - DNA, 441 bp, Homo sapiens
cttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattttgatattgtctctggaactcgctacaaagg

SEQ ID NO: 6802 - DNA, 463 bp, Homo sapiens
  misc_feature 383: n = A,T,C or G
ggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccangcgtttcctttcattccctcagtgcttctcttctgacctgcatgttgagttctgtattgctggggcttccaacaaaaacc

SEQ ID NO: 6803 - DNA, 405 bp, Homo sapiens
  misc_feature 259, 282, 314, 327, 338, 359: n = A,T,C or G
gccgccccagccgctgccgcctgcaccggacccggagccgccatgcccaagtgtcccaagtgcaacaaggaggtgtacttcgccgagagggtgacctctctgggcaaggactggcatcggccctgcctgaagtgcgagaaatgtggggaagacgctgacctctgggggccacgctgagcacgaaggcaaaccctactgcaaccacccctgctacgtagccatgtttgggcctaaaggctttgggcggggcggagccganagccacactttcaagtaaaccangtggtggagaccccatccttggctgcttgcanggccactgtccangcaaatgccangccttgtccccagatgcccanggctcccttgttgcccctaatgctctcagtaaacctgaacacttgg

SEQ ID NO: 6804 - DNA, 228 bp, Homo sapiens
  misc_feature 21, 39, 92: n = A,T,C or G
cttccccttccctcaagccanggctcctcctcctgtcgngggctcattgtgaccactggcctctctacagcacggcctgtggcctgttcaangcagaaccacgacccttgactcccgggtgggggaggtggccaaggatgctggagctgaatcagacgctgacagttcttcaggcatttctatttcacaatcgaattgaacacattggccaaataaagttgaaatttt

SEQ ID NO: 6805 - DNA, 375 bp, Homo sapiens
  misc_feature 18, 61, 357: n = A,T,C or G
gtaaatttaactgttagnccaaagaggaacagctctttggacactaggaaaaaaccttgtngagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcntgctcataaggaaaggtt

SEQ ID NO: 6806 - DNA, 128 bp, Homo sapiens
gttgggagccccctgatgggcttgtctgtgtttgcaccttgtcctgtgtctgaggtcctgtgactgtaccctcctttgccctgggacatctgtatctcttggctttgtaataaatgctgcatactttc

SEQ ID NO: 6807 - DNA, 260 bp, Homo sapiens
tggaacaaaatctcctccacaccttgtctgtctttgataataaagatgacattgccagttttgtcaaagggaaggtaaaggtaggtcccctgagtttcatgtttctccccatctttccatctttcttccttaagacattccgaacactgtagcacactaacagtttttcctactaactgaacttttggctcaatacgtaatgccaaataagtttcatttatcacctgtcttaactttgtagtcagtctagcaaaatacac

SEQ ID NO: 6808 - DNA, 301 bp, Homo sapiens
atttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtg

SEQ ID NO: 6809 - DNA, 257 bp, Homo sapiens
  misc_feature 222: n = A,T,C or G
gtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaanagaagttattttctacagtggttttatactgaagg

SEQ ID NO: 6810 - DNA, 429 bp, Homo sapiens
  misc_feature 356: n = A,T,C or G
cttttcctgaggaaaaaagttgacctgaccagtgtatgaaattcaaacactgtataggaacaaggtaaaagcacaggtaggaattgctgaataattacctttagaccagcctgaacaggagacttcccacgagggtgagctcatttaatggttcctaaaactcaatcttgtggatgtcagtggtcatgcttgattatttgcagcagtgttttatgaaaagcagtagaaatgcattgggaggctgcagagaaagaggacaataacgggttttacttttgtaaatgaaatcccttcggtatgagacaagtatgttttttgctgctctgcctaagccactgaaaagggagatgtatgtnggatgttagtgtgtgagttttgtgtgtactgttcatgtaggcacatctaaaaactgctgtgcactatggctga

SEQ ID NO: 6811 - DNA, 440 bp, Homo sapiens
cttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggc

SEQ ID NO: 6812 - DNA, 462 bp, Homo sapiens
gtaaattagtgattgccagtgctgggggcttgggggtggatatggggttcctgggaggtgatgaaaaggttctggaattagtggtaacagttgcacaacctggtgatacactaaaatccactgaatcacacgttttaaaaaggtggattttagagtatgtgaattagatttcaataaaaaagaaacaaaaaaatgagttagagataaattttattttgtaaagtttactcattctttgtaattttcaaaaaatgtaatacaacacaagtagtcaatttctacttaattttatggttgttttccctcctaaaggagataacgataagcctaaaacaaagagcaatgagctcatgctaatcagctttgccagttctggtcataaattaggaatactgtaaaagtgaggtgacacctactaacgtcattttgctaagactgctggaagctctaccatcgctaata

SEQ ID NO: 6813 - DNA, 391 bp, Homo sapiens
ggcatacccagctcggcagactccccttagtatgaaactgcttccatcagtaaaatattcaatgtccaggtccccgaggggccaatctgttaaatctttccagcttgagaacactttatctaccacgtccacacagcaatgaaggggacttcctgtgtagggtccagccctacgggggcttagcgggtgttctccccgtgtgcagagacaagacatcgtaagaaataaagacacaagacaaacagataaagagaaaacagctgggcccaggggaccactaccaccaagacatggagaccgctagtggctccgaacggctggctgcgctgatatttattgaatacaagacaaggggggcagggtccggacggtggagtcgtccaagtaattg

SEQ ID NO: 6814 - DNA, 351 bp, Homo sapiens
gacatgtcttgtgaaggaaggtttcttggagaccacttttatttactcatgagaagtggaagctcctagtatcagaagaagctgatacatagtgtcatgtgctcagtggttgccaaagtctaccaactttggggagctgcagggttctttttgggaggtgggaggaagggagatgagttttgttattttggggttttcaagcattggaaccaaaggccaaataataaacagcctttagtttttaaagtaaaattcattttatttgcagagtacacttgtttggtagactgttaaagacaattttatgactatttatgcacattataatggttacatctgctttttgtcttt

SEQ ID NO: 6815 - DNA, 128 bp, Homo sapiens
gacttatgaaaaatcatgtaatattatctcagataataatgttatctcattaataatttttatattatttacatgtttatgataacattttggatatattgggttaaataaaatattttgttaaaatt

SEQ ID NO: 6816 - DNA, 204 bp, Homo sapiens
  misc_feature 203, 204: n = A,T,C or G
cttcaacccgttctcatctttgggattgaggcgcctgcagaattacaagagaggatttgtcctcctcttctccagagagctaccttgattttccccacccctgccaagatagacattcatgaatgcagtcatccacacctccacaagtgcacaaaaaccagccatctgcctaaaaaataaaagagcaaaaatgaatcagtgcnn

SEQ ID NO: 6817 - DNA, 183 bp, Homo sapiens
  misc_feature 86: n = A,T,C or G
caactacctgcagaacgtgctggctgagctggctgcccagggggtgaccgaggactgcctggagcagcagtgacctcgcaccccancacgcccgcctctggtggccaccccgctgccccatggctggcctgggtggccaggcaggaagtgcccagcccgagaggctgggaggttttgttgagg

SEQ ID NO: 6818 - DNA, 291 bp, Homo sapiens
ggaactggtatcctgccaagcctggttgtaatttgtaaccattttctatttgtgcaaactctgtaaatatgtgtttaaacaaatgtaatattttgtacaagatacactggagaacaaagggaactcaagattcttccagccacatgtcacctgtaggtagaagtaaactctgcagtgcagcttctgctcttggcccctctggccagggcccctgtggcttcctgcacactggacaggtgactgtatggtagagactgtgatctgggaactttttgctgtacaaatctgttt

SEQ ID NO: 6819 - DNA, 368 bp, Homo sapiens
atcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattgggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatattggtaaaggcctttcttt

SEQ ID NO: 6820 - DNA, 247 bp, Homo sapiens
gaaagtagttcttgttggtgccttcatttaaaaagcactctttaaaataaaagggaaatgttttctgataaaacaaacatttagttgaggttcttgatataaaacaattacaaaatgagtgttgtttgtaaaacagtaacatcaaattggctagagagataaatgtatcatgttttaaattaggttttgtgagtagacagattacaattctattttaaatataaagtttataaaataaatacttttt

SEQ ID NO: 6821 - DNA, 441 bp, Homo sapiens
  misc_feature 394: n = A,T,C or G
aaactccaagggtttgagtaaatacaaagactgaagaaatttcacagcagtttattaatgtatataaacttataaatatttctccagcaaatttgaggaagcatgatatatttgaattaacaccaagggtgatatttcttttagagatgttagttaatctgttttgtgtcttacgtgaaatttcactgtagactgttttaaattgccaagactgcacaaaattacagtgctaatgtatatggttgcagttcacataaagacaaaagcatctgttatgaaatgagtagtaatattgggtggttgatttgttcttagcagacttggcttcattttggtcttgagataaaatggccagcataaatgctgtttatattcacgttttcctaggtgtggngtgtgcaggccacagcagcatgcccttggtgtagtcagtgccgaaag

SEQ ID NO: 6822 - DNA, 468 bp, Homo sapiens
  misc_feature 11, 180, 187, 285, 315, 347, 356, 423, 425, 459: n = A,T,C or G
gaaagaatggnatatttttttcccctttgagaaagtgctctcattttctttcgagcttttgtttatttttattttagtcttttaaatttagattttagtttttaactacttaatactaacaatttgagagttgagatgaaggagaaataaggcttctacttccagatttacaggttgggntttttanggataatttttatagatgtatttttataccctttcatctgtttcctcatttgtaacatgaagtaataaaatatgcctcatttgccttggaaattttgnggatgaatgaatgacagtttattgtagtgncctgctagttgaaaggtgacccttaaaatttngatggattntaacaacagattttatggtaatagtttttctattatttgtcacatttgacacttttaaaatttgttnangctcgaaaggacacagaagcgggagaaacgtttncatctgtcc

SEQ ID NO: 6823 - DNA, 269 bp, Homo sapiens
gtacgcccagggaaagcggcgttatgacaggaagcagagtggttatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttc

SEQ ID NO: 6824 - DNA, 497 bp, Homo sapiens
aaaaacacctttttttggaagctcgcgcgcctgcaggtcgacactagtggatccaaagtttctgccctgggtgctcatgggattttccttgttgttggggaactcaatcattgtggaccttttgggtattgcagttggacacatatattttttcttggaagatgtatttcccaatcaacctggtggaataagaattctgaaaacaccatctattttgaaagctatttttgatacaccagatgaggatccaaattacaatccactacctgaggaacggccaggaggcttcgcctggggtgagggccagcggcttggaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgc

SEQ ID NO: 6825 - DNA, 138 bp, Homo sapiens
gataaatgtatacaatatttctaagggaaactatgtactgtgatgtaaaagtctgggcaaaatgtatataatcctgtatataattatgtatttgattataattactgattgtaaagatttaataaaatatgtaaatat

SEQ ID NO: 6826 - DNA, 143 bp, Homo sapiens
  misc_feature 4, 5, 10, 12, 15, 38, 51, 67, 108: n = A,T,C or G
ctcnngccgntnggnctggtgaacgataactgcacggnttgttttaagaanatggcagacaaaccanacatgggggaaatcgccagcttctataaggccaagctgaanaaaacggagacgcaggagaagaacaccctgccgac

SEQ ID NO: 6827 - DNA, 400 bp, Homo sapiens
  misc_feature 357: n = A,T,C or G
ggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactgggtgcgaccccccacccccgcccctgggctaccatctgatggggcttnggggtccttcctgtgctatttgtacaaataaacctgaggcagg

SEQ ID NO: 6828 - DNA, 461 bp, Homo sapiens
  misc_feature 1: n = A,T,C or G
nagaaatgtggcagagcataactgggcaaagtcttgtaataattttgcaatcctgtattaaaaattaatgtaattgaagtctattggaattattttcattttttcctcctccagggtaaatattaataactcaaattcctttaaccacttttattcaagctctgtgaatcccaaactccattaacttaaatgaagaaacatggttaaacaattttaggctattttattaatgagacacaattccatagctgaaaaggggaagctaaaatcagttgaaacttggaatgaatcaataaggaaaagaaactttcctgaacaaaataaggttaaaatcattcaagtctgctacaacagaatggctagcaactgctctgccgcacatgtacacaaagtgcttttttgcctcatgaagtttctttgcttctcaaagatgattctttaaggaggaaaaaaaaatcaga

SEQ ID NO: 6829 - DNA, 103 bp, Homo sapiens
cttttctagaattatttttcactctaagtcatgtatgtttctctttgattatttgcatgttatgtttaataagctactagcaaaataaaacatagcaaatggc

SEQ ID NO: 6830 - DNA, 411 bp, Homo sapiens
  misc_feature 409: n = A,T,C or G
aaagtaggctttggttaatttgtggattcatttttatttttgtctttgtttaactttttaaaaaataagatttctggagtagattggtatattctgttaaagacttacagtgatccattttgcttacactgttgcatcacaagggactcacccagggaccatgacctgctggtgtgtgtgtatatttacaaaaacaaaacaaacaaaccacccattgggatataaggtagcaatcacaaactaaagactgcggcttgttgaggtgcaataccctgactcccaaagttagttacagtgggttttattgtttttgtgactgaaggatttattcagactgctgtactcttcatttgatgtaacaaaatgctattaatctaaatatttgtaaataaagtacctgtatcctagntt

SEQ ID NO: 6831 - DNA, 189 bp, Homo sapiens
aagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagtta

SEQ ID NO: 6832 - DNA, 436 bp, Homo sapiens
ctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatggggggcttgtcttttgcagggcacagatgaccaaagtcc

SEQ ID NO: 6833 - DNA, 362 bp, Homo sapiens
  misc_feature 226: n = A,T,C or G
aaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgnaaggaggctaaggagaagcgccaggaacaaattgcgaagagacgcagactttcctctctgcgagcttctacttctaagtctgaatccagtcagaaataagattttttgagtaacaaataaataagatcagactctg

SEQ ID NO: 6834 - DNA, 389 bp, Homo sapiens
  misc_feature 358: n = A,T,C or G
gaagtttccagggcctttggaaaaccagagattgtctttcctgttggaaaaggcaatcactagggaagcacagatgtggaaagtgaatgtgcggaaaatgccttcaaatcagaatgtttctccatcccagagagatgaagtaattcaatggctggccaaactcaagtaccaattcaacctttacccagaaacatttgctctggctagcagtcttttggataggtttttagctaccgtaaaggctcatccaaaatacttgagttgtattgcaatcagctgttttttcctagctgccaagactgttgaggaagatgagagaattccagtactaaaggtattggcaagagacagtttctgngggatgttcctcatctgaaattttgagaatg

SEQ ID NO: 6835 - DNA, 421 bp, Homo sapiens
atccagctgaccttcctgcgcctgatgtccaccgaggcctcccagaacatcacctaccactgcaagaacagcgtggcctacatggaccagcagactggcaacctcaagaaggccctgctcctccagggctccaacgagatcgagatccgcgccgagggcaacagccgcttcacctacagcgtcactgtcgatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaaccctggctccctcccacccaaccaactttccccccaacccggaaacagacaagcaac

SEQ ID NO: 6836 - DNA, 432 bp, Homo sapiens
gaaatgtacacattaaaaggccttgctgacaacttgcacaatgttgaacatagcctttaagcatcatttaaattttaaaggaatgggagtttttcagcctgtggcccagcactggtcaagaaaacaagatggcaacatatatgctttcagggtcaaatttgagcaaactgtaaactgtcagggtgataaaatgtttctcttgatgtttacatgcacaagctttgcgttctgactataaaaagtgtgaacaaatcaatgccagattcctgttttgcgcattgtcatgggattcttaagtgaacctttctaaatgtggtcttgttcacatgctccacgtagctgtaacttcacatcatcagcttgcagtttgtaattgactaaagcattccagtgtcctctttctagattgccagctcatgacatggtgcttat

SEQ ID NO: 6837 - DNA, 127 bp, Homo sapiens
ctggcgcaggcctatagttccagctacccaggaggctgaggtgtgaggatcgcttgtgcctaggagattgaggctgcagtgagctgagattgggccactgcactccagcctgggagacagcaagacc

SEQ ID NO: 6838 - DNA, 374 bp, Homo sapiens
aaagagtcaaagacaaaggacatttatcagccaagagtgtgacgcattcttcgcatctagtctgtagtagtgtctgtgctctgggatggataccgtctgatgtctgtttgttattgatggcgcacccactgcaaaactagtcaactcccatctataactgttactttttctagtgctgctttgtgctgagagaacattttagtttactgcacttgacctgtaaaagactgattctttgtaattttagggataaattaggtggttaatttaaagaagaaatttcaatgttgcctttacatcacattaaaatataacttctttcagaaggataatagaagcactgattcatagtaaaaatcttgtttttagctttg

SEQ ID NO: 6839 - DNA, 389 bp, Homo sapiens
  misc_feature 389: n = A,T,C or G
gtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttattttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaaggattatttgggn

SEQ ID NO: 6840 - DNA, 286 bp, Homo sapiens
ctgaccaccgcaggcgctgtcacccagtgctaccgagacatgggtgcccggcaccgcgcccgagcccactccattcagatcatgaaggtgggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccgg

SEQ ID NO: 6841 - DNA, 295 bp, Homo sapiens
tcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaaccccctcaaaagccaaaaaatgggagacaatttcacatggactttggaaaatattttttttcctttgcattcatctctcaaacttagtttttatctttgaccaaccgaacatgaccaaaaaccaaaagtgcattca

SEQ ID NO: 6842 - DNA, 216 bp, Homo sapiens
caagagacatggattcacttattcggcaaacatttactgggcatgccacatgccagataccgggctaagtatctggcatgtgttacagaaacaaaagacctaaatcttgtcaccaagaaacatgttacatgattttaataagttccctgatagaagagcattggggtgctctggggaaatattggagggtcatccattccacattaaaagagcaag

SEQ ID NO: 6843 - DNA, 441 bp, Homo sapiens
gatctatctcatgaagttgcattacataactaaaatatttagtttcagctgtattagggaactcttaattctctttcagatgaaattatgataaagctacactttactcaataagtaagagtgatgatgatgaaaataacaatagcataagctacaagctaactcattgctaccactaatacatcagatctcacactaggcattttacatatagcgtgggtaatttggtaacagccgggaataagtatttttataatactcattttatggttaaaggcactatatctaaggaatttaaattgattgctcaggtttatttaacttgcatgagcagatattcacatctatttaactcaatttaacagcaatttttgtcatgtagcatgcaaaatgaacagtactaatatttgtaaacaataaagtatatttaaaataagcata

SEQ ID NO: 6844 - DNA, 413 bp, Homo sapiens
caggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtgggggtgtgtgcagggctgcatcccgcagatggctggaatattaaaattcttctatattggctggtaaattgccatggccctgagccactgagtatgttcattgccacccctgtccctcccctgggcaccc

SEQ ID NO: 6845 - DNA, 424 bp, Homo sapiens
atggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacg

SEQ ID NO: 6846 - DNA, 151 bp, Homo sapiens
gttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgag

SEQ ID NO: 6847 - DNA, 379 bp, Homo sapiens
gtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatggggtaggcctttgtaaaattgacagagaggggaaaccccgtaaagtggttggttg

SEQ ID NO: 6848 - DNA, 440 bp, Homo sapiens
  misc_feature 397, 404: n = A,T,C or G
gcagagcatagaaaaaagatgagtgaatccggaatcaagtaccatacacccctgttctcccgcttcctagctttgtctccttagacaagaaactatgttgcctctttgtcttcacctgtaaaatggtaatatttacagctcacataagattttgtgaatcttaaaccagtgccactcatcaaacattattcaagtgggaattcctattattaacttttagtagcaaaaactagaagcaataaattatcaactcatcactatttttacattcaaatgactggtactgtaagctcctggaaggcagagaccataccacacatttacatagcagctagacagacatcatatacagatatgtgctcaattcaagtttagatggtggataaagggaaaaagntttcctnaattttaaaaaaattagctcaagggctgggcactgt

SEQ ID NO: 6849 - DNA, 404 bp, Homo sapiens
  misc_feature 244, 255, 296, 350, 359, 362: n = A,T,C or G
atacacttaatgttgttattgtatgttgttactgaagtacttagatttttaaaatttcaaatcctaaatcacttcttgtaggagggttttcattaactgcagtatatacagttcactacatatgggttgtttgagttttttgtgtgctgtatttctttctgttttttaatacctggttttgtacatatctaactctgttctcttttggttgttcagaaactggattttttttttcttaagcagngcttaatttgngttttttaattttgattcagaagtagtcccagctcataggngttcatactgttacatccagaacatttgtcaggctctctgtcagctttcatgtncatatggtntanaaaccatgggagttaggcacttcctggattttttttttatgg

SEQ ID NO: 6850 - DNA, 384 bp, Homo sapiens
  misc_feature 368: n = A,T,C or G
gtccgacctccacggcctcacggagctcatcctgctgccccctccgtgccctgccagtttcaatgcggatgaggacgattcgggtggacatcctgggcccccagccggagtcgcaccagcaactctctgccagctcccacaccgactacgcttccatccccaggtagctggggcagcctctgccaggcttgggtgtgcctggcctgggactgaggggtccaggcgaccagagctggctgtacaggaatgtccacgagcacagcagttccagctacttgggaggctgacatgggaagatcacttgagcctgggagttcgaggctgcagcgagcaatgattgcgccactccactccagcctgggtgaganaagtgagaccccgttt

SEQ ID NO: 6851 - DNA, 423 bp, Homo sapiens
gttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaaca

SEQ ID NO: 6852 - DNA, 295 bp, Homo sapiens
gttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtccc

SEQ ID NO: 6853 - DNA, 110 bp, Homo sapiens
ctttttaaagagtctaatggacttataacagccttattagcacattaagttctaagagcatcatcactgtaactcagactgaaaatgtttttcctctccctttcagaaac

SEQ ID NO: 6854 - DNA, 435 bp, Homo sapiens
  misc_feature 13: n = A,T,C or G
ggaacatggcggnggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgc

SEQ ID NO: 6855 - DNA, 261 bp, Homo sapiens
gttaaatgttaggaaaaaaattctgaagtttactgatacattgcttggaccccaaagtccctgcactccttagacaagtgttggagggaaacggccacatcaggggtgaagtggcatttatccactagtatactccaagatgtcgcgagtccctgaatcccccacatctctgatttggtcttccagcaactattggaataaggctatatgatttgtgcaacaacaatgaaaagaaggcaggaaagagggaaggaaggatag

SEQ ID NO: 6856 - DNA, 138 bp, Homo sapiens
caggaacaggctccgacgagatcttcctggcaccctgagggtcgtcctccagcaggggcttcttggacccctgtctgaggggtcgcgtcttagtagggcgggattcttttccctttgaataaaaatggattcaaaccc

SEQ ID NO: 6857 - DNA, 390 bp, Homo sapiens
  misc_feature 27: n = A,T,C or G
attgcatgcaagtttgctgagctgaangaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaaaga

SEQ ID NO: 6858 - DNA, 399 bp, Homo sapiens
  misc_feature 378, 389, 398: n = A,T,C or G
gaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttnccaataaaaanaccttttcnt

SEQ ID NO: 6859 - DNA, 424 bp, Homo sapiens
cttccctcccaggctccttaccttggtcttttccctgttcatctcccaacatgctgtgctccatagctggtaggagaagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtagggagcagagccactatctccattgaagctgaaatggtagacctgtaattgtggggaaaactataaactctcttgttacagccccgcc

SEQ ID NO: 6860 - DNA, 433 bp, Homo sapiens
  misc_feature 327: n = A,T,C or G
gtcgggtccgcggcctgcgctgtagcggtcgccgccgttccctggaagtagcaacttccctaccccaccccagtcctggtccccgtccagccgctgacgtgaagatgagcagctcagagggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcangcagccgagatgctttatggattgatccacgcccgctacatccttaccaaccgtggcatcgcccagatgttggaaaagtaccagcaaggagactttggttactgtc

SEQ ID NO: 6861 - DNA, 336 bp, Homo sapiens
ccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggc

SEQ ID NO: 6862 - DNA, 440 bp, Homo sapiens
gtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattggaatgtgaaacatcccgttttcattgttcacttctaaaccaaaaat

SEQ ID NO: 6863 - DNA, 333 bp, Homo sapiens
ggttcactgttctataggctgtgcaggaagcatagtggcttctggggaggcctcaggaaacttacaatcatggcagaaggggatgtgagatgtcttacatggtggagcaggagcaagagagagagcagggaggtgccacacacctttaaacagtcagatctcctgaggactctatcgtgagaaaaatactagcagggtgttaagccatttgtgaaaaacggccctcatgatccagtcacctttcaccaggccccacctccagcactggggattgcatttcaacttgagatttgggtggggacacagatccaaaccagatcactgtaattcctg

SEQ ID NO: 6864 - DNA, 418 bp, Homo sapiens
  misc_feature 392: n = A,T,C or G
gcccactcctggaagccgctgttccctttctaccttcttaccagagcccaagggcaggcctggtcccggggaagcagcagcttgctgacataagtcagctgcaaaggctgaggagtgtgccctcagagaagcaccgccccccagtcttgtgccagcgcctagagccgcagctcccagggatgctccttccctggaggcagcccaggagagggactctggcagcgttcttcagatttgtggccactgtttctcatttgctggttgactgtttttatttcttaggcttttgctagttttagaaaatagggaagcagcccctgatttgtggattaaaagcaacatttgagcgatgatgcacaacagtccaggaaaatgggcggtggacacttgangctgaagatggggagttgacatgagc

SEQ ID NO: 6865 - DNA, 435 bp, Homo sapiens
gctgctagggtgtctggctcctggcggctttgccatccatgaggcaagggctgggaacacagtgtctttgcctatggtagatccatgtgaatgtcaggaagccagctcttcagtcttggagatgatttctgctacaattctgtagaaagattaaggatggcagagtaaaaggttaccaagaatgccaggatgtttttcttgggcgtaggaggtccagattactttcctttttgatgaaagagtttggaagactgtcccatctctctggcttgagaaatctctgccattttaaacatcactgtgaaatagcaattattatcatctgtatttagttttaacattacccacaacatagaaataataggtaaaaatcgtcttgcctactcattccaaagatgatcaagtcattaatctagcaaagtattcatgtatcag

SEQ ID NO: 6866 - DNA, 438 bp, Homo sapiens
  misc_feature 396: n = A,T,C or G
gtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaaaagtttgctctgcatttttgatgatgggnttgggaacattatctacaattttactctcaaatagtcaaaat

SEQ ID NO: 6867 - DNA, 421 bp, Homo sapiens
tctccaaaagcaattttagtggagtaatagaactgcaaatcaaataccagtattttgagaagcagcaattaagaataattgtagaattgagagcaacaaatatagccactctcaaaaaattcacctgagtggaagacggtggtaatagctaggagaggatgctatgttgaaggccagttttaattactttttaaaatttgttaaaaatatgtgatagacttgaacacaaagataggttgaggacaaaaaggcagcagagaggaagaccaatacggggaaatggggtggtaattgatgaggcaagtgtcctgagaatttgagaagggatctttgagaaccacaacttctagccctgataactgtgaatatatatcgagataatgataaccctttaggtgcaaagataggtcgtcagtggtag

SEQ ID NO: 6868 - DNA, 331 bp, Homo sapiens
  misc_feature 146: n = A,T,C or G
cgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccnggtggacctgctccagcagctggtgctgcaccagcaggaggtcctgccccctccactgctgctgctccagctgaggagaagaaagtggaagcaaagaaagaagaatccgaggagtctgatgatgacatgggcttttggtcttttttgactaaacctcttttataacatgttcaataaaaagctga

SEQ ID NO: 6869 - DNA, 402 bp, Homo sapiens
ccccgaggtccccctggctctgctggtgctcctggcaaagatggactcaacggtctccctggccccattgggccccctggtcctcgcggtcgcactggtgatgctggtcctgttggtccccccggccctcctggacctcctggtccccctggtcctcccagcgctggtttcgacttcagcttcctgccccagccacctcaagagaaggctcacgatggtggccgctactaccgggctgatgatgccaatgtggttcgtgaccgtgacctcgaggtggacaccaccctcaagagcctgagccagcagatcgagaacatccggagcccagagggcagccgcaagaaccccgcccgcacctgccgtgacctcaagatgtgccactctgactggaagagtgggaga

SEQ ID NO: 6870 - DNA, 440 bp, Homo sapiens
  misc_feature 409: n = A,T,C or G
ccgccaggcctttcccaataccaaccgctggttcctcacctgcattaaccagccccagttccgggctgtcttgggcgaagtgaaactgtgtgagaagatggcccagtttgatgctaaaaagtttgcagagacccaacctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataangacggctggtcccttgtggtactcagagtat

SEQ ID NO: 6871 - DNA, 217 bp, Homo sapiens
gaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaa

SEQ ID NO: 6872 - DNA, 410 bp, Homo sapiens
ctgtctcaccacaaaattgtcttaataaggacggaaataagcaaagccttgatatatcataaatcttaatcaaagacagtgtttaaagttctccagaacctgactgaacaaaagagagtcacataaaagggaggattgactgtgttggcagaaagaaagtgtcagacagatagcaaatgagggcatcatttctgatagtgcaggggaccccagacatgcacatggatgcacagagagatgcacacacacacactcatacacacaggcagacacaaacagagatgcaaatgcccacagatgcacacacagacaaagagagagatgtacacacagagaaagatgtacacacagagaaagatgcacacacaaagagagatgtacacacagagaaagatgcacacacagatgca

SEQ ID NO: 6873 - DNA, 440 bp, Homo sapiens
tggttcgtgaccgtgacctcgaggtggacaccaccctcaagagcctgagccagcagatcgagaacatccggagcccagagggcagccgcaagaaccccgcccgcacctgccgtgacctcaagatgtgccactctgactggaagagtggagagtacctggattgaccccaaccaaggctgcaacctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccagttcgagtatggcggccagggctccgaccctgccgatgtggccatccagctgaccttcctgcgcctgatgtccaccgaggcctcccagaacatcacctacca

SEQ ID NO: 6874 - DNA, 253 bp, Homo sapiens
  misc_feature 9, 10, 61, 96, 100, 168, 178, 194, 207, 239, 246: n = A,T,C or G
gccccttgnncaaaggctgactgagcgccagacaggacgtttccaactcaaaaatgcaggntcaacagtaccaccatcagcgtagaaaatttgcanctgncttcttggcattcattttcatactggcagctgtggatactgctgaagcagggaagaaagagaaaccanaaaaaaaagngaagaagtctgactgnggagaatggcagnggagtgtgtgtgtgcccaccagtggagactgnggtctgngcacacg

SEQ ID NO: 6875 - DNA, 232 bp, Homo sapiens
  misc_feature 11, 25: n = A,T,C or G
gccaccttggnaagtgcctgcgcanggcccggccgccctccatctgggccgggtgactgggcgccggctgtgtgcccgaggcctcaccctgccctcgcctagtctggaagctccgaccgacatcacggagcagccttcaagcattccattacgccccatctcgctctgtgcccctccccaccagggcttcagcaggagccctggactcatcatcaataaacactgttacagc

SEQ ID NO: 6876 - DNA, 200 bp, Homo sapiens
tcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaag

SEQ ID NO: 6877 - DNA, 420 bp, Homo sapiens
tgttccagaaataagctgtgttctactatgcctctaaatgactatacatttcagtatcacacttgatgtatttttaaattgtagcttaagttgaactgtaaataaattaagggatgtagacatatgattgcacttttaaagacatgctgggcttctgtagtttataggaagaacatactgtttgctggaaaaatcagtgtctcataatgtgatacatttttgttctctgtgttacttttataggtagatctttttctccgtggtacttaccactgcctcatatattgtatatttgtttggtttcgtctgtcttcttctaccaggatgtaagtcacacagggcggaaactttttgttcactgcagtatcctcgatgctttcaacagtgcctggcacataaatagctcttaatattaattga

SEQ ID NO: 6878 - DNA, 285 bp, Homo sapiens
acaaaaaccccaaaactgaatgctttaattaattagctttgcaacatttataattacatgtaatgcttctttgcaggaacacacatatttgcctttatcaagaagcttatacactaaactatgttgaacttacatgtcaagaaacttatatactaagttaaacgtaatttctggtttaatattgagtatagcattattagtatgtacgcatgttacccatggccttatgtgtgaccattcattttcagtattgaagcagcacgcttggcttgcattttatgaagt

SEQ ID NO: 6879 - DNA, 366 bp, Homo sapiens
gcctagctcagtgacaccagcctgggccacatggcaaaaccccgtctgtaccaaaaatgcaaaaaattagctgggtgtggtgttgacgtttgcggtcccagctactctggaggctgaggtgggaggattgcttgagtctgggaggcagaagttgcagtaagccgagatcatgccactgcacaagctaggtgacagaatgagactctgtctcaaaaataattaaaaagcctctgccccaaactcgttaaaagattttataaccacaactgctgtttctgtgtagatgcatctgcatgcccaggagcagtaaatgcaataaaatcatttggttatactttgaacacaaaataaacggttgaggctttt

SEQ ID NO: 6880 - DNA, 438 bp, Homo sapiens
  misc_feature 1: n = A,T,C or G
naccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaataagttctgccacctctgacgcaccac

SEQ ID NO: 6881 - DNA, 430 bp, Homo sapiens
  misc_feature 240, 287, 312: n = A,T,C or G
cttcagacgccctatggcgtccgcctcgacccaaccggcggccttgagcgctgagcaagcaaaggtggtcctcgcggaggtgatccaggcgttctccgccccggagaatgcagtgcgcatggacgaggctcgggataacgcctgcaacgacatgggtaagatgctgcaattcgtgctgcccgtggccacgcagatccagcaggaggttatcaaagcctatggcttcagctgcgacggggnaaggtgtccttaagtttgctcgcttggtcaagtcctacgaagcccangatcctgagatcgccagcctgtcangcaagctgaaggcgctgtttctgccgcccatgaccctgccaccccatgggcctgctgctggtggcagcgtggccgcctcctgagagttggccctcccttgtgccactgccaggggaag

SEQ ID NO: 6882 - DNA, 452 bp, Homo sapiens
  misc_feature 352: n = A,T,C or G
cacaggcatgcatagcctcaacttatataagttatgccaacttgtgttctgaagtgggcatggcagcttatgctcccagcaggagtctatgagaattcttgttgtacatcctcaccaacatttgggattgtgagacctcatgttttatccatctattcagctggaagtgaaatctcagaggggtttttaagttgcttactagtgagcatgagcatcttttcatatgttgcttggcccttcctgtttccccatctgtgatttgaccattcaaggtgtttgcctacttttcaatgggtctattctttttgttattgatttgtagaaatcccatataaattatggaaacatttangtctttaactggaattaattttatatgaatgctgggagatagaaataaatttttgcctgctttatcttcttacttgtttattttcatggtttcctggcat

SEQ ID NO: 6883 - DNA, 443 bp, Homo sapiens
aagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacga

SEQ ID NO: 6884 - DNA, 413 bp, Homo sapiens
  misc_feature 12: n = A,T,C or G
cttgtccatggnaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgaattatgaaataaaaactaaataac

SEQ ID NO: 6885 - DNA, 464 bp, Homo sapiens
  misc_feature 1, 14: n = A,T,C or G
nattccttcaaagnttactgtaatttcacatctggtggtgagacttgcatttatccagacaaaaaatctgagggagtaagaatttcatcatggccaaaggagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatga

SEQ ID NO: 6886 - DNA, 452 bp, Homo sapiens
  misc_feature 448: n = A,T,C or G
cacccccaaatgccagcctctcctttcttcccatccaccagtatactgcggggccatttctggtctttgtccaacaggaaacccatttctggtgggatatgccttccagtgccacagggccactcaccccatgcatctctgtcctgcccgtcagtgctgggacggacagcaagggcaagcccagtgtctggcggataggtgggtgggaacagagaggggagaatgccgtcctaagcttctgcttggggatcccccacacgacctgggtactgcctgggaaacctgtcctaagtaaaactatggacctcgcctcgcccaccggcctgcaaagccagcatctccgtgaaggtggatggaagcgcctttgtcctcattttgagctgcaagctgggtcagcggctctgaagccctcgagtgactttctaacccaagacccagcccctggcangagg

SEQ ID NO: 6887 - DNA, 227 bp, Homo sapiens
gtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaacc

SEQ ID NO: 6888 - DNA, 336 bp, Homo sapiens
ccaggagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggcttggaaggggtccagcctcgttggaagaggaacagcactggggagtctttgtggattctgaggccctgcccaatgaga

SEQ ID NO: 6889 - DNA, 500 bp, Homo sapiens
  misc_feature 12, 16: n = A,T,C or G
tattacaattantggncgactagtggatccaaagaattcgacgagcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagc

SEQ ID NO: 6890 - DNA, 257 bp, Homo sapiens
  misc_feature 13, 202: n = A,T,C or G
taccaatgagggnatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaanaaagccgaggctggggctgggtcagcaaccgaattccagtttagaggcggatttg

SEQ ID NO: 6891 - DNA, 361 bp, Homo sapiens
gcagcgccaggtgacaagatgttgtgaggggttttgagtcatccagtcctgggcactgaggtctgttagatgaaaggatatgagaaaggtaatattggtaaataaagaaataggaaacaatgtaacaaatgttaagtacagaaatacattaatgggtggtaaataaagatgtaaaagaaggcaatgcgatcgatggtggcaaaagatcatcacagattaagggctatggctggtccacttctagaaaaccacaggctgtccattaaataatgaacatctaagtgaacaagtcagtgagtacctaaatagacaaggatgaggtgaatgagaagacatggccccatgggtcctcctgatgagg

SEQ ID NO: 6892 - DNA, 336 bp, Homo sapiens
  misc_feature 11, 12: n = A,T,C or G
cttcggagcgnnctctgtcctacttctgactttacttgtggtgtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttctttttttttccttttttgtctatgaagttgctgtttattttttttggcctgtttgatgtatgtgtgaaacaatgttgtccaacaataaacaggaattttattttgctgagttgtt

SEQ ID NO: 6893 - DNA, 243 bp, Homo sapiens
gaaaggcaaaccaggagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttg

SEQ ID NO: 6894 - DNA, 443 bp, Homo sapiens
  misc_feature 54, 100, 115, 125, 167, 233, 346: n = A,T,C or G
atttaatacaatatcttgttcaagttcacagagctagccagcagcaggtgcaanactaaaatctagtaatgtcatcggaaaccttgctcttaagcatgtnacttttatgcatctntttctctagngggggatgaaggtaagtacaccagtgagcttatggctttgtnttttggtgatggatcttgctcctcttacagtaccctgggcatttacccatctgattaaagtaagtnattctagaaagagagaaggaaactgccatcagttattatttcaaacttcacaataaggaatgggaatttagcccagatccatctaccttaaagccccaataggaacatcatanagcatggagtagtgcttatactggcaagatgtacaatatcagagaaatttacaacaaggtttccatcagataaattcaatgcttcctgtgagcagag

SEQ ID NO: 6895 - DNA, 106 bp, Homo sapiens
  misc_feature 106: n = A,T,C or G
caactagcttctttattagagaggagcgggtgaaaagtagtagtttaatgttcagatatacaatcatttaaaagtattcaatacatggtgtttgatggtaatggcn

SEQ ID NO: 6896 - DNA, 111 bp, Homo sapiens
  misc_feature 53, 104: n = A,T,C or G
tacttctagagcggccgcgggcccatcgattttccacccgggtggggtaccanggtaagtgtacccaattcgccctatagtgagtcgtattacaattactgggncccgtca

SEQ ID NO: 6897 - DNA, 445 bp, Homo sapiens
cggactccttggtagtctgttagtgggagatccttgttgccgtcccttcgcctccttcaccgccgcagaccccttcaagttctagtcatgcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgaaacgggtgctggcaagcatgtgccccgggcagtgtttgtagacttggaacccacagtcattgatgaagttcgcactggcacttaccgccagctcttccaccctgagcaactcatcacaggcaaggaagatgctgccaataactatgcccgagggcactacaccattggcaaggagatcattgacctcgtgttgg

SEQ ID NO: 6898 - DNA, 442 bp, Homo sapiens
  misc_feature 1: n = A,T,C or G
natttggagatacataaattttaaaatcaaaatactagtaatgcatggtaaaggtgtactccaacatttatttgataatattttagtttttaataggatcaactaagtgaatttctcatatcgattttgttgcatcgttagaattacatgcatgatttagatgtgtacataattgaaccaaacacagaaagagttcaaggggaaaagaaggctaatacagtatgtacttaaaaaaagtctatagtgatactagtgaatacttatgtgttgtaacgagaacatttgtgattactttgagcttggggaaatattatttctaagattactttgagcttggggaaataaatgtaaggttggctaagacactcgtaccatgataaattcctccaaacttccacatcattctccagaagtccctgggacttgagaagccaggttagcg

SEQ ID NO: 6899 - DNA, 379 bp, Homo sapiens
aaagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatattttttgtacatctagctgtatcgaggcatcaggcctgaataaacatcctttctt

SEQ ID NO: 6900 - DNA, 458 bp, Homo sapiens
ggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactg

SEQ ID NO: 6901 - DNA, 440 bp, Homo sapiens
ccgaagactgcgatgacttctgcgctgacccaggggctggagcgaatcccagaccagctcggctacctggtactgagtgaaggtgcagtgctggcgtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctggtgacggtgtcaggacagagggtgtttgtggtgaagaggcagaaccgaggtcgggagcccattgatgtctgagcctgccggagggcgagggtcggagaagcggattgggtcctgggcctctgtgatgaggcaggcacacctgtcggtcttggcttgctgctagaactagggccttctgctcgcccacctcccacccctac

SEQ ID NO: 6902 - DNA, 106 bp, Homo sapiens
  misc_feature 57, 75, 78: n = A,T,C or G
aatatcttccacagagggaagtttaaaacccaaacttccaaaggtttaaactacctnaaaacactttcccatgantgngatccacattgttaggtgctgacctaga

SEQ ID NO: 6903 - DNA, 440 bp, Homo sapiens
  misc_feature 300: n = A,T,C or G
cccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcggtggtcagagcggtgagcgangtgggtttggagactcagcaggctccgtgcagcccttgggaacagtgagaggtttgaaggtcataacgagagtgggaactcaacccagatcccgcccctcctgtcctctgtgttcccgcggaaaccaaccaaaccgtgcg

SEQ ID NO: 6904 - DNA, 326 bp, Homo sapiens
  misc_feature 4, 10, 12, 170, 172: n = A,T,C or G
gcgngggatngngagatgagatgccttctggcttacttcactgtaggccatcctgggaaatttcaagtcgttcataaatatacataccaaaatcaaattctaaattacaaacagaataagatgagtaagcaaagatcaaagtgaagaaggtgtggaattttggagggccngngggtagaatggtgtgccatgggaaggagagaggagcatcctggagacgctcctttcaccaacaaggtaagggagtggtttatcaaatttctttggtccataggtattgacaaacgttgtgggcttcaggttctagcctagggcagaacaaagcc

SEQ ID NO: 6905 - DNA, 277 bp, Homo sapiens
aaataaatggctgtggttttgagatatgaacctatatatccctttttaaaaaaactattttagtttttcatgtaatggggaaagagaaatttttactttaccttctccttttaatgagtgttctttcttatgtattattttaaggaaacctgactctttcttctacatctgctttaatatgtaacatttaattttgcactaattttctaaaatcacaatgtatatgcttttgtttgcatgactatgagtaaattattaaacaaagataaggtaaaca

SEQ ID NO: 6906 - DNA, 413 bp, Homo sapiens
gtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaagtaagttttgattttcaaatgttctgcttcatgtgtctgtgaagaattgtacttttttaaaagtgtgtgtcctctga

SEQ ID NO: 6907 - DNA, 219 bp, Homo sapiens
  misc_feature 12: n = A,T,C or G
tgtaaccacagngactacaagtagttctttctctattgaattattaggtccagaatagaagatgtcattgtacactttatttccctcacactgtgttacgctctgatgtgctatgcttagctatctgtcagagattagtaaattataaaactcatgtgtactacttaagtttatatcttatgctagtttataagaacaattaaaaggacttagaagatt

SEQ ID NO: 6908 - DNA, 301 bp, Homo sapiens
aaaatctaaataaggtcaataagaaatgaaacaggagatattacaactgacaccacagaaatgcaaaagatcatacaaggctacaatgaacaactttatgtgcataaactagaaaaccaagaatagatgaataaattcttgggaaagatacaaccttcttagcttaaatcaggaagaattagataccctgaacagatgaaaaacaagcagagagattgaaatggtaattcaagaattaacaacaataaaaaaaaaatgtccaggaccagatggattcacagctaaattctaccagacattc

SEQ ID NO: 6909 - DNA, 197 bp, Homo sapiens
aaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccatt

SEQ ID NO: 6910 - DNA, 407 bp, Homo sapiens
gccatttccccagtattggcatgggcatggaaagaatgcttcttgagttaatgattaaggagaggctctcttcctgggcatcccacaggtcctcatcagcatggtgtacctacccgaggccatgccagcctccttccaggccatctacacccccgtggagtcagcaggcacggaagcccagatcaagcacctggctcggctcatggccacacagatgacagctgccggactgggaccaggtgtagagcagaccaaacagtgcaaggaggagcccaaggaggagaaggtggtgaagacagagagcgtcctgatcaagcggcgcctgtcagcccagggccaagccatctcggtggtgggttccctgagctccatgtcccccctggaggaagaggcaccgcaggccaaga

SEQ ID NO: 6911 - DNA, 244 bp, Homo sapiens
cggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagca

SEQ ID NO: 6912 - DNA, 440 bp, Homo sapiens
cttatgaaaagaaggctgcgaagctgaaggaaaaatacgaaaaggtaagaagtgtgggtttgcttggtaaaatgatgacaagtacgccagatgtatgattgtacttagtttgaggtgtaataagtttttagggtaacagctacattaagtatggtgttgatataagtcctcatccttcaaagaatgcagaggaccaaataaattagggtttttttgactaaaatgtaatcagactcagacaaaggctgtgtacatttatgttggttttgttattccccagtatcttgaagttcatgaaaatgttggtagtcacttcaagtcaaaaatgagcattttcaaatggcttggcatacagtacaaaaacaggctagacaaagtaatataggctatatttttcttagtcatatcctgaaacatttatgttcttttcctttagatac

SEQ ID NO: 6913 - DNA, 414 bp, Homo sapiens
  misc_feature 410: n = A,T,C or G
gtcaggtgaccttactcaggagcagatatctccttggccgccatggagcctcatccatccacacgtgcctgtagcattccagagctcactgcccttctagatgtgccttcccgcttggcttccagcggcttgtgctcactctgtctgccaggtatgagaagaacacgtaagaccgccaccacactcaccctccctcaaggccctgtgccataggggtggccacccgacctgcccccagaacttttggatactggaggcagttgcataggtctccctctctgggcaccaggactcagtccagcccaagactactctgggcagctcccatcccagtctggggccatttgcagactcaggaaaggatttctacagtgttctataaaagccaaaagagagagtggggtttgggnaaga

SEQ ID NO: 6914 - DNA, 413 bp, Homo sapiens
  misc_feature 348: n = A,T,C or G
tccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccggtgggggaangggggcaaaggatgctggagctgaatcagacgctgacagttcttcaggcatttctatttcacaat

SEQ ID NO: 6915 - DNA, 124 bp, Homo sapiens
gcagagcttcagaggtggccccacctgagcccccacccgggagcagtgtcctgtgctttctgcatgcttagagcatgttcttggaacatggaattttataagctgaataaagtttttgacttcc

SEQ ID NO: 6916 - DNA, 283 bp, Homo sapiens
gcacagaggggtttgtccagcgccacatgcccaccatccggtgccagcccagcgggcactgggaggagcctcagatcacctgcacagaccccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccatt

SEQ ID NO: 6917 - DNA, 427 bp, Homo sapiens
acgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagc

SEQ ID NO: 6918 - DNA, 429 bp, Homo sapiens
gcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaac

SEQ ID NO: 6919 - DNA, 438 bp, Homo sapiens
  misc_feature 412: n = A,T,C or G
gccctttgaaaagctgttcagaaatcatttacagtgatctttcatctcggtcgctgtagtgaaacattttagtgtgataaatttcaaaattctaaacaaattacccacttttatattggaaatctctaccagaactccctcttcattttttaaggcatacatttgcttgttttcaagatcaagaattctgagctagctttaagtagcaaactgatttatatgtgcaattataggatgcattaagatgaatgatagcctttacatattgaaaactttgcagacgttttgttttgaaaatggcattgtatagtaaatgcaaattaattttgtaaaattatgttaaagagtatgttcagacactttctgccatggccaaaaagtatgtatgaaagtatgtgtgtatttggtttgnaaaaggatgccaatgttttacctgat

SEQ ID NO: 6920 - DNA, 434 bp, Homo sapiens
gttaaatttcccaaacatttcttctagttctttcttccatgtcatgtaatttattgtgtttttccatttatacaacctaatgctaggttagaaaactgatgcttaggaagatatggtattatctgttggtttcaccagggtttgtgaatactgattacagtctttatacataacagtatttttaaatggctgctatatttggggagccccttgtctatactgaaggtttggactgttcttgtaaacaggtatatgcatctttaaaataatcaaatgtccacctccaccttgccccattgtttactagatttagacttatgagatggagcagagaaaagcctcactgggatgggtggagggtcttggtcttgtcttttggccttgagactttaggtactttccatacccaccaatatgtctagactcagaggcta

SEQ ID NO: 6921 - DNA, 439 bp, Homo sapiens
cgttgctgctcatgatttacatccctgacttctaatctctttgagtgtgaaaacttcctttttaacaccacaaattattgttctctccctttgaggatataggtcacatatttttatagtaatgattgtacttacaaaatgtatgtactgagaagatatgaaataatgagtaaatgccaggaaattctcactctatgtctttgtattctttggtgtatacatactacaattaaatccacacatattgattgaaccaactatgtttaggggacactgcctgtgatggggattataggggaaagaatgagcaagaagtctctatccttgtgaggctttcacaggaggaggtagataataaacaagtaaatactacagaaaagatatttatagattgtgatgactgacatcaagggaataaagaaggtgatgtataataatg

SEQ ID NO: 6922 - DNA, 435 bp, Homo sapiens
ggcgcgtgggtgaggaaggtcaggtctaggaactctaactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgagcatcaggattttatggatgagcaaaaacgactaaagaagcttcgtggaaaggagaaaccaaagaaaggagaagggaaaagagcagcaaaaaggaaatagtggttggtccctcaagagggagactttcttcctcagtggcggagagaagaaagtgcat

SEQ ID NO: 6923 - DNA, 255 bp, Homo sapiens
  misc_feature 103: n = A,T,C or G
atttcttcttcttcttttttaactgaaagctgaatccttccatttcttctgcacatctacttgcttaaattgtgggcaaaagagaaaaagaaggattgatcangagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttg

SEQ ID NO: 6924 - DNA, 427 bp, Homo sapiens
aaaatgaaagaggggcttgaggatgagaaaagagaagagaaagccctgaagaatgacatagaggagcgaagcctgcgaggagatgtgtttttccctaaggtgaatgaagcaggtgaattcggcctgattctggtccaaaggaaagcgctaacttccaaactggaacataaagatttaaatatctcggttgactgcagcttcaatcatgggatctgtgactggaaacaggatagagaagatgattttgactggaatcctgctgatcgagataatgctattggcttctatatggcagttccggccttggcaggtcacaagaaagacattggccgattgaaacttctcctacctgacctgcaaccccaaagcaacttctgtttgctctttgattaccggctggccggagacaaagtcgggaaacttcgag

SEQ ID NO: 6925 - DNA, 323 bp, Homo sapiens
caaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttcca

SEQ ID NO: 6926 - DNA, 445 bp, Homo sapiens
  misc_feature 9, 10, 13: n = A,T,C or G
ccaagatgnnggncccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggatagggaaagaaaaacttatccaggaaggaaaattggatcgaacatttcacctctcatattaagtctggcaatgatgactatatgtattcctgcctaaataaatcatctatt

SEQ ID NO: 6927 - DNA, 179 bp, Homo sapiens
  misc_feature 179: n = A,T,C or G
ggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacagcn

SEQ ID NO: 6928 - DNA, 409 bp, Homo sapiens
gtaatttttggataaggtatgctgaagaatctcctgcagaagtctgatacatgattttcatgttaattgtaaatgttaattccctcttgcaagggagacatatcctagatcactttgctttttctttaaggagctgatgttgcacctaaacattccaacccttaaagctaaaacagcacaaaaaaatttcacttttgaaatgaaatttttataattgtatggcaaaaggctatgtaaaaacaaatcttgcatcttaagacaaatattcttttatttctgttaaactgaatatacaattgttccctaggcaaccaacttttgcttataactacaatttaatttcacgttgacaaaacacagtgaaaagacaactttgtgaagatctaattacaataataaataaaataat

SEQ ID NO: 6929 - DNA, 406 bp, Homo sapiens
gcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagccggaagggtacagccaatgcccgaatgccagagaaggtcacatggatgaggagaatggagggattttgcgccggctgctcagaagataccgtgaatctaagaagatcgatcgccacatgtatcacagcctgtacctgaaggtgaaggggaaatgtgttc

SEQ ID NO: 6930 - DNA, 422 bp, Homo sapiens
gcaggtgcaggcgctgctgggtgtggccaagtgctgggtggccaggaaggcgctggacaaggctctggatgccatcgagagagcccaggatctggccgaggaggtggggaacaagctgagccagctcaagctgcactgtctgagcgagagcatttaccgcagcaaagggctgcagcgggaactgcgggcgcacgttgtgaggttccacgagtgcgtggaggagacggagctctactgcggcctgtgcggcgagtccataggcgagaagaacagccggctgcaggccctaccctgctcccacatcttccacctcaggtgcctgcagaacaacgggacccggagctgtcccaactgccgccgctcatccatgaagcctggctttgtatgactcctggcagcaggcgtgggcttcctcctcgcca

SEQ ID NO: 6931 - DNA, 406 bp, Homo sapiens
  misc_feature 168, 198, 252, 320: n = A,T,C or G
aaacgattctctgctttttggttctgaacttgaagtccctaaactgcaaaatctaagagttgggtggttattaaaatgcttttaaagtcaactgtggcaccaattctaatgtaatccaacttgtgactgtttttttttgttttgttttgtttttgtgtgtgtgtgtgnggcactgggaaaagtggaaacaaacatgtnttgaaatacatattggaaataaaaatggtttgagcgtcagtgatattctcccanaatgtacttatcttacctcggcatgtactgtagtcactcagtatttgtatatgttgctagaattttanattgtaaaatagtgaaattttaatgtgttcatttgtttttaatgtatatatgtcttgctcagattatttggtttaaataaaacaac

SEQ ID NO: 6932 - DNA, 412 bp, Homo sapiens
  misc_feature 350, 398: n = A,T,C or G
gcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcangcgtcggagggccccctcaagggcatcctgggctacactgagcaccangtggtctcctctga

SEQ ID NO: 6933 - DNA, 172 bp, Homo sapiens
ccagcaggaaagcagtgggagttgggtagctgctggggccagcatgtcctcttccacactacctgcctttcagaactctgctcttccgcttgtcccaaagtcagggctggcaatcttcataatcaaaggggagttggaaaagaacacccactaagaggcctccatggcagat

SEQ ID NO: 6934 - DNA, 438 bp, Homo sapiens
cagatgtgcgcattgacaccaggctcaacaaagctgtctgggccaaaggaataaggaatgtgccataccgaatccgtgtgcggctgtccagaaaacgtaatgagggatgaagattcaccaaataagctatatactttggttacctatgtacctgttaccactttcaaaatttctgtgctaaacagtgttacagtcgccaagagcccataaagggagccctcctggaagtggatgaggccttgggtctcggctcttcattgcttcctgagctgcagcagatgcctttacaaccaagctcaccgaggacgtctgtctcccatattaccctggcagagggccaggcctgttctacacggccggggtttcaacaaggtactgatgtcttctgcccttgcctcttcgacaggcaagtaataagacttaagtgaaggagaattc

SEQ ID NO: 6935 - DNA, 410 bp, Homo sapiens
  misc_feature 12: n = A,T,C or G
ggcaacagccgnttcacctacagcgtcactgtcgatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaacccccacaaaagccaaaaaatgggagacaatttcacatggactttggaaaatatttttttttcctttgcattcatctctcaaacttagtttttatctttgaccaaccgaacatgaccaaaaaccaaaagtgcattc

SEQ ID NO: 6936 - DNA, 286 bp, Homo sapiens
ataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataac

SEQ ID NO: 6937 - DNA, 438 bp, Homo sapiens
  misc_feature 1: n = A,T,C or G
naattggaaaaaagccaaaaacacaaacacaagaaaaagaagtcaaagaagaacaaagataaagagaaggagaaggagaaagatgaccaaaaagtgaaatctgtcactgtgtaaaaagacagattttttaaattgacttaattactaagtcatctgtattaaattttgttataatgtaaagagattcaagccttgtaaataatgacatggaagaccctgtgctgcacttaaaatattgctgcttgattatttgatttttacatcagagctttataacacgaacttttgtacagaattgtgagttgtgaccatgtaacatgagaggttttgctagggcctattatttttaaccaccattaattagttggggtgggagtttacctgtaatgtgaaattttcacatttgaattttttaattgcctggcaaaagctgatata

SEQ ID NO: 6938 - DNA, 167 bp, Homo sapiens
  misc_feature 24, 70, 160: n = A,T,C or G
ctgtgtttatcttttttttttganatggagtctcgctctgtcgcccaggctggagtgcagtggtgccatntcggctcactgcaagctccacctcctgggttcacgccattctcctgcctcagcctcccaagtagctgggactacaggcgcccgccaccangcccgac

SEQ ID NO: 6939 - DNA, 437 bp, Homo sapiens
  misc_feature 368: n = A,T,C or G
gtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggcttttgtgttcaccaaggaggacctcactgagatcagggacatgttgctggccaataangtgccagctgctgcccgtgctggtgccattgccccatgtgaagtcactgtgccagcccagaacactggt

SEQ ID NO: 6940 - DNA, 112 bp, Homo sapiens
gagtacttctagagcggccgcgggcccatcgattttccacccgggtggggtaccaggtaagtgtacccaattcgccctatagtgagtcgtattacaattcactggggcccgg

SEQ ID NO: 6941 - DNA, 443 bp, Homo sapiens
  misc_feature 11: n = A,T,C or G
gtgtattaagncaatattagaatgagggggattccaggaacctaaaagatactcattttcataagaggaagtatggtgaatagctaactggaatttagtgttctaagaataattttgttaaatttacctttaaaaatatctgagggagttactagattatatatctagtttatgtatatggaaaaaaatgttatggccagccattaacagtgatgccaaggaaaacaatttatttcccagcttttgaatttgaaacttaacagatggagagtgtcaaaatggaagggcagtggtaccctgctttccctattcagagggaaaaaaatccttgacccgcagttgagctgatgatctctgccacagtcattgtgaattctaatcaatatttcatcattgctgtcaaatgatagcctgttactaatgaaacaacattctgtcccagc

SEQ ID NO: 6942 - DNA, 440 bp, Homo sapiens
atttcctaggccccaggcatgggagtaatttgtctcacaggtgtggttgcctgggcaagtgcaaacatagccatgtttgaaatgagcagtttccattggtagcccacacatgattcctttttaagcaacacttgggcccaggttgtcttgtaaaatgtctttcaaaatcacttgtccattcatataaaaatatgtattgcacaaagagaagatcagctggacaacaggaatacaatggtgatcttgctctcacagaacttaccttctagaggagagaataaaaaacaagcaagtaaatatattagtaaacatgatagtgtaagtaccgtgagggcaattacactttccaggcaaacactgaatgaagggagtaaaaactactggatcttttggaatatatgataaaacttttccaagttaggaaaagtctatgggactca

SEQ ID NO: 6943 - DNA, 419 bp, Homo sapiens
cctagacctttggaaggtgagagcagggccctgagaaaaggcagccacctcctctccctggctgaacccctgccaccctactcctcaccagaattgtcagtggcctttcaccacagtggtccttcctgcctgagccctgcactgtcccagaccacacagaagtctggtcacctctgggcgcctgggatggtcaccgaagagaagcacgctgtccccgtctctcctggcttctgccagaaaatcgaacaagtgcaattaacacactgttactgccgaagcctgaaactcccaggacttgtccttgatccttccagaaaccaccaggtccggcacttggagccccccggagagggacctcccagccgagccctcaaagaactccatgaaatcaggaactgcttgatgaaatgtatctcctt

SEQ ID NO: 6944 - DNA, 275 bp, Homo sapiens
caccaacagagagaggcaccctggatcttttgacgtggttcacgtgaaagatgccaatggcaacagctttgccactcgactttccaacatttttgttattggcaagggcaacaaaccatggatttctcttccccgaggaaagggtatccgcctcaccattgctgaagagagagacaaaagactggcggccaaacagagcagtgggtgaaatgggtccctgggtgacatgtcagatctttgtacgtaattaaaaatattgtggcaggattaatagc

SEQ ID NO: 6945 - DNA, 431 bp, Homo sapiens
  misc_feature 11: n = A,T,C or G
aaaatcttaanggcaatcagagaagaatacacattatatacaaaacagacaatggaaggatcacagacttcatttcacctccaactttgcaagcctgaagacaatgaaataacatctttagagtgctcaaagaaaaaggcagccttgaattctatatttaatgaaaacatcttcaaaaacaaagatgaaataaagtttatcagacataacttgagggaatttgttgtcggcagatatatgcaacaagaaatgtttaaaggaaattattcaggccaaagcaaaatgataccagatggaaacttgaaagacactatttcagaagtagtaaatatgtggacaaatagaaaagactttgtgtccttatttttaaatttcttggaaagctaattgactgcatgaagcaaaaatagtaacaatgtatttttgagata

SEQ ID NO: 6946 - DNA, 360 bp, Homo sapiens
  misc_feature 170: n = A,T,C or G
aaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcantgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggaaaaaaacc

SEQ ID NO: 6947 - DNA, 436 bp, Homo sapiens
gacagcagtcggttggagcgagcatcccccaaagttcacaatgtggccgaggactttgattgcacattgttgtttttttaatagtcattccaaatatgagatgcgttgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacaccttaaaaat

SEQ ID NO: 6948 - DNA, 222 bp, Homo sapiens
  misc_feature 1, 217: n = A,T,C or G
natcaattaatttagcatagaaaaaaattatgtgcttttttttcttctttgtaagtctgtgagttattgaggacatgccttatatgtgagacctctttgttttcagaccaatgttccattttgtgcctcagtaaatcagaggatactcacattcaaactggttccagaaaaaaaaaaaggttaatttattgtttcacataactgaaaagtagagaanccaat

SEQ ID NO: 6949 - DNA, 128 bp, Homo sapiens
  misc_feature 54: n = A,T,C or G
gttgggagccccctgatgggcttgtctgtgtttgcaccttgtcctgtgtctgangtcctgtgactgtaccctcctttgccctgggacatctgtatctcttggctttgtaataaatgctgcatactttc

SEQ ID NO: 6950 - DNA, 221 bp, Homo sapiens
ggaaatcaagattatgtgactgaaaaacataaaggaagagacccatctagataacagcaatcaacctgcttaattctgaatgacaattatatccacaaatttttaaaacttctacatgtatttttcacatgaagatctccttaacaggttgccaaccttttcttttataaaactattacatttaaaatattggacgtctgaaaaataaaatattcatcatt

SEQ ID NO: 6951 - DNA, 426 bp, Homo sapiens
ctcaaccacaccatcaactgacaggatctaattggcattcatagcacaatctgtccaacaacagcagaatacacatttttttaaaggtcccatgagacatttaccaagatagagcatatcctagatcataaaacaaacattaaaaagttcaagagaattgaaattatacagactatgttacctggccataataaaatcaaagtagaaatcaaggcagaaagtcaataggcaaatctccaaacccttggaaactaaacaaaaaacatttaaataatccatgcgtcaaagtggtaatctcaaaggaaattttaaaaagacaagaaaagaatgaacatgaaaatatgacatgttaaaattttgtaagattagctaaagcagtgctgagaataaaattgataggagtaaatgcttacattagaaaagagg

SEQ ID NO: 6952 - DNA, 404 bp, Homo sapiens
  misc_feature 368: n = A,T,C or G
aacaccttggcccagcccacggtgtggctgaccattgtgctcaccacagtcgtctgcatcatgcccgtggttgccttccgattcctcaggctcaacctgaagccggatctctccgacacggtccgctacacacagctcgtgaggaagaagcagaaggcccagcaccgctgcatgcggcgggttggccgcactggctcccggcgctccggctatgccttctcccatcaggagggcttcggggagctcatcatgtctggcaagaacatgcggctgagctctctcgcgctctccagcttcaccacccgctccagctccagctggattgagagcctgcgcaggaagaagagtgacagtgccagtagccccantggcggtgccgacaagcccctcaagggctgaaggcc

SEQ ID NO: 6953 - DNA, 180 bp, Homo sapiens
atcagatccttgccccaccccttgcttccagaaagggttttaaagcccatgccccaactctgccagcccccacctgccaggacgttctagcaggacatcggtgctttgctgtccatcttcccatgctgcaatttcttcctgagatttctataaatataaaatgtatgtatgtattatatt

SEQ ID NO: 6954 - DNA, 375 bp, Homo sapiens
  misc_feature 14, 374: n = A,T,C or G
ctcacctgtgagancaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggaagactctggtcaagaagcatcgtgtctggcgttgtggggatgaactttttgttttgtttcttccttttttagttcttcaaagatagggagggaagggggaacatgagcctttgttgctatcaatccaagaacttatttgtacatttttttttcaataaaacttttccaatgnc

SEQ ID NO: 6955 - DNA, 466 bp, Homo sapiens
  misc_feature 8, 169: n = A,T,C or G
gtgacctngagggggacaccaccctcaagagcctgagccagcagatcgagaacatccggagcccagagggcagccgcaagaaccccgcccgcacctgccgtgacctcaagatgtgccactctgactggaagagtggagagtactggattgaccccaaccaaggctgcancctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccagttcgagtatggcggccagggctccgaccctgccgatgtggccatccagctgaccttcctgcgcctgatgtccaccgaggcctcccagaacatcacctaccactgcaagaacagcgtggcctacatggaccagcagactgg

SEQ ID NO: 6956 - DNA, 427 bp, Homo sapiens
  misc_feature 275: n = A,T,C or G
ctatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctganaacttcaagctcctgggaaatgtgctggtgaccgttttggcaatccatttcggcaaagaattcacccctgaggtgcaggcttcctggcagaagatggtgacctgggagtggccagtgccctgtcctccagataccactgagctcactgccca

SEQ ID NO: 6957 - DNA, 299 bp, Homo sapiens
cccaggctttgttggtacaattctaattgatcagctgagtctctgtagtaatgctccatttcttggtcatatgtatattttgaggaataacaagtgttttaaagctcaaaataacagttatgctaacatatactataagctgcattctttaatccatatatagggaaagaaaaacctagattgttaatccggaacatttacattcttaaacatagtaaattgtctactgtacttaactatgttaaatacttttaaatggcctagagcttcatctttttatctaataaaaatgaataaat

SEQ ID NO: 6958 - DNA, 293 bp, Homo sapiens
  misc_feature 101, 133, 150, 170, 284: n = A,T,C or G
ctcgtgccgtgagagaccattgtctcgttggctggcgctcacggacatgcagtcacggtagcgggagcaatcacaaaactgtaatttacttaccaaatctnttcctttccgtagcctcgcctgcctgacttanagaaagaaaagcaatanttttacaggcattttgaggngtctctttgggttctttctgtttgaaaggatatttgtcgaaaaaaagagcaaaaccgttttaaataaactccccctggaaaaaaacccaaaacactggcatctgagtaggaatntgaaaatga

SEQ ID NO: 6959 - DNA, 497 bp, Homo sapiens
  misc_feature 16, 23, 39, 52, 58, 61, 64, 137, 153, 175, 250, 251, 310,312, 334, 356, 402, 425, 430, 447, 482: n = A,T,C or G
tcgtattacaattaantgggcgnctagtggatccaaagngcgggccgaccangcagcnggnggnctgagacagcatgacgcctgaggtggatgccacactcaagtccctcaacaaccagattgagagcatccgcagnacccgagggctcccgnaagaaccctgctggcacctgcngagacctgaaactctgccaccctgagtggaagagtggagactactggattgaccccaaccaaggctgcaccttgnncgccatgaaggttttctgcaacatggagactggcgagacttgcgtctaccccaatccancnaacgttcccaagaagaactggnggagcagcaagagcaaggagangaaacacatctggtttggagaaaccatcaatggtggcttccatttnagctatggagatgacaatctggntcccnacactgccaacgtgcanatgaccttcctacgcctgctgtccacggaaggctnccagaacatcaccta

SEQ ID NO: 6960 - DNA, 249 bp, Homo sapiens
cttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatga

SEQ ID NO: 6961 - DNA, 444 bp, Homo sapiens
  misc_feature 13: n = A,T,C or G
ccgagcaggaggngccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcacttgtcctgctctccggtc

SEQ ID NO: 6962 - DNA, 445 bp, Homo sapiens
  misc_feature 9, 12: n = A,T,C or G
attggaccntgnagaatgttgcaatattgtttacagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctt

SEQ ID NO: 6963 - DNA, 443 bp, Homo sapiens
  misc_feature 10: n = A,T,C or G
caccaatgcnatgctggggaaaaagacagtggtttcagagttctatgatgaaatgatatttcaagacccaacagcaatgatgcaacaattattgacaacatctcgtcagctaacattaggagcctataagcatgaaacagaataatcaagaatgattgagaataggaacggctcaagacgttcacaactaaggccatgaatagctaggaattccctttaagagcaaaggttttatcatcagacagacctacttgcaggcacttctgtgagaactgagccattacaccagccttggaagccagaggcagctggatccttcaggcctggcatctcccaggcccgcggtcctacctcagtggaggaagagtgggaactgctgtgcattccaacttcagttccctgtgtgtgccgctgccaccatcgctcacctgcaaactgcttca

SEQ ID NO: 6964 - DNA, 444 bp, Homo sapiens
  misc_feature 1, 13, 14, 15, 16: n = A,T,C or G
naccaaaataaannnngaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaagttgtcctcttcttcagattcagcatttgttctttgccagtctcattttcatcttctt

SEQ ID NO: 6965 - DNA, 461 bp, Homo sapiens
  misc_feature 7, 9, 12, 13, 15: n = A,T,C or G
aaaaaantnganngnggttttcatccacttcttcccaggtaaatccccagtgtagttagggtcaccattcttcttttgctagtctctgacctaatccagggctcggacaaggacctgcaggacaaacctggcccactgcctgttttgtaaatagagtgtcactggaacacagccaggctcatttttttatgcatcgtctgtggctgcttttgcactactatgagagttgaatagttgcaacagagactgtatagcccataaatcctaaaatatttacttttctatcctttacagaataagtttcctgactcctgataatccacaggacttggctctcctcagccatgaggaggagaggaggagagagaacgggttgtcggggggaaaacttggagtgtgaggtgatcaagccacttaagtccccaggttagtttttccttgagcctggatgcagtacaaag

SEQ ID NO: 6966 - DNA, 445 bp, Homo sapiens
  misc_feature 10, 13, 165, 166: n = A,T,C or G
cgaagatggnggnggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagnncctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctg

SEQ ID NO: 6967 - DNA, 234 bp, Homo sapiens
gaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttcttt

SEQ ID NO: 6968 - DNA, 446 bp, Homo sapiens
  misc_feature 13: n = A,T,C or G
gttcggactattngtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgat

SEQ ID NO: 6969 - DNA, 446 bp, Homo sapiens
  misc_feature 11: n = A,T,C or G
ccctggtgctnttggtttgaggggacctaaaggtgacttgggagaaaagggggagcgtggccctccaggaagaggtcccaacggtttgcctggagctataggtctcccaggtgacccaggccctgccagctatggcagaaatggccgagacggtgagcgaggccccccaggggtggcaggaattcctggagtgcctggacccccgggacctcctgggcttcccggtttctgtgagccagcctcctgcaccatgcaggctggtcagcgagcatttaacaaagggcctgacccttgaaaggcttactgctgcatggctgtctgcatgaaccacgcctggtgaaggagccttgggtgagaaacaccatccaaagctggggcaaagatgattaccttcagcatgattacaatgtattaccttcagtatgattaccagaagtcctacttga

SEQ ID NO: 6970 - DNA, 367 bp, Homo sapiens
ggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagag

SEQ ID NO: 6971 - DNA, 310 bp, Homo sapiens
ccccactacattcaatggaattggtgcttaaaatctcatcgatgtgctgtctctggagtgataagaaagggctacatctcccgaaatgatttctttacgtcatgtattggtttccttcttcaccttgaacttttgttgaactgtatgtactttaccccaaacctgttaatattttgagcgcttctatgtgaaagcaaagaaataattttaatactctggcattcataaattttattgatgagattatttattttaaaggtttgaggtaacatctctggttgtaccaaagaagaaataaatatggtttctt

SEQ ID NO: 6972 - DNA, 434 bp, Homo sapiens
tatgtagtattttaaaatgagttaaaatagatttaggaatattgaattaattttttaagtgtgtagatgcttttttctttgttgtttaaatataaacagaagtgtaccttttataataaaaaaaagaagttgagtaaaaaaaaacacacaaacctgttagtttcaaaaatgacattgcttgcttaaaggttctgaagtaaaggcttgttaagtttctcttagttttgatttgaggcatcccgtaaagttgtagttgcagaatcccaaactaggctacatttcaaaattcagggctgtttaagatttaaaatcacaaacattaacggcagtaggcaccaccatgtaaaagtgagctcagacgtctctaaaaaatgtttcctttataaaagcacatggcggttgaatcttaaggttaaattttaatatgaaagatc

SEQ ID NO: 6973 - DNA, 447 bp, Homo sapiens
ctcaggtgagccctctctatagtgcttccctgggccaagctgacaccagcccctgagggtggggtgggacgggtggtgcttaaaagaggaaggggaccagtgtagcaacttgccagggaccccacccctccctctctgggcctgtgcagtgagcatggggattcccatcaaggggcctggcacctgtgctagttacgtagccgctgctcacgcgctcactcctgaccacatgcacgttccctagatgcagactgctttgaactttaaagctgtacaatttggttatgtttgtgctgacttaaaatatattttaatgaggaaaaaataatggagaaccctgggaaggacctggttcttttgcttctcggggaactgtaagccctcgcgttctgggaatcgctctctgctgctctttcctggaagctaagcctgtctccaccgcccgag

SEQ ID NO: 6974 - DNA, 426 bp, Homo sapiens
gctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaac

SEQ ID NO: 6975 - DNA, 364 bp, Homo sapiens
aacatgagcagaagaatcgttttatgctagttattgcattcatggttgaaactcaacttagggaaagggttccaatgtattaagcaatgggctgcttctccccaatcctccctaacaattcgttgtgtggacttctcatctaaaaggttagtggcttttgcttgggatcagtgctctctattgatgttcttgctggtctccagacacattcctgttgcattaagacttgaaagacttgtagatgtgtgatgttcaggcacaggatgctgaaagctatgttactattcttagtttgtaaattgtccttttgataccatcatcttgttttctttttgtaggtataaataaaaacactgttgacaat

SEQ ID NO: 6976 - DNA, 308 bp, Homo sapiens
ctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattg

SEQ ID NO: 6977 - DNA, 388 bp, Homo sapiens
  misc_feature 7, 12, 13, 15, 181, 352: n = A,T,C or G
acgacgngcggnnanggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtntcttttgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccantcggcccctcacagcccttgcccgcttcgggtatga

SEQ ID NO: 6978 - DNA, 435 bp, Homo sapiens
  misc_feature 331: n = A,T,C or G
acatggatcaggatagaccccctgagtaagctcatgccacagtgggaggaacctccccttcaggggagtctgggctgggctctgggcccaggcactgccctgggggtcatgaggccattccagcatctagctcagtgtgaggcactgttctaagtgcagggaaccacagtatggggtcaggttcatgtcctgtttctgcctaagttaactcccaggcaacctctccctgaaacacttcctctcccaaagagggccttagaatccatgaagctcctaggccaggcccacctgtgatcctgtaaacttttctctcagaaaagccccatctcangctaggcatggtggctcacgcctataatcccagcactttggaggtcaaaggtgggcagatcacctgaggtccgggaagttcgagaccagcctgaccaacatggt

SEQ ID NO: 6979 - DNA, 372 bp, Homo sapiens
  misc_feature 7, 11, 12, 370: n = A,T,C or G
gctgtgnaganngaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtcttggaggagaaaaagacagaacaaagatggaagtggcctgggcccctggggggggggncc

SEQ ID NO: 6980 - DNA, 365 bp, Homo sapiens
  misc_feature 9, 12, 14, 167, 168, 171: n = A,T,C or G
ggcatgggntgngntatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctnngtngattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaag

SEQ ID NO: 6981 - DNA, 410 bp, Homo sapiens
  misc_feature 8, 11, 15, 169: n = A,T,C or G
ctcacttnatncggngactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggngtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaaggggaagcaaagaaagaagaatcccgaggagtctgatgatgacatgggctttggtcttttttgactaaac

SEQ ID NO: 6982 - DNA, 274 bp, Homo sapiens
  misc_feature 118, 126, 164, 187, 189, 202, 229, 245: n = A,T,C or G
gcaggctcaatgaatcgaatgaatgtgaacttcttcatctgtgaaaaatcttttttttttccattttgttctgtttgggggcttctgttttgtttggcgagagagcgatggctgccgnggggagtnctggggagccctcgcggcaagcagggtgggggggactngggggcatgccgggccctcactntntcgcctgttctgngtctcacatgctttttctttcaaaatngggatccttccatgtngagccagccagagaagatagcgagatcta

SEQ ID NO: 6983 - DNA, 436 bp, Homo sapiens
  misc_feature 160, 166: n = A,T,C or G
gaaccactgtgtcatagggcatgcatacctaaagtattgacatataccactaagttcttttcagaaagggctctgccaattttcagttccaccaacagtaggtatacacatagatggttggtattattagcgagaataaccatcctcacaaactctgatngctagngatttttaaggtattttcttaagtgataagcaaaaaaaatttttttggcaaaaaatattttattaatggttgtgacctctatttccttcgtttttaatgagattaaaatcttttcatatatttattggacttttttcttcaacttctgtaaattgctgttatcttttgttcaattttctattgattgtttttatttttcttattgacttgttttatatatatgtatacacacacacacacacacgtatatgtatataatgattaaaattc

SEQ ID NO: 6984 - DNA, 403 bp, Homo sapiens
ctggatacctaatgtcagtggagtcttctgagtgtttcctggaagaagtcgggtcccaggctctagttgctggttcttacatgccaccatccacagtccttcagcagattgattcagtggctaatgctgatatcataaatgcagcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaacattctgtttaagtg

SEQ ID NO: 6985 - DNA, 102 bp, Homo sapiens
  misc_feature 9: n = A,T,C or G
agaactagnctcgagtttttttttgacgtattttatttacaaatatcatacactgctggtgttaccatatgaaaggaaataaagtcaattgataattgcctc

SEQ ID NO: 6986 - DNA, 394 bp, Homo sapiens
cggagccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttt

SEQ ID NO: 6987 - DNA, 410 bp, Homo sapiens
tgcttcgcctcagtttgaacattgaccctgatgcaaaggtggaagaagagcccgaagaagaacctgaagagacagcagaagacacaacagaagacacagagcaagacgaagatgaagaaatggatgtgggaacagatgaagaagaagaaacagcaaaggaatctacagctgaaaaagatgaattgtaaattatactctcaccatttggatcctgtgtggagagggaatgtgaaatttacatcatttctttttgggagagacttgttttggatgccccctaatccccttctcccctgcactgtaaaatgtgggattatgggtcacaggaaaaagtgggttttttagttgaattttttttaacattcctcatgaatgtaaatttgtactatttaactgactattcttgatgt

SEQ ID NO: 6988 - DNA, 458 bp, Homo sapiens
  misc_feature 56, 214: n = A,T,C or G
tccctgtccttcatgggcctgctggccatgtacacctacttccaggccaagataanggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcangaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactgg

SEQ ID NO: 6989 - DNA, 114 bp, Homo sapiens
gctgagggtgcccaccaagcccaccttccagaaacttggagaaatgggggttgggaacttatgcagacatggatttatttttcaacattttttaaaaattaaaaaaaataaaat

SEQ ID NO: 6990 - DNA, 442 bp, Homo sapiens
  misc_feature 12, 15: n = A,T,C or G
gaaggagtaggnggngggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggggggtgtcattccacacatccacaaatctctgattg

SEQ ID NO: 6991 - DNA, 108 bp, Homo sapiens
aaacaactaacctgccactaatagttatgtcatccctcttattaatcatcatcctagccctaagtctggcctatgagtgactacaaaaaggattagactgaaccgaat

SEQ ID NO: 6992 - DNA, 441 bp, Homo sapiens
  misc_feature 169: n = A,T,C or G
gcaaaggagaaattcagttttcagtagcatcattggaagtattatgacttgtgcttaaacttttaccagtgcattcttttgataaatagaaatagtaacaaaatatgaattttaaatatgtggggagatacataaagaacattgcttatttgttcttgaaaataacagngattcaaatatttcattcagatttacctatgcctaatgaaaaaaatgatgcagaacttgattctccaccttcaaagaaaaaaagattaggttttttccagacttatgatacagaatatttaaaagttggttttattatctgtcctggatcaaaagaaagttcaccaaggccacagtgtgtcatttgtggagagatcttatccagtgaaaacatgaagccagcaaatctttctcatcatttgaagacaaaacattcagaattagaaaacaaac

SEQ ID NO: 6993 - DNA, 444 bp, Homo sapiens
  misc_feature 398: n = A,T,C or G
gcagcgcggaggccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtgggaaaaggaccaagatggcggccgcaaactgacacctcanggacaaagagatctggacagaatcgccggacaggtggcagctgcca

SEQ ID NO: 6994 - DNA, 225 bp, Homo sapiens
ctcagctcaccgcaacctctgcctcccgggttcaagcaattctgcctcagcctcccgagtagctgggattacaggcatggtggcacacacctgtagtcccagctacttgggaaattgaggcaggaggatcacttgagtcctggaggtcaaggctgcagtaagccgtgatcgtgtcactgaactccagcctgggtgacagagcgagaccctgcctttcaaacaaac

SEQ ID NO: 6995 - DNA, 433 bp, Homo sapiens
  misc_feature 8, 11: n = A,T,C or G
ctcatgtnagntggaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttga

SEQ ID NO: 6996 - DNA, 463 bp, Homo sapiens
  misc_feature 10, 11, 13: n = A,T,C or G
gtcaacttgnngncaggagatgaagttcatacactggacttctgggggttggtctcatttgttttaggacaaaacatattatctatcgtaccaagagttcgatagctatctgctttcaaaggtaaatacatttgatcagaaaactccctgctaaaattgcagtttctaagctgcccttgttatactttttcttcctctgaggatactttaaacactcatttcagattcactaggactgtggctgttctttagcttctactttatgtatttatctaagctcgggtattttcatcttccccataagtagttcatccatagcagaactggccgtgttgctgatggttaatatccttttttgttttccctttaaagtaacacacactgagccctgagtaagagccgggctctgtgataagcactttgcaggtgtgagaacacttcattcttaaaacaactgtaggca

SEQ ID NO: 6997 - DNA, 109 bp, Homo sapiens
  misc_feature 1, 11, 13: n = A,T,C or G
nattaccttcngngtgattacagaagtcctacttgacaatcacatatagaagaacggtgctattcagtaagttctctttcctttcccttggagggaagacagcagagtc

SEQ ID NO: 6998 - DNA, 234 bp, Homo sapiens
catagggccgggctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctattt

SEQ ID NO: 6999 - DNA, 212 bp, Homo sapiens
ctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagtttgaaagaccagtagacgctcctctactctttgagacatcactggcctataataaatgggttaatttat

SEQ ID NO: 7000 - DNA, 446 bp, Homo sapiens
gaacatttctgttttaaatttcattttaaaatattttattatctgcaattcaccactgctctgggaaagcaaaaggaaagttcctgttgtgtgtgaagagcctcttaggctataaggcttcccagccatagtcagctatagctattcagagacagcaggttcttccagtctttgttcctgggacctgatgttttgagcaactcaggtcactgataaagtggaaggactaagacactgtggtcacagatcccagcaacatcaactcacactcaatccatgtggtggtccacattctgctactcttatccacccatgtggtcattgagagcctttctcagagactcttctgtgtgtttgattgtgcccaggtggcccagggctagctggctctaacaactagcatgacagcctccaatcagaaaggcaggtaaggggacagggtgagg

SEQ ID NO: 7001 - DNA, 434 bp, Homo sapiens
  misc_feature 9, 11: n = A,T,C or G
actactggntngaccccaaccaaggctgcaccttggacgccatgaaggttttctgcaacatggagactggcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacat

SEQ ID NO: 7002 - DNA, 437 bp, Homo sapiens
ctggtgttatcaccgtgggctccctgactgggagttgatcgcctttcccaggtgctacacccttttccagctggatgagaatttgagtgctctgatccctctacagagcttccctgactcattctgaaggagccccattcctgggaaatattccctagaaacttccaaatcccctaagcagaccactgataaaaccatgtagaaaatttgttattttgcaacctcgctggactctcagtctctgagcagtgaatgattcagtgttaaatgtgatgaatactgtattttgtattgtttcaattgcatctcccagataatgtgaaaatggtccaggagaaggccaattcctatacgcagcgtgctttaaaaaataaataagaaacaactctttgagaaacaacaatttctactttgaagtcataccaatgaaaaaatgt

SEQ ID NO: 7003 - DNA, 445 bp, Homo sapiens
  misc_feature 11: n = A,T,C or G
ctcaagttcgnctcgaccatggtccacgccctcaacaccatcctgctgacctccacagagctcttccagctaaggaaccagctgaaggacctgaagaccctggagagccagaacctgttctgctgcctgtaccgctcctggtgccacaacccagtcaccacggtgtccctctgcttcctcacccagaactaccggcacgcctatgacctcatccagaagtttggggaccttggaggtcaccgtggacttcctcgcagaggtggacaagctggtgcagctgattgagtgccccatcttcacatatctgcgcctgcagctgctggacgtgaagaacaacccctacctgatcaaggccctctacggcctgctcatgctcctgcctcagagcagcgccttccagctgctctcgcaccggctccagtgcgtgcccaaccctgagctgctg

SEQ ID NO: 7004 - DNA, 220 bp, Homo sapiens
caaacatccacaagcatcaagacctcccaggaaaatataagctgaacaaatgaactaaataaggcactagggactaatcctggagaaacagagatatatgaccctttcagacagagaatacagaattgctgttttgaggaaatttaaagaaattcaagacaacccaggagagaaattcagaattctatcatataaatttaacaaaaagattaaaataatt

SEQ ID NO: 7005 - DNA, 343 bp, Homo sapiens
  misc_feature 12, 87, 100, 147, 155, 170, 279, 293, 317, 322: n = A,T,C or G
cagacttgcagnttaagtattggaatttcacaaaagacataggacttaactggaaaatgaaaaaaaaaagaaaaagaaaaaactaancaaaaaatccctntaggtagtttaggtgaaaaatgtcccttttattttggctttggttgngatttcanagcataatgctatgnttttttgtctttttactatgtttttcggatttttaagtccgtaagtgcatacagttttctctaatttttaaaccctttcctcctcccattttgacatttgcacttgganaacacttgagttgngaaggttttgggcatccaccccanaaagngggaatttgattttatccttc

SEQ ID NO: 7006 - DNA, 423 bp, Homo sapiens
  misc_feature 15, 316, 414: n = A,T,C or G
ggaataaggatggtntagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaacaaaaaaagaaaaatatatattcataaaaaatatggtgctcattctcatccatccaggatgtactaaaacagtgtgtttaataaattgtaattattttgtgtacagntctatactgttatctgtgtccatttccaaaacttgcacgtgtccctgaattccatctgactctaattttatgagaattgcagaactctgatggcaatnaatatatgt

SEQ ID NO: 7007 - DNA, 404 bp, Homo sapiens
  misc_feature 3, 4, 5, 159, 162: n = A,T,C or G
tannngaagaggtaacacggatggccaataaatgtgaaatgatgctcaacatcattaagaatcaccaaatgtagttaatcaccaaatagtaatgaattgctatttcatacccacccaccacatcaaaaaaatttttcaagtctgataattacaggtgtnagnaaggatatgaaaccatatgaattcccatttacaacggatggaagcataattggtagaaccatttttgaaaaatagtttgacattatgtagcaaagttaaagataaactctaatcctttgtttttatgcttctaggaatactctcacgcatgtaccagcagaattgttggtaatagaagaaaaacacctgaaaaaacctaaacctaaatgtttgtcatgagtggaatgaataaatattacaat

SEQ ID NO: 7008 - DNA, 414 bp, Homo sapiens
  misc_feature 11, 14: n = A,T,C or G
gtcgtaagggntgnggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacgagaaaaactccttgtggtgaaggttctaagacgtgggatcgtttccagatgagaattcacaagcgactcattgacttgcacagtccttctgagattgttaagcagattacttcc

SEQ ID NO: 7009 - DNA, 224 bp, Homo sapiens
  misc_feature 11, 12, 169, 171: n = A,T,C or G
caattctttgnngcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagttngngaagtgattgacattttgtagctagtttaaaattattaaaaattatagactcc

SEQ ID NO: 7010 - DNA, 185 bp, Homo sapiens
gaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaat

SEQ ID NO: 7011 - DNA, 410 bp, Homo sapiens
  misc_feature 8, 13, 14: n = A,T,C or G
ctcacatncaganntattttcctacagtgcaaacacaccagatgaaactttaaaatgttactttttgtaagcttatcataaatgagttgcagtaatttgtttgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagttgaagttgaaacatgatgttttgcattaaatttaagatatgcaaat

SEQ ID NO: 7012 - DNA, 436 bp, Homo sapiens
  misc_feature 2, 3, 157: n = A,T,C or G
tnnggcacgagggcgggcgcccctcccccagcctcactgccgccttgcagtttgatctcagactgctgtgctagcaatcagcgagattccgttggcgtaggaccctccgagccaggtgtgggatataatctcgtggtgcgccgttttttaagccggnctggaaagggcaatattcgggtgggagtgacccgattttccaggtgcgtccgtcaccgctttctttgactgggaaagggaactccctgaccccttgcgcttcccaagtgaggcaatgcctcgccctgcttcggctcgcgcacggtgcgcgcacccactggcctgcacccactgtctggcactccctagtgagatgaacccggtacctcagatagaaatgcagaaatcacccgtcttctgcgtcgctcatgctgggagctgtagaccggagctgttccta

SEQ ID NO: 7013 - DNA, 445 bp, Homo sapiens
  misc_feature 11: n = A,T,C or G
gccatcctcgnggctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccc

SEQ ID NO: 7014 - DNA, 231 bp, Homo sapiens
  misc_feature 169, 215: n = A,T,C or G
gaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgnacacaactcactccttttaaagaaaaaaattgaaatgtaaggctgngtaagatttgttttta

SEQ ID NO: 7015 - DNA, 104 bp, Homo sapiens
gtaagggtaaaggagcagaggcaaaggagaaaagcagaagttgcagctgatgcaggtatcctatgcccttgatggatgagactaaaataaaatttttgaagtta

SEQ ID NO: 7016 - DNA, 445 bp, Homo sapiens
ggatgatcgcacagactgtcactgctgttgccgggttgacttcctatccatttgacactgttcgccgccgcatgatgatgcagtcagggcgcaaaggaactgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatggga

SEQ ID NO: 7017 - DNA, 443 bp, Homo sapiens
gtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgac

SEQ ID NO: 7018 - DNA, 443 bp, Homo sapiens
  misc_feature 13, 171: n = A,T,C or G
gccagcagctagncatgaaggcccctgccgccatccctggatggctcagcttagccttctactttttcctatagagttagttgttctccatggctggagagttcagctgtgtgtgcatagtaaagcaggagatccccgtcagtttatgcctcttttgcagttgcaaactgnggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgattggtcagaatgtgtggcaattctgatctgcattttcagaagaggacaatcaattgaaactaagtaggggggtttcttctttttggc

SEQ ID NO: 7019 - DNA, 422 bp, Homo sapiens
  misc_feature 169: n = A,T,C or G
ctgcccctgagctggaggggggtctcattctacaaagagagaggtggcccccctttcttgacctcctcctccttcaagctcaaacaccacctcccttattcaggaccggcacttcttaatgtttgtggctttctctccagcctctcttaggaggggtaatggtggagtnggcatcttgtaactctcctttctcctttcttcccctttctctgcccgcctttcccatcctgctgtagacttcttgattgtcagtctgtgtcacatccagtgattgttttggtttctgttccctttctgactgcccaaggggctcagaaccccagcaatcccttcctttcactaccttcttttttgggggtagttggaagggactgaaattgtggggggaaggtaggaggcacatcaataaagaggaaaccacc

SEQ ID NO: 7020 - DNA, 103 bp, Homo sapiens
gtacctattaagacaaaatacttctaaagatacttatgaaatgtatacatattttttcttgcacgttacaaagaaaatactcaattgcataacacggatgttt

SEQ ID NO: 7021 - DNA, 132 bp, Homo sapiens
gtgactcaagactcgaggccgatacgaggctgtgattctgcctttggatggatgttgctgtacacagatgctacagacttgtactaacacaccgtaatttggcatttgtttaacctcatttataaaagcttc

SEQ ID NO: 7022 - DNA, 391 bp, Homo sapiens
  misc_feature 9, 167: n = A,T,C or G
attgatggnggcctggattagcaaagaggaagacagcttttaacacagttccctgccttcacaagaggtgtcagattaagatgtgaaagctgcaagaatgttgcagtgaacaccatttcagagctctcagtgtgcagttcaggaattaagatacttggaatagctgnggaggaagaacctaaattgcaaagatctgctattgccagctctcaacccaagtcagtgaattgtcaacctgcatatcctaaaaatgtcaaaatgctgcatctggttaaatgtcggggtaggggggaagctgaaggtgctcgcttcatttgccttgtttactcatcctgccctgtaatgtctgtaatcctgaagatggaataaattgtaacatttagtttctttc

SEQ ID NO: 7023 - DNA, 179 bp, Homo sapiens
  misc_feature 2: n = A,T,C or G
gngaaggccaaggacggcactcaagaattgtcctgtctctaaaaaaaaagcatctgcaacgaacttcctttaatttttgagttcagtgtctgtgataattaagaaatggcaataccatgtattttccccagaagttaagaaatattgctgaacgaaccaataaaaataattacagctcc

SEQ ID NO: 7024 - DNA, 425 bp, Homo sapiens
  misc_feature 402: n = A,T,C or G
gccgagtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaangactatggcaaggagtctcaagc

SEQ ID NO: 7025 - DNA, 443 bp, Homo sapiens
  misc_feature 10: n = A,T,C or G
acggggaagnggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaaggatttcttagagagacgcctgcagacccaggtcttcaagctgggcttggccaagtccatccaccacgctcgcgtgctgatccgccagcgccatatcagggtccgcaagcaggtg

SEQ ID NO: 7026 - DNA, 442 bp, Homo sapiens
  misc_feature 12, 13: n = A,T,C or G
caagtttttagnngcttatatcctataattgagcacatgatagttacagcagaatttaacaatagatttttcataccttcataattctttgcgaccatgatggggtgtttattatattcccacataaagcttctctccttgtcagtcttatagtctagttcacatattatattacccgtgagtaccacctaatcacattctacactagttatatgtagaataaactgtattctatatgttaagattttaattagtaaattgttggaaataaacctgcttttctcttcaaattgcaggctttctaattaaaaacactttttaggacatacagagtggaatggtagacattggagactccaaaaggtgggagagtagaagaggggcgagggatgagaaattacccactgagtacgatagacactcttcgggtgatggcttcacc

SEQ ID NO: 7027 - DNA, 334 bp, Homo sapiens
  misc_feature 14: n = A,T,C or G
gcgacccagcccgngagcgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagt

SEQ ID NO: 7028 - DNA, 352 bp, Homo sapiens
cagaagcgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataacctggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggttttaaaaaat

SEQ ID NO: 7029 - DNA, 448 bp, Homo sapiens
  misc_feature 6, 7, 10, 12, 32, 169, 171, 172: n = A,T,C or G
cagaannccngngaggcccttctcctggcagngcggggagggccccacaggtaacacccatgtagctgccatgctcaggacacgtgtgcccgggcaggccagaacccacacggtgggcagcggggactctgggtgatgggtagcccccattcaattcacggcagctggngnnacagttaaaagacacggaaaactggagcgccggcaccatcattttattataatttaaaatgtaattataaaaggctgatttgaatgtaaatatctctcttaaacacatgaaaggggattctaaatttaagaaccccaaatcagcaggtaaatatttcagctaaatgctcttcctgccatctgaaatgccagaatgaaggaaagggcgttccacggggcgggggggaaaaccgccctggttttagaaagccagaagcatcagggacgattccttcta

SEQ ID NO: 7030 - DNA, 180 bp, Homo sapiens
  misc_feature 13, 15, 170, 172: n = A,T,C or G
gtcttgtttaagngntaggaagttcctgtctcaagtattctggggcaaccaggaagaggagaatattagagtcatttggggcacgtaagtggccaagtactttaaaagtccctttgggggcatttttaaccacctaggctcattggataaatttgttttttttttaaacngngatactat

SEQ ID NO: 7031 - DNA, 439 bp, Homo sapiens
  misc_feature 167, 170: n = A,T,C or G
cggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggnggngctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagacatgaa

SEQ ID NO: 7032 - DNA, 444 bp, Homo sapiens
  misc_feature 13: n = A,T,C or G
ctcctgggccggntggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccatctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagga

SEQ ID NO: 7033 - DNA, 327 bp, Homo sapiens
cctacgcacacgaggaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 7034 - DNA, 433 bp, Homo sapiens
tacgtagttgtctttcgtaagttaaaatgataattgggccgaaacttactgccttacctaaaaggcagcgcagtcaggatattggtaggtcgggggcggctttggaaacccttaagtttacaagcatgcgcggacttgagtgctcattaggtcgccgggcgtccacgtgcagccctggaccctgaaccccggcgtgcgtgggccgtgggccctcggggaaaggttccgtgcactcggggactccggtgaagcctgttcagccgtctgtgtcatgtggccatcttgagtctactctgtcgctcttgtgccctagcaccccgagaactgtcagtttgagccagatggaagctgagctgaacacattacgatggatgatggaaacataagactatcaagaaatccaagtggtaatgggccgaagtttattcagcat

SEQ ID NO: 7035 - DNA, 122 bp, Homo sapiens
aagagattgagaaaattggtatatcatgcagataacatacaaaatctttttgtaacgtaaaaaatgcagttttattattgcttgtgcctcaactgtttaagtgaatattaaagggcttggag

SEQ ID NO: 7036 - DNA, 302 bp, Homo sapiens
ctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtc

SEQ ID NO: 7037 - DNA, 430 bp, Homo sapiens
atcttttcccaagtactggattttaaatctgtatgtatctgtttgatttttttttctaatatttcagttgagctgctgttttcttccatgcaatattgtatactcaattgtgtatagaagaagctggtgagagtgccctcctacataaataagcaattgcagtgttttgcatgcaaaatataaaaaatttaaattgtcctgattctattttgtaaatggagaaacaatcatatctttctaagcggtaatggaggaagactagtgctttgtgcattttgatatatttgagttcattttttccacaatgtcatacttttgacgcagttgggtttctcataagtatcctagttcatgtacatccgaatgctaaataatactgtgttttaagtttttgtgttgcaagaacaaatggaataaacttgaattgtgc

SEQ ID NO: 7038 - DNA, 361 bp, Homo sapiens
gctctaccttcatcccactgctacttatttctcttcgggcttctgtgatataaatctggctgcttcctggctcactctggttttggtttaggactcaagtagatgagttactgcttgcctacccgcttttcggcttcagcttccattctttttgtttttctcaatttatacctaaatgataatcattttagaaccttttttttcctattattttagtgtggctgtcagagggagcagagctaaatatgtgacttcagtgtttagtttttcaaagtaaagtggaatgttctttgcagaactgagaatttagacttttcagtttttccccatagtttgcatttgcctatctatatatagatag

SEQ ID NO: 7039 - DNA, 435 bp, Homo sapiens
  misc_feature 434: n = A,T,C or G
ggtaacaggttccaaaaatattatgaaagtagaagtgacacatcttgaaccatttgtatatggtgatcatgatttccacgaagttgtccatgtgtggcactaaaaataaaggaataactacgcaatagaagggctagataattgcaagttcacctttccctatcttgtaattccttcatgtgcataaaatatcactttccagttatataatgatttctcctgttacattatatgttttatgaagaattctgtaagtgaaagtggaaatagtttattcaaattggattaactatcagaagcaaatgtattggtaagttgagaagaatggctataccatagctaggttctaagaaagaacatattatgtatgtttaacaatgtctaccatgtctgtggaagagagaaatacctttttatatcttctacatggttgnt

SEQ ID NO: 7040 - DNA, 427 bp, Homo sapiens
gttttttaagcccattggaaaagggcagtattagggtgggagtgacccgattttccagttgccgtctgtcacccctttctttgactaggaaagggaactccctgaccccttgtgcttcccgaatgaggcaatgccttgccctgcttcagctcacgcacggtgcactgcacccactgtcctgcacccactgtctggcattccctagtgagatgaacccggtacctcagatggaaatgcagaaatcacccatcttctgtgtcgctcatgctgggagctgtagaccggagctgctcctattcggccatcttggctccaccgtatccttgttttaatagaagaaaactgtataatatcaatattgggaatggttaaatactgttttactcattatattgatattatacattcattagaagatgacttaatt

SEQ ID NO: 7041 - DNA, 301 bp, Homo sapiens
caaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttatt

SEQ ID NO: 7042 - DNA, 403 bp, Homo sapiens
cagaggccctggaggtctccaggggcctgcagaaggaaagaagggggccctgctacctgttcttgggcctcaggctctgcacagtcaagcagcccttgctttcggagctcctgtccaaaagtagggatgcggatcctgctggggccgccacggcctggctggtgggaaggccggcagcgggcggaggggatccagccacttccccctcttcttctgaagatcagaacattcagctctggagaacagtggttgcctgggggcttttgccactccttgtcccccgtgatctcccctcacactttgccatttgcttgtactgggacattgttctttccggccaaggtgccaccaccctgccccccctaagagacacatacagagtgggccccgggctggagaaaga

SEQ ID NO: 7043 - DNA, 102 bp, Homo sapiens
  misc_feature 47: n = A,T,C or G
ccaaggtcctgggcaggaccggttctcagggacagtgcacgcagggncgcgtggaattcatggacgacacgagccgatccatcatccgcaatgtaaaaggcc

SEQ ID NO: 7044 - DNA, 453 bp, Homo sapiens
  misc_feature 2, 443: n = A,T,C or G
gnaccgatgcaatcgaggaagggactctagatggccttgaccactctgattttcaggatacagacattccctttgaggtgccactcccagctaagcagcatgtaccggaggctgagagagaagaggttcgagactgggtgcttacagtctccatggaccagcggctggagcaggttctgcctcgggatgagcgtggcgcctacgaggcctccctagtggcagcgagcactggtgttcgagccctgccctgccttattacaggataccccattctgaggaacaaaattgaatttaagcggccagggaaggctgctaacaaggacaactggaataaattccttatggccatcaagacctcccacagcccagtgtgccaggacgtgctgaaattcatcagtcagtggtgtggagggctccccagcaccagcttttcctttcagtantcggtagagc

SEQ ID NO: 7045 - DNA, 132 bp, Homo sapiens
aaaaaatttgtcacaaaaactttgttgtcatagttaagttgattgtagatggtaattgaatatactcctttgaaaatatttcatcaagtatgtttcctgctcattgtgatacattaaaaaaaaaatatgagc

SEQ ID NO: 7046 - DNA, 327 bp, Homo sapiens
gaacattccagtgctggtgttggatgtcaatgatgatttttctgaggaagtaaccaaacaagaagacctcatgagagaggtaaacacctttgtaaagaatctgtaaccaataccatgatgttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcttgttttt

SEQ ID NO: 7047 - DNA, 445 bp, Homo sapiens
cccatgtgcactttgttccatggataaataaacactaggaacgcatttccaccctagatttcagcagaaatgctgaatgtaaaggaatatttgagtaaagtgagttgccgttcttgaagcccgtctcctaaggattctcccggtgtccgcgtagggatctcatgctatataggagggccctgccaggcaccgtctcctgtctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtg

SEQ ID NO: 7048 - DNA, 324 bp, Homo sapiens
  misc_feature 28, 40, 75, 121, 174, 218, 272: n = A,T,C or G
ggcacttcctggattttttttttatganaaaaatactgtntttaaaatgtaaaataaacttttaaaaagcaggcnctaatatatatttcttccagcctttgattacaaatttgtccttgcncatgttaagatgaattatctcctaaaaatatcattgttcttgggagcagtgtntgttactttacatagcagcggttcctgtcatgtgttcatgtcanaatatttttggttttaaactttcttattgcctttggctgttgattagtacagtncaagtgcgatttcaaaaagatcttgaaagtaatatatttaatcaattaaaat

SEQ ID NO: 7049 - DNA, 444 bp, Homo sapiens
cgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatggatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatg

SEQ ID NO: 7050 - DNA, 445 bp, Homo sapiens
  misc_feature 82, 91, 121, 130: n = A,T,C or G
aaaaggtaaaagtgaaaccgattatgcacagcgggccttgtgactcttgagtggattttatttttgcactccaggatgcagngaagacggnggaaggttcatcttcacaccgagggccctnagtgtcgangtgactcccggcctgaggagggctgaggcatcctgaattttgagagttcgaggttgaggtctaagaaggtgtacgtgctgtagtcatgatgctgcaggttcttgtaggtagtgttgtcaaacggctcagcaggcactggggctggctctgcggaggaaacacgatgcccatgagaccaacacaaggacagctctttatgaatgactcggctcacacacaggcgcttacctaccaagcattcttcatcatccctatctgtgaacagctctttatgaatgacttggctcacacacaggcgcttacctaccaagcatt

SEQ ID NO: 7051 - DNA, 443 bp, Homo sapiens
accacgcccagcctcttttgctgtttcattgctgacagtgttcaacaatatgccccatctttatatatcctaagaaacactaatcctaggttattgctagccaaaatatttttgtcctgagtagtgtcactgggccaaaagatagatcaggacgacagcctttagttttcctgaaatcaccaggtcaggcacaaggagaaaaggttcctggatactgactaacttgggtgggtctagccaggagaaagacagtaacatgtgttctgtactttctgggaagatccctgaagccatcacagaggctccccaacttctgagtcgcccatctgttgctgtgggagtgtgaacggatcgctgaaggagagggagctttgctctctctaggtgggcaagtttcctgggctctctgtgttgcctccctctggcttcttcctcccgtgccc

SEQ ID NO: 7052 - DNA, 293 bp, Homo sapiens
  misc_feature 290: n = A,T,C or G
aaggccaagctttgtagtggttgcacagtcacactgatatgctgatttgctctttctcattgtatgtctatgctttgtcatcagtgctatagtaaattacaaagaaataggtagattgtatgaacatacccacaaatgcctatgatttaggttaccaatgtattctttctcatttggggttttgcttctgtctgtctgtttattggaaacttgtacttcaagtagggggaatcctaattctaataactccttagctaagttttattattcaggcaataaacatgttttcntgt

SEQ ID NO: 7053 - DNA, 385 bp, Homo sapiens
  misc_feature 346: n = A,T,C or G
cctgagagcaggaagaactcggaaccgcagctgaatgtattggatgagaaggagccaggagggctacaccatctgtatgagggaaaagccttgggggagaggggtgggttcctgcctcctgccgagggtaagccggcaggagagagccatcagagggacctccgctgcctgggagttgggttccctccaagggtccctctttcagtgtcctctctctcacctgggtctgccaccctaacaggtggcaactcggcagggctgctgggggcacttcctgcccagggggggggtgccgcccaaccttctcccctccccacccccgcccccgggaccgtgcaggcaccanggttccgtgcacctattatattttttgaaaactggaaga

SEQ ID NO: 7054 - DNA, 314 bp, Homo sapiens
agggccaggcatgggggctcatgcctataatcccagcacttcgggaggccgaggttgggaggattgcttgatgccaggctgaccaatatagcaagatccaatctctactaaaaatttcaaaaacaaaaattaaaaaaattagctggacgtggtagcacgtgcctgtagtctcagctatttctgaggctgaggtgggaggtttgcttgagctcgagagtacttctagagcggccgcgggcccatcgattttccacccgggtggggtaccaggtaagtgtacccaattcgccctatagtgagtcgtattacaatta

SEQ ID NO: 7055 - DNA, 283 bp, Homo sapiens
accaactcataagatcaaatttcattgaatggtttgaggttgtagctctataaatagtagtttttaacatgcctgtagtattgctaactgcaaaaacatactctttgtacaagaagtgcttctaagaatttcattgacattaatgacactgtatacaataaatgtgtagtttcttaatcgcactacctatgcaacactgtgtattaggtttatcatcctcatgtatttttatgtgacctgtatgtatattctaatctacgagttttatcacaaataaaaatgc

SEQ ID NO: 7056 - DNA, 400 bp, Homo sapiens
  misc_feature 396: n = A,T,C or G
atttcactgtatccgccatgcatggagatatggaccaaaaggaacgagacgtgattatgagggagtttcgttctggctctagcagagttttgattaccactgacctgctggccagaggcattgatgtgcagcaggtttctttagtcatcaactatgaccttcccaccaacagggaaaactatatccacagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcangagg

SEQ ID NO: 7057 - DNA, 454 bp, Homo sapiens
ctcactctaattattaagttgactacaattcaatattatcaaccaacacatgaattgcttctttaggacatttgaattttacttctctagtagcaaagcaaaaatgggatccctcaggtacctgatttcagacgtcagcacatagcatgatctttcagggtgtgagtctgaattcatccttttgggataagtggaagtggaaaaacatatgtgcctgtctccccagctacctacctgtgctgcttggaagatgagccaagctcggcactaaggtatattcccatcatcactgcttctgtgggcctgagtcccgctctctcacacctataggtctgtctgacaggcccttgcctgtagactctcatcctacatcccctccagagctcatcttatcccccaaaaatccctttcccttctccccataatcactcctctttcagatgcagacttcatg

SEQ ID NO: 7058 - DNA, 250 bp, Homo sapiens
attttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttc

SEQ ID NO: 7059 - DNA, 393 bp, Homo sapiens
  misc_feature 386: n = A,T,C or G
cctgagagcaggaagaactcggaaccgcagctgaatgtattggatgagaaggagccaggagggctacaccatctgtatgagggaaaagccttgggggagaggggtgggttcctgcctcctgccgagggtaagccggcaggagagagccatcagagggacctccgctgcctgggagttgggttccctccaagggtccctctttcagtgtcctctctctcacctgggtctgccaccctaacaggtggcaactcggcagggctgctgggggcacttcctgcccagtggggggtgccgcccaaccttctcccctccccacccccgcccccgggaccgtgcaggcaccagggttccgtgcacctatttatatttttgaaaactgaagattntaatatt

SEQ ID NO: 7060 - DNA, 362 bp, Homo sapiens
tataggtttgggaaaaccataccttaaggttggtcagcagtcagacaactctaatgtgtgtagtgataagagattcaagtaacatcagttctcctccttttcatgcttttccttcccaggtgcagcctgtgattctgatggggactggtaaatctgtgcctctgcctcctaggacttattttcccaggaggccatttacaaggggatctggatgacctgctgatggagatccagcttgccagggacttaggtttatcctgttttgtttgctactggttacaaattctattttctgtacaattagtcagactaaagttttcactgtgtttgtttggcaaaacaaattaaacaaaaagtaaggt

SEQ ID NO: 7061 - DNA, 351 bp, Homo sapiens
gaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctg

SEQ ID NO: 7062 - DNA, 443 bp, Homo sapiens
aaatgtttgaaatttcctagagacttggagggttcagaagacaggaaaatgtgtgaaagtttagaacttcctagagacttgttgaatggctttgaccaaaatgctgatagtatggacaataaagtccaggctgaggtggtctcaagaggagatgaggcacttgttggaaactgaagaaaagtaactcttattatgcttagcaaagagactggttgcattttgcccttgccctagagatctgtggaactttgaaattgagagagatgatttagggtatctggtggaaaaaaatgtctaagtggcaaagtgttcaaaagaaagcagagcataaaaactttgaaaaatttgcaacctgatgatgcaatagaaaagaaaaacccattttctgggaagaaactcaagcaagctgcagaaatttgcataagtaatgaggggccaaaggc

SEQ ID NO: 7063 - DNA, 444 bp, Homo sapiens
tggggttctaaaatttccctaggaagtatggccaaatgagaaaaatcagactccaaattctccagttatgggcctgctgtagtggcttatacctgtaatcccagcactttgagaggcagaggtgggaggattgcatgagccaaggagtttgagaccagcctgggcaacctaatgagactacatctctacaaaaaaaaataatccaaaaattagcctggcatggtggcgctcgcctgtagtcccagctacttgggaggctgaagtgggatgatcacttatgtccacaaaaagagtcaaactctgtaaaatatttgaaaagatttattctgaaccaaatgtgagtgaccgtggtgtgtgacacagccctcaggagaccctgaaaacgtgcctaaggtggtcggggcacagcctagttttataccgtttaggaagacatgaggcaat

SEQ ID NO: 7064 - DNA, 395 bp, Homo sapiens
ctcgtgccgctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattat

SEQ ID NO: 7065 - DNA, 350 bp, Homo sapiens
  misc_feature 139, 153: n = A,T,C or G
cctggccccattgggcctcctggtccccgtggacgatcaggcgaaaccggccctgctggtcctcctggaaatcctggaccccctggtcctccaggtccccctggccctggcatcgacatgtccgcctttgctggcttangcccgagagagaanggccccgaccccctgcagtacatgcgggccgaccaggcagccggtggcctgagacagcatgacgccgaggtggatgccacactcaagtccctcaacaaccagattgagagcatccgcagccccgagggctcccgcaagaaccctgctcgcacctgcagagacctgaaactctgccaccctgagtggaagagtggaga

SEQ ID NO: 7066 - DNA, 291 bp, Homo sapiens
ctccctaggaggcctgcccccgctaaccggctttttgcccaaatgggccattatcgaagaattcacaaaaaacaatagcctcatcatccccaccatcatagccaccatcaccctccttaacctctacttctacctacgcctaatctactccacctcaatcacactactccccatatctaacaacgtaaaaataaaatgacagtttgaacatacaaaacccaccccattcctccccacactcatcgcccttaccacgctactcctacctatctcccctttcatactaataat

SEQ ID NO: 7067 - DNA, 448 bp, Homo sapiens
  misc_feature 100: n = A,T,C or G
gcagcacggtgccagtcatctgcatgtgctcctgcggcgtgggggtttgtagacttggaaaaccctgttggcagaaagttaagagctcccaggcctgaangcaggacacagtgccagcagggggccgtttgcccccatgtgtaagggaggcagggcccagctctcccacggcgaggtgagctgagactttctgagaacagttagagtgggtgcgtgtctgaaatgggtactcctagcagctattgtgtacgcaaagcctgagtacagcctgctggtgtcatggccacgtgtgagcaggccagcgtcacacggctcgctgtgacccgtcccggagactgaaatgggcctgggtcttctccttgtcctgtgattaaagtcctctcttgaaagtggagagcaaaggcacacagaggtgcgcgctcacaagaattcctcccggtgactgggt

SEQ ID NO: 7068 - DNA, 444 bp, Homo sapiens
  misc_feature 264: n = A,T,C or G
ccctggtcctccaggtccccctggccctggcatcgacatgtccgcctttgctggcttaggcccgagagagaagggccccgaccccctgcagtacatgcgggccgaccaggcagccggtggcctgagacagcatgacgccgaggtggatgccacactcaagtccctcaacaaccagattgagagcatccgcagccccgagggctcccgcaagaaccctgctcgcacctgcagagacctgaaactctgccaccctgagtggaagantggagactacttggattgaccccaaccaaggctgcaccttggacgccatgaaggttttctgcaacatggagactggcgagacttgcgtctaccccaatccagcaaacgttcccaagaagaactggtggagcagcaagagcaaggagaagaaacacatctggtttggagaaaccatcaatg

SEQ ID NO: 7069 - DNA, 443 bp, Homo sapiens
acgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaagg

SEQ ID NO: 7070 - DNA, 275 bp, Homo sapiens
ctcagaggctcactcagtaacgttgtttaattctctgccctggggaaggaggatggattgagagaatgtctttctcctctcctaagtctttgctttccctgatttcttgatttcatcttcaaaggtgggcaaagttccctctgactcttcccccactccccatcttactgatttaatttaatttttcactccccagagtctaatatggattctgactcttaagtgcttccgccccctcactacctcctttaatacaaattcaataaaaaaggtga

SEQ ID NO: 7071 - DNA, 413 bp, Homo sapiens
ggcttttagcttatgtcttagagtatttgcctactgatcttggactaagaaaaatgtgattaattattgtgttaacactttgctgtgatcaaagttctcaattgccaaaagattatctgcttttggaaaaataggtacgtctgttaacttccagtgatgtgactcattaaatgtgcaccttctcttcattcactgagttctgattggctcatattacaacttgaaaatttttatctaaggaaacctgccttatatggaaaatcaatgagcaatagtacccatgaggtgaacttttcacttaagccaaaagttgtatatgtaataaatctcaattttgccaatttaccattgtttacttgtaactatgatgctgacccataaacaaacatttcattgaccatttaatataacta

SEQ ID NO: 7072 - DNA, 443 bp, Homo sapiens
atgattcaaagaggcaaggccagagctcccaaccaggcttcttgtttctaaaatctgccaatcaatataactctgaaatattgaaatacggccccaaccccaaccccaccccactgctgttgtaggggagaaaagcagtgtattttccttacccattgcaaggttcatggctgagaccccgtaacaaaagacagattaacaatagaaaagtgcttttagaaaaagcccaatgtagaaaaaggtccctattgccctttatacactggtcacccactggactcggctctgtggacctggggccacttcttgttcagctgccgatgcaggagtggcgtcagaggatgtgctttctaccttggaccccacacgcaatggaaaacactgccacctctttgtggaaagttgttgcaggttggcttccctgggaagcagactctgagagg

SEQ ID NO: 7073 - DNA, 438 bp, Homo sapiens
  misc_feature 396: n = A,T,C or G
ggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagaatgcagggccacctgaagcgggcctccaacgagagcacccgccagaggctgcagcagcagctgacccangcccaagagaccctgaagagcctgggtgccctgaagaagtga

SEQ ID NO: 7074 - DNA, 456 bp, Homo sapiens
cagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagacttt

SEQ ID NO: 7075 - DNA, 421 bp, Homo sapiens
gatcctggcccggggggaaaacttggaacatctccgcaataagacagaggatctggaagccacatctgagcacttcaagacgacatcgcagaaggtggctcggaaattctggtggaagaacgtgaagatgattgtccttatctgcgtgattgtttttatcatcatcctcttcattgtgctctttgccactggtgccttctcttaagtaacagggaacctctcccacctgcccttcttttcagggacaaccctccataaatgtgtgccaagagggtctcctttcctgtcttcctctacagagaatgctgctcggtcctcctacccctcttcccgaggccctgctgccacgttgtatgccccagaaggtaccttggtcccccggaaggagagaaaaaagagagatgggcctgtggctgcattt

SEQ ID NO: 7076 - DNA, 495 bp, Homo sapiens
  misc_feature 2, 3, 51, 53, 68, 76, 93, 104, 109, 332, 367, 374, 383, 410: n = A,T,C or G
gnngctcgcgcgcctccaggtcgacactagtggatccaaagtaattgggcncnaggtttttggcttgnacgactgnggctcttcctcagtgcngcggaagcggngcggnggtcggagaagtggcctaaaacttcggcgttgggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccganctgctcatccggaagctgcccttccagaggttggngaggganatcgcgcangatttcaaaaccgacctgaggtttcanagcgcagccatcggtgcgctgcaggaggctagcgaagcgtacctggtgggtctgttcgaagataccaacctgtgtgccatccacg

SEQ ID NO: 7077 - DNA, 444 bp, Homo sapiens
  misc_feature 326, 377: n = A,T,C or G
gtttttcgctcgtcgactgcggctcttcctcgggcagcggaagcggcgcggcggtcggagaagtggcctaaaacttcggcgttgggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcangatttcaaaaccgacctgaggtttcagagcgcagccatcggtgcgctgcangaggctagcgaagcgtacctggtgggtctgttcgaagataccaacctgtgtgccatccacgctaaga

SEQ ID NO: 7078 - DNA, 442 bp, Homo sapiens
  misc_feature 15, 214: n = A,T,C or G
caacatggtgttcangcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccanaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtact

SEQ ID NO: 7079 - DNA, 440 bp, Homo sapiens
cattttcttgtctaagtcagttatgtgattctgttccccttgccagtgattggtgtgaggtgggcatgtgacacaatgatggccagttagatagaaatggaagttcattggggggtgtataagtccgttctcatgctgctataaagaaatacccaagactgggtaatttataaagaaaagaggcttaactgactgacatttccttatggctgaggaggcctcaggaaacttttaatcacagcagaaggcacctttccacagggcggcaggaaggagaatgagtgccagcaagggaaatgccagacgcttataaaaccatcagatctcatgagactcactcattatcacgagaatagcatgggggaaactgcccccttgttccagttacctccacctggtcccacccttaacacatggggattattaccattcaaggtgat

SEQ ID NO: 7080 - DNA, 262 bp, Homo sapiens
catttcagaagatggacacaaagaagaaggaggaacagttgaagcttctcaaggagaaatatggcatcaacacagatccaccaaaataaatgttttctacattttcatttggactaaatcccacgaatgacaactaccacctttttttcctttttaattaatactaaatattgtgatttcttatttgaggttcaaaatgacctgcttgaaactttgatacatattggaatacattatgttaataaacttgtagctttttgtg

SEQ ID NO: 7081 - DNA, 443 bp, Homo sapiens
gttttatattataaagtatgcattcttatcacctagtatatagttagtttgtagagtgatttccccccagtttcttgaacatggtatcttcacatcttggaccttggtcagttgtgctattcattattaaacactaaaactttggcggttcttgcataacattgtcagattttttagtgtatttctgtgaagtcattttttttcttgtcattccttttgtagtagttgctgtttggataaaagttgatgtgtgattttttattaaacaaatagtaaacccttcaattatagttagtcttggtgaagtaagatgtttgtagactttagagttctttaattcttggcacaacgtgactgttgagctaacaccaaatagtgtgttggcaatacttttcaaatggctgaaaacacctaaaaattgttcattcagaaatatctgtcac

SEQ ID NO: 7082 - DNA, 305 bp, Homo sapiens
  misc_feature 30, 32, 42, 270: n = A,T,C or G
ctttagtgtgctatacctatgagtcttatngngggccactgngccaataaacaaaaacaactgtttggtttacctcagttgcagtagttattttcatttagaagttgttctcagattattgtttcagttatatagaggattactagactagttatgaagaaaccccactacattcaatggaattggtgcttaaaatctcatcgatgtgctgtctctggagtgataagaaagggctacatctcccgaaatgatttctttacgtcatgtatnggtttccttcttcaccttgaacttttgttgaactg

SEQ ID NO: 7083 - DNA, 428 bp, Homo sapiens
atttattttaagttaactgcttaaggattgtagacaagttctccctagaacaatgttaaaccttttgatttccaggccagctcaaaacatgcatggagcatgcaaagctattgtgagtctttgggaatattttttcagagttgtgtcttgggtagatcaagacccatttgactcttccttttacttttctgcctgcctgctaggcgctgaagatggtcctgatggttctgatggccctctagctaccaacagaaggttttgaagatcggggtgaacttactgctttttattacttggtttttctaccattcctagcctaaactgtttaggaatttggcaactgaacttaaaatgtttacagatcttgtgaaggctctttcagtgatgtgattaatctcttagccttttgttattctttaaaaagaaag

SEQ ID NO: 7084 - DNA, 416 bp, Homo sapiens
gctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactga

SEQ ID NO: 7085 - DNA, 440 bp, Homo sapiens
caacttgaaattttaggaaataagtagtaatgcagcatagtgttttaggagtacagctcaagctccaccatttgctagatttgtaaactcagacattgcctgatcttatgccttagttgtgttatttgtaaagatagtagttcctagttcattgagattgttgtaaggattataatgagctgagaggcataacagtctgtacacaaaacctgtgacatagcaaatgctcaagagctgtaattaattacttacagagcataagtggattgagttgaatgaagtgggaaaaattggcaaatttggtccctttcattaccccttggttcctattgacttctcggcagcacatgtgctctatacaaaatggggagagtgaacaacactgggaacttgattaaaaggttttagaggtactccactatcatttgagtcatcctgtg

SEQ ID NO: 7086 - DNA, 445 bp, Homo sapiens
  misc_feature 231: n = A,T,C or G
gctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctangactctgcactgaatggctgacctgacctgatgtccattcatcccaccctctcacagttcggacttttctcccctctctttctaagagacctgaactgggcagactgcaaaataaaatctcggtgttctatttattttattgtcttcctgtaagaccttcgggtcaaggcagaggcaggaaactaactggtgtgagtcaaatgccccctgagtg

SEQ ID NO: 7087 - DNA, 421 bp, Homo sapiens
gtgctaccacacctggctttttgttgttgttgttgttaaagctagggtctcgttatgttgcccaggctggtcttgaactcctaggcttggcaaaatattgggattacaggcatgaacaaccgaacctggcctgtgataggtttttatatttctaaaaaaacactgttgggatgttaataggattgcattgcctctgatgaccactttgggtagtactgacatgtgaacaatattaaactttccaacacaggatgtctttccatttaattgtgtctttaaatggatataattgaacacaggatgtctttccatttaattatgtcttctttaatttctttcaacaatattttgtagttttctgtgtacaagtctttcacctccttggttaattcctatgtattttattctttttgatgctatt

SEQ ID NO: 7088 - DNA, 471 bp, Homo sapiens
  misc_feature 414: n = A,T,C or G
gttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgttttggcatctaccctggttcacctgggtgaatatcangcagctgttgatggggctaggaaagctaacagtactcgaacatggaaagaggtctgc

SEQ ID NO: 7089 - DNA, 258 bp, Homo sapiens
cactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttg

SEQ ID NO: 7090 - DNA, 290 bp, Homo sapiens
gcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagaaacccaacaacagcttttaaagtgtcttctatctcattgtattttttttaacttgccccaatgatagaaaagtcttttgctgaaatgattttgatgatttttgtttatcgtttataaaaaggaaaagaaatata

SEQ ID NO: 7091 - DNA, 250 bp, Homo sapiens
tattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttgggagaaggcgcaatactctccagctccaccgttaccgctaatataagtaaagtttgtaaaattcatacttaataaacaatttag

SEQ ID NO: 7092 - DNA, 460 bp, Homo sapiens
  misc_feature 6, 59, 135, 201, 216, 333, 420, 430, 459: n = A,T,C or G
caattntcatttaattacccatgcacttatgcatggcctttgcattcattcctgcattngcatgctttcttagagctggttttccttctatttgaaaatgcctttagcatctctttcactgaaggctgactaagncaaagtctttctgggtggtttttcaaaaatactattatttagtcttcatgtttaaagaatatattnatctatatatagaantctaggtccttgggttctcttcatcttaaacacatcactccattggcttctgaatgtcattatttctgttcaaaagtcaactttaatcttattggtgctttcttttacgttaattgncattttcctctttttagcaagtccgttatgatatacccaggtgtgatttcctttacggctggacatcatatcacttcttgaatctgnggcttgatgntgctcactagctttggaaaattctctgtnt

SEQ ID NO: 7093 - DNA, 441 bp, Homo sapiens
ggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttc

SEQ ID NO: 7094 - DNA, 420 bp, Homo sapiens
  misc_feature 362: n = A,T,C or G
gtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtgggttgtagctgatgagttattacctcatagagactataatattctatttggtattatattattttggatgtttgctgttcttcaaacatttaaatcaagctttggactaattatgctaatttggngagttctgatcacttttgagctctgaagctttgaatcattcagtggtgggagatggcc

SEQ ID NO: 7095 - DNA, 410 bp, Homo sapiens
  misc_feature 298, 301: n = A,T,C or G
ggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggctgggaggggcctgaatgtgggtgnaanacgggccgagtcatgctcggggagaccaaccctgcagactccaagcctgggaccatccgtggagacttctgcatacaagttggcaggaacattatacatggcagtgatt

SEQ ID NO: 7096 - DNA, 406 bp, Homo sapiens
cgcttgtgctgcagccatgtctctagtgatccctgaaaagttccagcatattttgcgagtactcaacaccaacatcgatgggcggcggaaaatagcctttgccatcactgccattaaggggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcg

SEQ ID NO: 7097 - DNA, 382 bp, Homo sapiens
tatctcccctggccaagtaagaaaaagtgacagcaacaggtcccagagaatctgtctctatctggatgcatcagatgccagagcagaaaagcctgcaccagacgccaccagcctggagtccctggggggcgtcccctcctgtcccgagaagatacactggtgactccctgcttactaggctggggttgcacattgtcttaatttactgtacaagcagcacccacgttggttcttatttgcatggtgaacactgagctggggcagtaaagaaagggtcacattttacaacagagctgggagcattctccttgcagtgagaaacggctgaaaataggcttagccaggaagatgggactcaagtaccagggaattaagggagatg

SEQ ID NO: 7098 - DNA, 401 bp, Homo sapiens
gtttttccctggttttctgtcactggcacaggagggtacagttgggagagtgcgttcctggagctcagtcctgcatttgttcacgtgcctcacagcaggcctttgtgcccttgaatctcaaacatggggatctgcttggtacccagagctctggtcattgtgtccaaccacacaccccaccccatccgtgtcctccatctcacccagaaccacagggtgcccactagtgtcagggcccaaagtgccagccttctcttctgccttacctagtctacctatttatttcctccactttttatcttaaaagtagctaagccatgctggtgcccatactccaagcaggctgcctcagctcagagaagtggtcagagagtagagcacagaacctgtgatgtggggac

SEQ ID NO: 7099 - DNA, 409 bp, Homo sapiens
aaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccac

SEQ ID NO: 7100 - DNA, 455 bp, Homo sapiens
ctcaagtggccaaggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagatcattgatgacaatcatgccatcgtgtctacatctgtgggctcagaacactacgtcagcattctttcatttgtagacaaggatctgctggaac

SEQ ID NO: 7101 - DNA, 355 bp, Homo sapiens
cagaagcgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataacctggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttcttggttttaaaaaatac

SEQ ID NO: 7102 - DNA, 421 bp, Homo sapiens
  misc_feature 392: n = A,T,C or G
cccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatttgtggaanatgtttaaattaaattgtgaaaaaaatga

SEQ ID NO: 7103 - DNA, 377 bp, Homo sapiens
taatgatgtcactttccttgctggtcatcattaggcttaaattaaatgctgaagctgtcatcaaagagtttacactaaaatcttcagggctttaaataaaaggttaagtccagcttccaaacacaattttccacattagcagctccaatcttcttaaataaagctctgttttcctatatttttatgactgctgagaccccacagggaccaatatttgtattcaaattacatttcatggtttcccattgtttcacaatgagttctaataaatgggatttactataataatccaagtatgacatagccggtatgctttcatgaatgtttttatggtagattttcctcccatgaacatgagtaaataaatctgtttcctg

SEQ ID NO: 7104 - DNA, 441 bp, Homo sapiens
cgccgatagagggacggccaagaatgtacgtccagcctgccccggagctggaggatcccctccaagcctaaaaggttgttaatagtttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattggagtttttacaagatgtatttgttgtagacttaacacttcttacgcaatgcttctagagttttatagcctggactgctacctttcaaagcttggagggaagccg

SEQ ID NO: 7105 - DNA, 422 bp, Homo sapiens
cctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtggggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacgaagcagctgacagaaatgctacccagcatcttaaaccagcttggtgcggatag

SEQ ID NO: 7106 - DNA, 401 bp, Homo sapiens
  misc_feature 280, 319, 346, 349, 373, 384, 399: n = A,T,C or G
gccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccanagaaggtcacatggatgaggagaatgaggattttgcgcncggctgctcagaagataccgcgaatcnaanaagatcgatcgccacatgtatccncagccctggtncctgaaaggtgaaangg

SEQ ID NO: 7107 - DNA, 439 bp, Homo sapiens
ctttgctgaagtgagaggaagagtctgagttgtctgtttctagaagaaacctcttagagaattcagtaccaaccaagcttcagcccactttcacacccactgggcaataaactttccatttccattctcctagctggggatggggcatggtcaaacttagccatcccctcctcagcaaggcatctaccggcccctcacagagacagtactttgaaactcatgttgagattttaccctctcctccaaccattttgggaaaattatggactgggactcttcagaaattctgtcttttcttctggaagaaaatgtccctcccttacccccatccttaactttgtatcctggcttataacaggccatccatttttgtagcacacttttcaaaaacaattatataccctggtcccatctttctagggcctggatctgcttatag

SEQ ID NO: 7108 - DNA, 390 bp, Homo sapiens
gtctcgagtttttcatcctttaagaaaaaaatcagctttagaattctctgcggtcagttgtgtgcaatgcaacaaaactacctttcagtaaattacttagttatttatttcagtgttttgtttcttttgatactaagtttccctttcaataatgaatgatgtgaccaaccaaggagaatttgtttgttctgtactaaaattatattttacagttaggaattataaaaagcaagggagcatctttaaatgttttttgtttaagcgatgtcttccatccaaagtaagaataatactctcggaaggtccttttggtgtcatgtcacttgctgtatgtggcagccttacagtgccacacttgggtactgaaaaatcaataaaacgaaagttcat

SEQ ID NO: 7109 - DNA, 137 bp, Homo sapiens
  misc_feature 113, 135: n = A,T,C or G
gtttacaacataatctagtttacagaaaaatcttgtgctagaatactttttaaaaggtattttgaataccattaaaactgcttttttttttccagcaagtatccaaccaactnggttctgcttcaataaatcttngg

SEQ ID NO: 7110 - DNA, 439 bp, Homo sapiens
gtgccggatccagacacctgacctagaatgcctgcccgctatccctgtggcaggaaatatcccctcatgtcccagggaattgcagatgggtcttctatacccttctacctgcccttagatctccatttttatcaaatagtacattggcattttgaagttttgggttttgtccttcatctttccctttcccttcaaatcttttaatggtaagaaagcaagtgaagcttggtgcaagctaaaatttttaaatggtgtggaaatgcaaataataccaagtaaaataatacagatattattaaagtttctggttttgaggtgttgtagataaatgtatttatgtgcctagtggggaatccaatattatgaatatgaaaaagggggcaataaaagggtatgtaaaatatgtatgaagaaaaggtgtacaaaaatttgcccttat

SEQ ID NO: 7111 - DNA, 438 bp, Homo sapiens
  misc_feature 407: n = A,T,C or G
ctccgggccagcttccctccaaggaatgagtggatttcatacaggatctctttattgcacagactgaatggctttacatgtttctaatgtgaattaggcatgtgaagcagtgggtgtccacccgtgtccctcatgggtgagccctccagctgtgagcccaggcagtgtggtcaccgagtgaggaccctcctcaccaggaaccgcatccctgtgctgcctccacctgagagttgctagggggttcttgtcgagatcatgtcatcagcacccctaagtcaagtcacgggtttccatagccaggcagttggtatgtacaattcagttcagcgtatgaacttgtatctctaatctgatgtccatttttatattttttgaaactgagcacaatgaaatcctttcttgaatcnttttccttttggattataaaaatatggggga

SEQ ID NO: 7112 - DNA, 401 bp, Homo sapiens
ggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcatt

SEQ ID NO: 7113 - DNA, 439 bp, Homo sapiens
gctgtttgggctaacaggatctcctcttgcagtctgcagcccaggacgctgattccagcagcgccttaccgcgcagcccgaagattcactatggtgaaaatcgccttcaatacccctaccgccgtgcaaaaggaggaggcgcggcaagacgtggaggccctcctgagccgcacggtcagaactcagatactgaccggcaaggagctccgagttgccacccaggaaaaagagggctcctctgggagatgtatgcttactctcttaggcctttcattcatcttggcaggacttattgttggtggagcctgcatttacaagtacttcatgcccaagagcaccatttaccgtggagagatgtgcttttttgattctgaggatcctgcaaattcccttcgtggaggagagcctaacttcctgcctgtgactgaggaggctgaca

SEQ ID NO: 7114 - DNA, 437 bp, Homo sapiens
gtaattaattttttggaagtttccgttaaatgtaatattgcttctcttgttaccatactgattcttttctatttataaatgtattttgatgggcagtaaaacaaagtgtcttaaaagttttaaatagagaaaatgtgctttacacagttgcctataaaaagtgctctatgttatccaagcaattcatactataagcttcactcttattgttgtatgcaatttttactatcatgcaaataagcttaggtaaataaaactaatagatcaccttagaaaattatgcaattaatgtgaaaataattgatgtttgcaatgtgtcttcctttggtttacaatcaattttaaagctacatctgtataaaatttctgtataaaggtgtatttcttttttatgagtttatggctatgaaaacagctattttgttacagctggctgt

SEQ ID NO: 7115 - DNA, 439 bp, Homo sapiens
ctcgtgccgctcccttcttcatggaatatttgcacttttcctcagacaaaaagcttaaacttttgtaagaggataaaaatttgagacagaatttaaagtcattaaggcttaattcatgtgtacccagatacctggaacctaccagatgataaggtgatgatgagcagagccttctagaggtctcatgtgaccctgaaacctggcaattcaggggattcatgcactccctgtgcatgagaaatgtcttctggtttctcctcatccattacgggagtgaaattttaacttggcttgtacacaggttgcttatttggctggtgggttcagatattggagtttcccctcaacagagactaaggaacagacctgtgagataaaagccagagagagaaaaaagagctaaagttaacaggtaacattgcccctacagtgggagctt

SEQ ID NO: 7116 - DNA, 438 bp, Homo sapiens
  misc_feature 273, 382, 414: n = A,T,C or G
ctgagtttcgcacttgattttcaatattttatagtaagaaatgacaaactgctttggttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattantaatattctaggtacctcacaaaatgtattatggtgccatggctgttagtttttagtgagtgctgtaggattaattcgaaaataggcagaattccattcctcccaaggnggcaaaaattagctatactgatgtaattgtcntttacctgggtatgaattccctga

SEQ ID NO: 7117 - DNA, 144 bp, Homo sapiens
gttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttc

SEQ ID NO: 7118 - DNA, 340 bp, Homo sapiens
gtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaat

SEQ ID NO: 7119 - DNA, 130 bp, Homo sapiens
cggccatcgtgatcgccgccctgctggccacctgcgtggtgctggcgctcgtggtcgtcgcgctgagaaagttttctgcctcctgaagcgaataaaggggccgcgcccggccgcggcgcgactcggctgc

SEQ ID NO: 7120 - DNA, 437 bp, Homo sapiens
gctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgcccc

SEQ ID NO: 7121 - DNA, 223 bp, Homo sapiens
  misc_feature 205: n = A,T,C or G
gtcacactgggtgagaagatgacagaggaagaagtagagatgctggtggcagggcatgaggacagcaatggttgtatcaactatgaagagctcgtccgcatggtgctgaatggctgaggaccttcccagtctccccagagtccgtgcctttccctgtgtgaattttgtatctagcctaaagtttccctaggctttcttgtctcanccaacttttcccatcttg

SEQ ID NO: 7122 - DNA, 384 bp, Homo sapiens
gtggagagccctgttcacctgatagggtctagctgtgacagtaaatataataccgctgtttccttgggtacagatttgagtgttcatgtgatgagactgtaaacctcatttttcggttcctctgtttaaaaaaacatctgaaggatgaactaaggctgctggtgccctgagcaactgataatgcaaatgtggacaaagtgtctgttttctactctagcctgttcatatggaccaaatttcaacaaggaactcaaggaaaatttgtacctgccgtatttatgctttcatgtaaaaaagggttggggggaggggtgtctttttgcttttggtgaactttttttcaaaatcatttttccactgtttctgtctggttttaaaacaaat

SEQ ID NO: 7123 - DNA, 438 bp, Homo sapiens
  misc_feature 424: n = A,T,C or G
ccgatacctcccaaaccgattccttcaactcaaacccagccaaatcatcctgactgcatacctgcctgcccaccttctgctcatcatcttactagaatgctgcaaatgaatggggcttcaataggccaaaaaccagacccattctctacccccactccaagctaatcatggccgcagtgaattgcaccatcagaaaattagaagtgatgctcttgaatccatgtgtcctggcctttatcttgctgatttcactgcctgatgctctccaattcattcactgttttcccaccagtcttctccagattatttgcacctcttgcctggatactcatgactccctcctaactgctttcacccccttctttctggtcctcccctcccctcactccaaattcttatcccaagcaatcttgtcacataaacntgttggatatgtca

SEQ ID NO: 7124 - DNA, 439 bp, Homo sapiens
atgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcagggagtttaagaccagcctgaccaacatggagaaacctcgtctctactaaaaatacaaaaattagccaggcatggtggcacacgcctatagtcccag

SEQ ID NO: 7125 - DNA, 439 bp, Homo sapiens
cttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccg

SEQ ID NO: 7126 - DNA, 439 bp, Homo sapiens
gccgacgcagacccctctctgcacgccagcccgcccgcacccaccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatg

SEQ ID NO: 7127 - DNA, 109 bp, Homo sapiens
tacttctagagcggccgcgggcccatcgattttccacccgggtggggtaccaggtaagtgtacccaattcgccctatagtgagtcgtattacaattccactggccgtca

SEQ ID NO: 7128 - DNA, 435 bp, Homo sapiens
gccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccag

SEQ ID NO: 7129 - DNA, 437 bp, Homo sapiens
atgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatt

SEQ ID NO: 7130 - DNA, 439 bp, Homo sapiens
caaagctttcaaccagtcctcaaaccttattgaacaaagtaattcatactggagagaaaccctacaaatgtgaagattgtggcaaagcctctaacccgtcctgaattcttactaaacataagaacattcatactgaagaggaaccctatgagtgtgaagaatatggcaaagccttcaacaagtcctcaattcttaccagacataagataattctggctgggtgcggtggctcacacctgtaatcccagcactttgggaggctgagacgggtgaattacatgaggttgggagttcgagaccagcctgaccaacatggtgaaatcctgtctctactaaaaatacaaaattagccatgcgtagtggtgcatgcctgtaatcccagctactcgggaggctgaggcaggagaattgcttgaacccgggaggcagaggttgaagt

SEQ ID NO: 7131 - DNA, 403 bp, Homo sapiens
gttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatggcggccgcaaactgacacctcagggacaaagagatctggacagaatcgccggacaggtggcagctgccaacaagaagcattagaac

SEQ ID NO: 7132 - DNA, 302 bp, Homo sapiens
tggaggctctggtgatggaatgataaaagtgaagaatcagctccgcttccttgcagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactgactgcctggtgcccagcacatgtgctgccctacagcaccctgtggtcttcctcgataaagggaaccactttcttatt

SEQ ID NO: 7133 - DNA, 428 bp, Homo sapiens
ctcgtggtcccaagaagcatctgaagcgggtggcagctccaaagcattggatgctggataaattgaccggtgtgtttgctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatggatgtcatcagcattgacaagacgggagagaatttccgtctgatctatgacaccaagggtcgctttgctgtacatcgtattacacctgaggaggccaagtacaagttgtgcaaagtgagaaagatctttgtgggcacaaaaggaatccctcatctggtgactcatgatgcc

SEQ ID NO: 7134 - DNA, 428 bp, Homo sapiens
gcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtg

SEQ ID NO: 7135 - DNA, 329 bp, Homo sapiens
  misc_feature 239, 241, 307, 310: n = A,T,C or G
gacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggcgaggtgggaaggattgcttgangncaggagttcaagaccagcctggggcaacacagcaagatcctgtctttgtaaaaaactaaccaaacnggnaaactggggaaatttctgc

SEQ ID NO: 7136 - DNA, 266 bp, Homo sapiens
atttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccg

SEQ ID NO: 7137 - DNA, 438 bp, Homo sapiens
ctaacttcggattacctcaaggaagtggatgtttttgtttccatgggataccacaaaaaaaacctatggaggctaccagggtagagtgtttctgaagggaggcagtgatagtgatgcttctctggtcatcacagacctcactctggaagattatgggagatataagtgtgaggtgattgaaggattagaagatgatactgttgtggtagcactggacttacaaggtgtggtattcccttactttccacgactggggcgctacaatctcaattttcacgaggcgcagcaggcgtgtctggaccaggatgctgtgatcgcctccttcgaccagctgtacgacgcctggcggggcgggctggactggtgcaatgccggctggctcagtgatggctctgtgcaatatcccatcacaaagcccagagagccctgtgggggcca

SEQ ID NO: 7138 - DNA, 348 bp, Homo sapiens
ccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggt

SEQ ID NO: 7139 - DNA, 402 bp, Homo sapiens
  misc_feature 401: n = A,T,C or G
acgctggagcacagcaccgtcctggggctgcccgcaggggccgaggagcgggcccggaaggagctcgccaggaagcacctggctgagcacgcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccaggcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaaggaaang

SEQ ID NO: 7140 - DNA, 439 bp, Homo sapiens
aatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgcta

SEQ ID NO: 7141 - DNA, 392 bp, Homo sapiens
ataacatatggtggactgttattaagagtatttgttttaagtcattcaggaaaatctaaacttttttttccactaaggtatttactttaaggtagcttgaaatagcaatacaatttaaaaattaaaaactgaattttgtatctattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgtcataaagaatttcttttatttttgaaatcgagtttgtaaatgtccttttaagaagggagatatgaatccaataaataaactcaagtcttggct

SEQ ID NO: 7142 - DNA, 188 bp, Homo sapiens
ccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattccc

SEQ ID NO: 7143 - DNA, 437 bp, Homo sapiens
gcgcggtgaggttgtctagtccacgctcggagccatgccgtccaagggcccgctgcagtctgtgcaggtcttcggacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagctgaccctcgtcgctgcgagtccaaaaagtttggaggcc

SEQ ID NO: 7144 - DNA, 437 bp, Homo sapiens
cgggttcaagcgattctcctacctcagcctcccgagtagctgggattacaggcatgtgccaccacgccaagctaatttttgtatttttagtagagacggggtttcaccatgttggccaggatggtctcgatctcttgacctcgtgatctgcctgccttggcctcccaaagtgctgggattacaggcgtgagccaccatgccccgccccagatggattttacatttgctcttttgtgtttcgctccaaagggttgtcttcctcgccaaaaggagggagggactttgaatttgatatgaatctttaaaaccagaattggctggatatttcccatgattgggaaaagagtgaaatgaggacattctgtaaactgtccctccctaattccaaggatcagaaactccccgttttgctgactcattccataactggagaaaga

SEQ ID NO: 7145 - DNA, 310 bp, Homo sapiens
ggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaat

SEQ ID NO: 7146 - DNA, 397 bp, Homo sapiens
cccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtaggg

SEQ ID NO: 7147 - DNA, 182 bp, Homo sapiens
  misc_feature 112, 154, 162: n = A,T,C or G
tcaacccctactttcctggccaggccattgccatggcccctcccatctacacagatgtcttagagtttgacgatggcaccccagctaccatgtcccagatagccaaggatgngtgcaccttcctgcgctgggcatctgagccagagcaggaccntcgaaaangcatggggctctagatgttg

SEQ ID NO: 7148 - DNA, 430 bp, Homo sapiens
ctctcttctagtgacagtacccttttcacttgaggaaaacctccctcctcaattccaattctggtagggctgcctatcacatggccccactggtccaggccagatggctgggagtatgctacatgactgattagccacagtggttcctacctctggctatagctattggtcctagcactggaccaatctcagagcattagtctaaacccagctcagattttgtacttggatgctaggagacagaggatttttttgttttgattattgaattgtgatgatgtaatctaaagctgtttatagccaaaccagcccccatcctaggttctctcctaacatttgcaggaagttatcgatagtgagaaagaagatcactaacatatcaagagaagtacaggtgaaaagttggtgagctagagatgaagagaagata

SEQ ID NO: 7149 - DNA, 438 bp, Homo sapiens
gatcctaattcctgtcattagtgacctaagtaccccatatcagaaactttgcaaaacagatctagggacagaagggctttgaaagacatttttctttggggcaaatttcgtgtgccagaactacagtttaaatgtttttatgagcaagggaaggtagcattgattcccatagctttctaattagatacatgctgtcatggatgtaagccttaaaggagttaatactaatcttgtacatacacaaattttcctcaggtttttttattttaaaaaatgatttgttaaaagtactgtctgctagacccttgcctttgagtggctttgaaacttaatatagtttttaaaaagtgcaatgggatgagattatgctattagtatattaaaagcatgtttctgttttactccaatttgtaagatcatttaatggaataaagatca

SEQ ID NO: 7150 - DNA, 439 bp, Homo sapiens
tgaagctgtacagttctccagaaattaaaacaatgtcagagtcaatgggagaatttaatttacctttaagatttcattttaatggtggcaaaattatacattcttagaagatgtaaatttggaactgttaggagattgctctgtggttttgatcttttcaaaccattttctttttgaaaaaaggcattagttgtagtcatggacattaaatgggccatatatgcttatcaatcaaaaaagtgttccttttttggaactgcccattttctggatcttccctctcaatggataggggatgaaaaccttggttgccttttatttgtttcctcttctaaaatttctcacctgaatgtagtcctgggagagtcccgatcacgtctctcctgacatgttcactgaaatcggagacaagaagttacatggatgatgggatcttata

SEQ ID NO: 7151 - DNA, 232 bp, Homo sapiens
gtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatt

SEQ ID NO: 7152 - DNA, 235 bp, Homo sapiens
ccaatgcagaccctagtataccgcctccacccagagctcctgcccctgcgccccctgggaccgtcacccaggtggatgttagaagtcgagtggcagcctggtctgcatgggcagccgaccaaggggactgtgagtcttcctagaattaatacttattgaacacttactttgggttgggacatagttcttgctttcaaattctgatgctgatttcagaactgaagcttgaggttag

SEQ ID NO: 7153 - DNA, 106 bp, Homo sapiens
  misc_feature 2: n = A,T,C or G
gngctagtggttaatagtaacgtgtcaatattggttcatcagttgtatcaaatgtaccacactgatgccagatgttaataatcggggaaactgtgtgtgctgaaga

SEQ ID NO: 7154 - DNA, 116 bp, Homo sapiens
tcgagagtacttctagagcggccgcgggcccatcgattttccacccgggtggggtaccaggtaagtgtacccaattcgccctatagtgagtcgtattacaattgcactggccgtca

SEQ ID NO: 7155 - DNA, 324 bp, Homo sapiens
gtgcaatcaaaacgaggaagagaaggaaaagaagtgtttaaaaaaccaccatgggggttcagagctgcaatccgagttccgagccgcagaatcctggagcgctgcgggctcggctcgccggagtgtgcggcaaaggtgggagcgcgcgccggctcccccgggagggagatggacaagcgagagcgagtgtgtatgcgcgcgtgtgtctgttggtgtgagctcgagagtacttctagagcggccgcgggcccatcgattttccacccgggtggggtaccaggtaagtgtacccaattcgccctatagtgagtcgtattacaattc

SEQ ID NO: 7156 - DNA, 304 bp, Homo sapiens
cccgtgccccacactttcctcctccccactgcagtgagtcaatagtccagggtggggcctggcctccctgccctgattggggactcaggaaggtgaggcctggggggcttcctgccccctccttgcccacctgcctgcccccgggcagcacgggagggagagcagggtgagcacgcttgttggtttcagatgcactttctgcttgcattgccgtatctgtgcgttccttcatcctggtcctggctttatggaacaccatgtttttagcatgtttttaaataaaaacggataaagtgtcaaaagc

SEQ ID NO: 7157 - DNA, 216 bp, Homo sapiens
gcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattc

SEQ ID NO: 7158 - DNA, 111 bp, Homo sapiens
agtacttctagagcggccgcgggcccatcgattttccacccgggtggggtaccaggtaagtgtacccaattcgccctatagtgagtcgtattacaattccactggccgtca

SEQ ID NO: 7159 - DNA, 299 bp, Homo sapiens
  misc_feature 3, 4, 11, 16, 18, 20: n = A,T,C or G
ccnncctgggngacanancnagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgc

SEQ ID NO: 7160 - DNA, 418 bp, Homo sapiens
gacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatccc

SEQ ID NO: 7161 - DNA, 255 bp, Homo sapiens
  misc_feature 231, 237, 253: n = A,T,C or G
tcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaactnggttcngcttcaataaatcttngg

SEQ ID NO: 7162 - DNA, 218 bp, Homo sapiens
gagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgt

SEQ ID NO: 7163 - DNA, 458 bp, Homo sapiens
cacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaaca

SEQ ID NO: 7164 - DNA, 457 bp, Homo sapiens
ggaacagccacctaaggcaagaatggaacggacacaccttgctcctttctgagcccgtttcccaaaaccccccttccaggtgcttctaatgggtgttgccatagcagacgctgctaatgcatcacagcattctttgaaatggaaccagacacagcctgcctctcaatcctcagctgggggctcctagcagcctcttgtatttactcagagttgacacatcacacagatcctgtttggcattcctaccttacggacgtctcaggggtgacaggaccagggcagagccccggtacaaacagacaaggctgcagtcaaatgggagggtccaggtgtccgtgttggagggctgggatcttgtagggcctgtgcgtcctggctgaggatcaaaccacatatgttattgggagaaacgatttctgttgacgtagatattgaaagaataatgaaggcagaagag

SEQ ID NO: 7165 - DNA, 455 bp, Homo sapiens
cgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtggccatgcttcttgccccttgggcctccccccagcccctcctccccttcctgcacccgtacccccgtg

SEQ ID NO: 7166 - DNA, 439 bp, Homo sapiens
gtgaactctgctagggactaagtactttgttagaaaggtgctcataatagaatggcgtgaacgcgggagacggagctttcagtgagccgagagcgagactccgtctcaaaacaaacaaacaaacaaacaaacaaaaataaaatagaaaggtgctcataataaaatgagaaataaaaaaaattctaactgatcaaatgggacaaaacccagattcacggtctttatatgcaaataaagtatagattcttagattcagaacagtaaaagaaaaatacctagaaaacaataaacaaaaggcatgaacaggcatttcacaaaagagctactgcaaagtcacaaacatattaaaagttactcatcctaactaacaatcaaataaatgtaaattagagcaagcaaacttgtttttccatttatgaacttgccaaagatttaaaag

SEQ ID NO: 7167 - DNA, 186 bp, Homo sapiens
gggaagagatcaaggtaataggaagaggggttagccagtctttttgtacaggtgccgtgtgacacttccacatcgcgggagcaggacccgtgctgtaccgaagcgcacttatacaaatgagtgggcaatacaaagtctgaatatgaaaataagatttcctctgaaaacacatttttggcacagatt

SEQ ID NO: 7168 - DNA, 443 bp, Homo sapiens
  misc_feature 208, 358, 442: n = A,T,C or G
gaaaatacaggtgggccttggggccagtggcaaggagcacaagagcgagaaggaagaggaagctggggcagcagcagtggtggatgtggcggagggagaggaggaagaggaggagaatgaggacctctactatgaaggggcaatgccagaagtgtctgtgcttgtcctgtcccgacactcctggcctgttgcctcaatctgccacacngtgaaccccagaacctgcctgccctcctacctgaggggcactttgaacagatactccaacttctacaacaagagtcagagccaccctgcccttgagcgaggctcacagaggcgactgcagtggacgtggctgggctgggctgagctgcantttgggaaccagaccctgcatgtgtccaccgtgcagatgtggctactgctgtatctcaacgacctgaaggcggtctctgtggana

SEQ ID NO: 7169 - DNA, 128 bp, Homo sapiens
cggttgtcaactcagctgaagaacacaatcaccgatgctgtcctgttgttttttaggggattgctattaacattttattttttgagacagtctcgctctctcactccagcctgggcgacagagcaaga

SEQ ID NO: 7170 - DNA, 438 bp, Homo sapiens
ctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatg

SEQ ID NO: 7171 - DNA, 120 bp, Homo sapiens
cgtgatgaaaatggggagcttcggttattgtcatccattgtggaagagctgctggatcagtgcctggcaccagacacttctggggatggtacagggggtgacaacatgacctgcatcatc

SEQ ID NO: 7172 - DNA, 108 bp, Homo sapiens
tacttctagagcggccgcgggcccatcgattttccacccgggtggggtaccaggtaagtgtacccaattcgccctatagtgagtcgtattacaattcactggccgtca

SEQ ID NO: 7173 - DNA, 439 bp, Homo sapiens
aaaaaagatttagtagaatctgaaatctggagttcagttttcctggaaattttccttatatggaaccacagagagaaataagaagtaaacacataagatggaaccatttcagaacaccttcgtacatgcattaaagctcatgcactccactcactaagcgctctaagtgcactaaagctcatgcatttctttcatttgtgtttaaacttaacaaaaaatacagttcaaacaagtttcaatattaggtttcctatcaaattagaatggttttatggcaatctaaacacaaggtgatgagctcttagagacaagctcatttgacaatagtgagaagtgacagtagcagcttagtggtcaaggagggaacaggaaagctttaaaagccgactcaaccaaatcacactagccgatttgtgtagggtgatttgaaacagcttta

SEQ ID NO: 7174 - DNA, 439 bp, Homo sapiens
gatggatgtgtttatacatttggtctaaacatttttcatcaattaggaattattccaccgccttccagttgtaatgtacccagacagatacaggcaaaatatctgaaaggaaggacaatcattggcgttgcagcaggcaggtttcatacagtcctatggactagagaagctgtttacactatgggactaaatggtggacaactgggttgtttgctagatcccaatggagaaaaatgtgtaactgctcctcgtcaggtctctgcccttcaccataaagacattgctctgtctttggttgctgcaagtgatggagctacagtctgtgttaccacaaggggagatatttacttacttgcagactatcagtgcaagaagatggcttctaaacagttgaacttgaaaaaagttcttgtgtctgggggtcatatggaatacaagg

SEQ ID NO: 7175 - DNA, 432 bp, Homo sapiens
  misc_feature 320, 408: n = A,T,C or G
ggtgcagccagtttgcataaacaagagaacagcaggtgcagccggttctaggcaagatcaggcagcatgcaggccacatcctcatgcctgtgataaaaagacaagaagtttccacttcagcctctgcttgaccatgagctaagcctccacttcagcctctgattggtcacaggccaatccttcacaggctgtagccaattggaggcttctaaagggtacctaggggtgttgccaagttcttttggctttataaaaaccctaattagggccgggcgcagtggctcacacctgtaatcccagcactttggaggccaaggcangtggatcactcgaggtcaggagtttgaaaccagcctggccaacacagcaaaacccccatctctgctattaaaaaaatacaaaaattantcaggcatggtggccccgcacctg

SEQ ID NO: 7176 - DNA, 216 bp, Homo sapiens
gtctgggtgaacgttggtggtcttcgtgctgcagtttacgttctgatacgtacacctcaagcttttgttcatccttcagaacaagacggagaaagaggaactctttggcaatgcaaagaatgaagatgactaatagtacttgtacttcccaccactggaaatgttagcataaaagaacttggagaggaaaaaagtattaacaaaactgcagtctgc

SEQ ID NO: 7177 - DNA, 436 bp, Homo sapiens
cctgttcggacactatagtctaaatttttgaaactgtgtggtgttcgctaaaagtaggaataacaacgtaaaagctaattaaggtcacaaacttcggtgaaacccttaaaagtccaaatcttcttgatattgtgaaccgtaccccttccagtttagtttcttctggactttccttacttaactgacagttaccttttaaaatttgcacacattatgattaaaattgggcctctactgtgatgattcctatttcctctcatgttttaaagtgcaaactaacatttaagtgaacattagcatcaagtagtgcagacacttgtatgcatttccttgattcaatttgtgaccttaccagttttgaattggaattgcaccatttcgtagataaaggaaactaagtatattgctgcacttttaagttttcaaaacagtgtct

SEQ ID NO: 7178 - DNA, 435 bp, Homo sapiens
ctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaattgtggatttgtgctcttgtatttttaagtggatt

SEQ ID NO: 7179 - DNA, 439 bp, Homo sapiens
cttacttccaagttctggctgcttgcaggtggaactccagctgcaagggagttagggaaatgaaggtctttttttaaaagcttctcagccttcctagggaacagaaattgggtgagccaatctgcaatttctactacaggcattgagaccagttagattattgaaatattatagagagttatgaacacttaaattatgatagtggtatgacattggatagaacatgggatactttagaagtagaattgacagggcatattagttgatgaaatggagtcatttgagtctcttaatagccatgtatcataattaccaagtgaagctggtggaacatatggtctccattttacagttaaggaatataatggacagattaatattgttctctgtcatgcccacaatccctttctaaggaagactgccctactatagcagtttt

SEQ ID NO: 7180 - DNA, 214 bp, Homo sapiens
gcacgggggaggtcatgagaaacgtggattacacccccttgtaaattcctattttcacaagataatatattgtaagccggtcatgagattatatgtggtaaagttaattgactaacaaccccagggtctctctcccccatataaacccctcattttgtaagctcagggctgccacctccgactggtggagaagcctggcaggttaataaactta

SEQ ID NO: 7181 - DNA, 409 bp, Homo sapiens
  misc_feature 159: n = A,T,C or G
taacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcanagtggtaattgtataaaattgctattgcagctttatattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctg

SEQ ID NO: 7182 - DNA, 194 bp, Homo sapiens
gccgtcagcatttggtgtgaagaagagaaaacgaggacccaagaagcagaaggagaacaagccaggaaaaccccgaaaacgcaagaagcgtgacagtgaggaggaatttggttctgagcgagatgagtaccgggagaagtcagagagtgggggcagtgaatatggaaccggaccgggtcggaaacgaagaagga

SEQ ID NO: 7183 - DNA, 394 bp, Homo sapiens
aagtcggaatccggaagaagatccgaacatgacgtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcactgtcaggaagaggaccctgtcccccagcactgggcttcacctagaacttcagtgggggccaagggtgctgagaacccagcaatgaccaggaagatacagtcactaacttcatctgtccccgtgccccttcccaggtcctgcctccacaggtttaacccagaacaataaacctgg

SEQ ID NO: 7184 - DNA, 191 bp, Homo sapiens
cgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcat

SEQ ID NO: 7185 - DNA, 265 bp, Homo sapiens
gttgaagagtcactttcctcaaccatttttttgtactgggcctttaaaaaaataaatccatccaactttaacacaacatttctcagtgtagaaatcatgtcttcttaattgctgaaccttactgcaaaaacttgtgatgtaagaaatttgtatggtgtggcagtggtctattcctaaggaactaaatatcatatagttaatgtttatttaactcagcttgagactgtactacagttaggtttgaataaatattttcattaacttc

SEQ ID NO: 7186 - DNA, 439 bp, Homo sapiens
acaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtg

SEQ ID NO: 7187 - DNA, 439 bp, Homo sapiens
cgatggccgggatcctggagcactcggtcatgtacccggtggactcggtgaagacacgaatgcagagtttgagtccagatcccaaagcccagtacacaagtgtctacggagccctcaagaaaatcatgcggaccgaaggcttctggaggcccttgcgaggcgtcaacgtcatgatcatgggtgcagggccagcccatgccatgtattttgcctgctatgaaaacatgaaaaggactttaaatgacgttttccaccaccaaggaaacagccacctagccaacggtattttgaaagcgtttgtctggagttagaaagttctcttcttcaacacgtccctccccagggtgttcctccctgtgacccagccgcctcgacttcggcccgcttgctcacgaataaagaactcagagttgtgtgtgcaatgcacacccagacacac

SEQ ID NO: 7188 - DNA, 380 bp, Homo sapiens
ctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggagggagataagaagagaaagggccaagtgatccagttctaagtgtcatcttttattatgaagacaataaaatctttgagtttatgttc

SEQ ID NO: 7189 - DNA, 417 bp, Homo sapiens
gtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttttctcccttgccatatactttgtgataaatccttatctcattttcagtacttcattaaacattgcagaaaaaaatattccttaaggtcttaattgatttaaagaagtagctattctgaattgaaatctcctttcattgaactggatgaaaaaatcatg

SEQ ID NO: 7190 - DNA, 436 bp, Homo sapiens
cttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggattttagagggaaagatcattgtagatgaactgaagcaagaagttatcagtaccagcagcaaggcagaaccaccccagtgcacctccctggcctggtctgctgatggccaga

SEQ ID NO: 7191 - DNA, 358 bp, Homo sapiens
aattaatgcccctctcttacagaacactcctatttgtacctcaacaaatgcaaattttccccgtttgccctacgccccttttggtacacctggaggttgatttcctttttcatcgatggtactatttcttagtgttttaaattggaacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccacctaaaaatgtctgaatgcttacacaaataaattttat

SEQ ID NO: 7192 - DNA, 439 bp, Homo sapiens
tcccatgatgaattgcttgacttagcaaagtttcatttcggtgactctttatgcacacacaaaggagaaataccagctctgcctccctgcaaattcacaggaagtgagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggatgcgactctgtacaagtgtcacag

SEQ ID NO: 7193 - DNA, 437 bp, Homo sapiens
ggacaacatgctggtgcaaacaaacaaaccctacaaatgcaacttgtgtgacaaaacattctccactcccaatgaggttgttaaacattcatgccaaaaccagaactcggatgtttttgccctagacgaagggcgatccattctcctgggcagtggggactcggaagtaacggagcctgaccacccagtgttagcttccatcaaaaaggaacaagaaaccgtcttactagactgaatgtcacttatctttttaaaaaactctcatttttacaaagactatcttccctcccttccctgaattcagaactgtagttctccatggcatgatacaaacaggtccttgttctcttctcctcttccccttttccacatcccagccccacctctgtaaaggctttgtgcattataaacctggaatgtatcgactttctttcagg

SEQ ID NO: 7194 - DNA, 311 bp, Homo sapiens
  misc_feature 115, 166, 222, 233, 278, 301, 307: n = A,T,C or G
cggcagagaggatcacagagttctgccaccgcttcctggagggcaaaatcaagccccacctgatgagccaggagctgccggaggactgggacaagcagcctgtcaaggtgcttgntgggaagaactttgaagacgtggcttttgatgagaaaaaaaacgtctttgnggagctctatgccccatggtgtggtcactgcaaacagttggctcccatttgggatnaactgggaganacgtacaaggaccatgagaacatcgtcatcgccaagatggactcnactgccaacgaggtggaggccgncaaagngcac

SEQ ID NO: 7195 - DNA, 438 bp, Homo sapiens
ctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcc

SEQ ID NO: 7196 - DNA, 439 bp, Homo sapiens
  misc_feature 19, 71, 115, 222, 234, 323, 365, 423, 430, 432: n = A,T,C or G
gaaaaaaaaaagatttgcnccatcatatccgagtctttactaataaaatgaggctgcttaagtacccaagnggagcaagggaagagttactacagttactgtaagtctgagttanaaaaaatacagagcatctagttattgagcaaagcccccttttacctgttcgcttattcaaagagaaacaatagaatttgcttctcagtacatgtttttaaaattganaatctctgatgngacaaaatcaatttttacaaaagttgaattaaaaacttttaaaaattgcttgtctttgggggtatgtctacatattcgtttaaatttanaaattcccacatgtttaagatatatgcccatcccctttttanagtaatcaaaatttctatcacagttcacatactggaatacatagtaaaattgagatgngtccaananattttca

SEQ ID NO: 7197 - DNA, 437 bp, Homo sapiens
  misc_feature 374: n = A,T,C or G
caacaatgataagttatttcatctagttaacacatatataaatgtatctttttataatttagctagccacagtaagacaaatattaagataatcaatgtctctatggatacttttcacatgatttaaactcacatcaatataaacaatatttctaaataaggaagccatcctctactctcttccgtgtgaccacagtatcaaatgcataatgagaatgaaaaaaaatatgttgctttaataatttcagtgtatgttcccatacctccttaacaacacacttacaatatctgtatccaaaagctactacctgatagaaataaccaagatgttcctcctcacttcattccaaattcatgttaatttagtagtcagnggtgatactccttccctctctgcttttatttataacaactagcttttgtttaaatggctcatg

SEQ ID NO: 7198 - DNA, 406 bp, Homo sapiens
cggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtatccgggcattgccgacaggatgcagaaggagatcaccgccctggcgcccagcaccatgaagatcaagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggt

SEQ ID NO: 7199 - DNA, 435 bp, Homo sapiens
atggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatggatacaggtgtgctgagtgagctgtgctgc

SEQ ID NO: 7200 - DNA, 299 bp, Homo sapiens
ctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaaccccc

SEQ ID NO: 7201 - DNA, 136 bp, Homo sapiens
ctttaattttgtaattctttactgtggaatagctcagaatgtcagttctgttttaagtaacagaattgataactgagcaaggaaacgtaatttggattataaaattcttgctttaataaaaattccttaaacagtg

SEQ ID NO: 7202 - DNA, 281 bp, Homo sapiens
cggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccatttt

SEQ ID NO: 7203 - DNA, 341 bp, Homo sapiens
ggcaagtttactacggaggcatagagcacgagatccgcaaggacgtctggccctttctgcttggccactacaagttcggcatgagcaagaaggagatggagcaggtgaggggagcctgttcccatggggctgagatggggagctgggccaggggacgccagggaggggaccttggaagcctcagccccttcccagccggaaagaagcatggcagggcagctccaccgtccttaccctgaggcccgtcttgagtctgagactcaggacccaaggtccagtgcaggcccagctcctgaaggggagggcctggtgcacgcttcccccatggtcgtggtgtggtc

SEQ ID NO: 7204 - DNA, 436 bp, Homo sapiens
aacagtacttcataataagaatcttttatagcaatctacagttatttatctactatcctaagaaatatatataaattttatgagatttttcttgtcattttaaatattttatgtatttcaatgtaaacttatttccttaaatgatgccaatatataatctagcccattgaaactgataaacaaatagataaggttgaaaaaagttctggtttatatagctaatcacaaaagaaaggaaatgctgtattagagatctcttttgtctgttctctggtatcttgtcactataaccttcacaccatctatcacattgttctgtttcatgttttgccccatttttccttttaacaataacaataacaccaaagggcaagcgggcaaagttatgtatactctgtttcttggcttttgaccacaaaaaactggtaccatagtc

SEQ ID NO: 7205 - DNA, 176 bp, Homo sapiens
ggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatg

SEQ ID NO: 7206 - DNA, 439 bp, Homo sapiens
cgggtgctgctgtgtcgctccagtgagtcacccctttagcgtcctcctgggctctgggtgctgggtaaagtcctgggacatctcgttttctttagctttctcatttatcccacagacttttgcggagtattggctgtatgtagcacgcgctgctgggtgttaagaaagacttggaatacatagcccttatcctcaagggaatcgcagtctaattgggagacagatgcataaagtgatcactacagtctctgggataaggaaacagttgaaatgttcacccactttttaaggctgccagcaatgatcgtgcaagagagaaaaaatgagaccgggcgcggtggctcacacctgtaatcccagcgttttcggaggtcgaggcgggtggatcacttgaggccgggagttggacaccagcctggccaacatggtgaaaccccgt

SEQ ID NO: 7207 - DNA, 437 bp, Homo sapiens
aaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatggg

SEQ ID NO: 7208 - DNA, 100 bp, Homo sapiens
  misc_feature 86: n = A,T,C or G
aaactatccaacccttacattaaacagacctccaaccctacactacatctggggaagtctttaatatccatgatttttttttttcngggggaaactcttt

SEQ ID NO: 7209 - DNA, 438 bp, Homo sapiens
acatctcctcatgtaattcaggcagttatgggagccctagagggcctgagagttgctattggaccatgtagaatgttgcaatattgtttacagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttggtttttgatgttaaacagtaaatgcca

SEQ ID NO: 7210 - DNA, 443 bp, Homo sapiens
  misc_feature 225: n = A,T,C or G
gccatttggtgggcctgtcctgctgaccagcaagtctctgtactgaatttggtgactttgatcttatgattcatgtttcccagcgaggtactctgtgtctttgctatgaataatgtgttattcaagggctagttggaagattgcatatataaattgaaaacattttgtctaaaaaggggtgtatagagagaaagaaaatttcagccagagagaattcttttttcngtcttgagacagggtcttgctctggagtgcagcggtgctatcatagctaactgcagccttgacctctcaggctcaagcaatcctcccgcctcagcctcccgagtagctgagactacaggtgtgcaccaccatgcccataaattttttgtaaggacagggtctttcttagttgccccaggctgatctcaaactcctgggctcaaccagtcctcccttcc

SEQ ID NO: 7211 - DNA, 211 bp, Homo sapiens
tctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataactt

SEQ ID NO: 7212 - DNA, 135 bp, Homo sapiens
cttagctctctacatacctatcatgtgccctgtatcacagaagattcaggaaaaatgcacttgggaatcaaagaaaatggaacttctttttgaaaagacaagcaaccatgttaactgtattgacacatcctcaat

SEQ ID NO: 7213 - DNA, 250 bp, Homo sapiens
ctttggtgctgtagaaaacaaaaaaagaaaaatatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccatctgactctaattttatgagaattgcagaactctgatggcaataaatatatgtattatgaaaaaataaagt

SEQ ID NO: 7214 - DNA, 170 bp, Homo sapiens
ccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaacta

SEQ ID NO: 7215 - DNA, 338 bp, Homo sapiens
gaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcat

SEQ ID NO: 7216 - DNA, 142 bp, Homo sapiens
ctgcctttggccctgcctggcccagcctgcacccctgtggggtggaaatgtactgcaggctctgggtcaggttctgctcctttatgggacccgacatttttcagctctttgctattgaaataataaaccaccctgttctgtg

SEQ ID NO: 7217 - DNA, 281 bp, Homo sapiens
cttcgggagacatgttgagatttgaccgtaatgaaagccacattttcctgaattatgatggtctgcattagtctcatgtgaaaggggaatgtggaagctcagggttaatgtagtggttgttttggtttttatttgctcaattttgtctgtactcatgtcattcagaaacctgaagtgtggctgcatcttgctgctaatgtgtgatgttgacgcctaactgaatttgaacagctcaccactgtgcctacatttaaaaatacttctctctcttttctaaaaag

SEQ ID NO: 7218 - DNA, 415 bp, Homo sapiens
ctcagtttggagtttttggtttctatttgttagtgtagaaagaaaatagtcttaacttctactttgagattatagatagcagaaaacagttctatattaattttcccacatattccctttggttctggttttatacaagtataatgggaaatactgaaatacagcaagttgacaatccattttggaacacttagataccttgaataattattgagatctgtgggttattacctgtactgagtcttttgagattcatccacttctattttccatttaaaggggaccttggtcctatgacttcagaaaggacaagccccaaggtcccagctgtgttccccttttatctcctaatctagtcatctcacttacccctaaggtcatatatcttttgctgttctctgttgcatgaagtagc

SEQ ID NO: 7219 - DNA, 234 bp, Homo sapiens
caacatggaacgtgattaatcggacagacttactggtttaaaaagtatattatcaaatgcgtggctctgtgtttattttcactagattcagagaaaatgtgagagctggtaaaaccgttgttggaaaagctatatgtacttttctccatccacagaattgaatcacgctaacttccaaatgtaaaaacaatataagtttcatgaattataacatgggaaaaataaattatgagg

SEQ ID NO: 7220 - DNA, 436 bp, Homo sapiens
atggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttt

SEQ ID NO: 7221 - DNA, 426 bp, Homo sapiens
aacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccc

SEQ ID NO: 7222 - DNA, 436 bp, Homo sapiens
cttcactgtgatcgaccagaaccgtgatggtattatagacaaggaggaccttcgggacaccttcgcagccatgggccgcctcaatgtgaagaatgaggagttggatgccatgatgaaggaagccagcggtcccatcaacttcaccgtcttcctgaccatgttcggggagaagctcaagggtgccgaccctgaggatgtgatcaccggagccttcaaggtcttggaccctgagggaaagggcaccatcaagaagaagttcctggaggagctgctgaccacgcagtgtgaccgcttctcccaggaggagatcaagaacatgtgggcggccttcccccccgacgtgggcggcaacgtcgactacaaaaacatctgctacgtcatcacgcacggcgacgccaaggaccaggagtaggggcacccgcgggcctccgctgcc

SEQ ID NO: 7223 - DNA, 378 bp, Homo sapiens
ctctgttgctgaggaggagcaagtctataagcagccctggaagcattccatcttcctttgcttgtgacaacagccataaaactctcattttcccttgcacggctgctatctaaagtctcaccgctcacccaattctctgctcacaaacagactgacggggcccatttgcattctgaagtgcagctcccctgagtcccctgtccctccaggcaggtattattagtccccttgttttgttgggtgactctgaatgggagcctgtttacgggctgggttcctaatagaaggcttcggttccctcctaataatctatcccctggtgggttttatttccaaagtacagcagtacagaacctgccctcttgggagtttattggg

SEQ ID NO: 7224 - DNA, 383 bp, Homo sapiens
catgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggattttgggtcgtggacgtggtcagccacctcagtaaaattgggagagg

SEQ ID NO: 7225 - DNA, 415 bp, Homo sapiens
ctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgt

SEQ ID NO: 7226 - DNA, 417 bp, Homo sapiens
aggaggttgatcaacatcaccccagggcctgtcagggtgtcaggggctaggggagggatagcattaggagaaatacctaatgtagatgatggattgatgggtgcagcaaaccaccatggcacgtgtatacctatgtaacaaaccagcacattctgcacatgtaccccagaacttaaaataaaatttaaaaaaaagaaagagtagaatgatggataccagaggccgggagggcactcaaaatacgtacgactattatatatcaattatgaatttaatgcattaaaaataagcctgctggattggaaatgtcagttcatgtagattttatgtttgtatccccaaactgcctaaactcatcaaacttttgatcagtcagtagaattaaataaatttggaaaccatattgcccaataaggg

SEQ ID NO: 7227 - DNA, 165 bp, Homo sapiens
  misc_feature 26, 163: n = A,T,C or G
atttttaatttctaaggttggaatanaacttattctcaaaattcctttagggttattaaatattttcatttattagtcaaaggtaagttaattaagcttgtttaatgatgccaatcttatgcttttctgtaatcttcaatttttaataaatgtgagttagatnct

SEQ ID NO: 7228 - DNA, 439 bp, Homo sapiens
caagtctgggacacggctggccaagagcggttcaagacaataactactgcctactaccgtggagccatgggcattatcctagtatacgacatcacggatgagaaatctttcgagaatattcagaactggatgaaaagcatcaaggagaatgcctcggctggggtggagcgcctcttgctggggaacaaatgtgacatggaggccaagaggaaggtgcagaaggagcaggccgataagttggctcgagagcatggaatccgatttttcgaaactagtgctaaatccagtatgaatgtggatgaggcttttagttccctggcccgggacatcttgctcaagtcaggaggccggagatcaggaaacggcaacaagcctcccagtactgacctgaaaacttgtgacaagaagaacaccaacaagtgctccctgggctgaggac

SEQ ID NO: 7229 - DNA, 435 bp, Homo sapiens
ctctcctggtgaacaaggtccctctggagcctctggtcctgctggtccccgaggtccccctggctctgctggtgctcctggcaaagatggactcaacggtctccctggccccattgggccccctggtcctcgcggtcgcactggtgatgctggtcctgttggtccccccggccctcctggacctcctggtccccctggtcctcccagcgctggtttcgacttcagcttcctgccccagccacctcaagagaaggctcacgatggtggccgctactaccgggctgatgatgccaatgtggttcgtgaccgtgacctcgaggtggacaccaccctcaagagcctgagccagcagatcgagaacatccggagcccagagggcagccgcaagaaccccgcccgcacctgccgtgacctcaagatgtgccactctgactg

SEQ ID NO: 7230 - DNA, 193 bp, Homo sapiens
atttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacac

SEQ ID NO: 7231 - DNA, 137 bp, Homo sapiens
ctcgtgccgaattcgggcacgaggcgtgagccaccttgcccagcccacatcatacagtttgaaatgaaactttgccacaaccagcctttgctgtagcacacacatatatcactgaacctgtttgaaataaagttttt

SEQ ID NO: 7232 - DNA, 405 bp, Homo sapiens
  misc_feature 78, 368: n = A,T,C or G
tggagacgacgtgcagaaatggcacctcgaaaggggaaggaaaagaaggaagaacaggtcatcagcctcggacctcangtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcanagccctttgcccgctcgggtatgaagatcgggcggat

SEQ ID NO: 7233 - DNA, 249 bp, Homo sapiens
cctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgat

SEQ ID NO: 7234 - DNA, 434 bp, Homo sapiens
gttttctgcaacatggagactggcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagac

SEQ ID NO: 7235 - DNA, 436 bp, Homo sapiens
gttgacatttgctatgccaggtactttctgtgtattttctttcagaagttccaggcatggcaaggtggcttacgcctgtaattctagcattttgggagactgaggtaggcggatcacctgaggtcaggagtttgagaccagcctggccaacatggcaaaaccccgtctctactaaaaatataaaaattagccggaggtggtggtgcatgcctgtaatcccagctacttgaaaggctgaggcaggaaaatcgcttgaatccaggaggcagagagttcagtgggccaagactgtgccactgcactccagcctgggtgacagagtgagactctacctcaaacaaacaaacagacaaacaaaaaagaagttccatgtcatataaattatcagttgtttcacagatgaggaaactgaaccttaaagtgattaagttgcttc

SEQ ID NO: 7236 - DNA, 437 bp, Homo sapiens
gaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttctt

SEQ ID NO: 7237 - DNA, 436 bp, Homo sapiens
cgggagccgcggcttatggtgcagacatggccaagtccaagaaccacaccacacacaaccagtcccgaaaatggcacagaaatggtatcaagaaaccccgatcacaaagatacgaatctctttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggcccaaggccaaggatcaaaccaag

SEQ ID NO: 7238 - DNA, 303 bp, Homo sapiens
tcgccctggactcgcatcccactattgtcagcctgcatcaccagagacccgggcagaaccaggcgtccaggacgccgctgaccaccctcaacacggatatcagcatcctgtccttgcaggcttctgaattcccttctgagttaatgtcaaatgacagcaaagcactgtgtggctgaataagcggtgttcatgatttcttttattctttgcacaacaacaacaacaacaaattcacggaatcttttaagtgctgaacttatttttcaaccatttcacaaggaggacaagttgaatggacctttt

SEQ ID NO: 7239 - DNA, 430 bp, Homo sapiens
ctccgtcattaccataggggacttggttttagactctgatgaggaagaaaatggccagggggaaggaaaggtgagtgggaaggagcagaaagctgggaaaggggatgggtagaacaagactgagaaatccacatgcttcagaattcagagggttcagggaatggtttcggatagtaggctctccctgctcccttctctacaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagttttagtagggaattggaagtggaagtccaggcttgg

SEQ ID NO: 7240 - DNA, 437 bp, Homo sapiens
gaaaggctggccagtcaggcggccaccaccatgtgcgagcgtggatttgaaaacctcttcatgctttccggaggtctaaaagtcttagctcagaaattcccggaaggactgattactggttccctgccagcatcttgccagcaggcccttcctcctgggtctgcccggaaacgatccagccccaaagggccacccctaccagctgagaataaatggagatttaccccagaagacttaaaaaagatagaatattatctggaagaggagcaagggcctgcagatcatcctagccgactgaaccaagctaactcctccggaagagagtccaaggtgcctggtgcccgaagcgctcagaatctgccaggtggcggccccgccagccactcaaacccccgctccctcagcagtggtcacctgcaaggcaaaccctggaagta

SEQ ID NO: 7241 - DNA, 108 bp, Homo sapiens; identical to SEQ ID NO: 7172

SEQ ID NO: 7242 - DNA, 251 bp, Homo sapiens
ggatgaggaaggggaagaagaaggagatgaggaaaatgatccagactatgacccaaagaaggatcaaaacccagcagagtgcaagcagcagtgaagcaggatgtatgtggccttgaggataacctgcactggtctaccttctgcttccctggaaaggatgaatttacatcatttgacaagcctattttcaagttatttgttgtttgtttgcttgtttttgtttttgcagctaaaataaaaatttcaaatac

SEQ ID NO: 7243 - DNA, 370 bp, Homo sapiens
  misc_feature 122, 203, 301, 309: n = A,T,C or G
gtttgaggctgcagtgagctatgagggtgcctctgtgctccatcctaggcaacagagtgagacgctgtttaaaaaggaaaaaatccttccctagagctagtatcctaaagctgcagagctancccagacctcattggtttccttgtccttggggtgcttttcctgaatctttgggggtgaagggagtgttgctcccagtccanaggcctgattctgttcggactgggttctcaagacacgaccaggttctcaagacaggagtccccttgttcctccccattaaagggggtttgtcataagnaagaacancccctctccccagtcacagcctgaagggaggccccgagagcttcctccttccccccacctg

SEQ ID NO: 7244 - DNA, 416 bp, Homo sapiens
tcactttgtataactggaagccttctgtgaaattttagttttcaaagcattatctggtgatgggcaacccagggcagcgaatcattcagaattttcttatctaggctaataaacataataaaatcaataaggactttgaaagtaactccactgggttcaggaaactgagtgtggccgccctgtggggtggtgtttggtgagtgcttcccggaggtgagtagttaattcacaggagtgactaatggcagcgtcccactcactcctccttccggggtcatggtctcaaggggtcactccatgcactggggatgtcagctcattacagaatgatatattcgggaagtgtctcagttctgagtgcctttgagggaatttgcacttccgttcccacacagccttgcattgtgtgtgttaga

SEQ ID NO: 7245 - DNA, 439 bp, Homo sapiens
cagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggca

SEQ ID NO: 7246 - DNA, 341 bp, Homo sapiens
cctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaat

SEQ ID NO: 7247 - DNA, 434 bp, Homo sapiens
actggtgagacctgcgtgtaccccactcagcccagtgtggcccagaagaactggtacatcagcaagaaccccaaggacaagaggcatgtctggttcggcgagagcatgaccgatggattccagttcgagtatggcggccagggctccgaccctgccgatgtggccatccagctgaccttcctgcgcctgatgtccaccgaggcctcccagaacatcacctaccactgcaagaacagcgtggcctacatggaccagcagactggcaacctcaagaaggccctgctcctccagggctccaacgagatcgagatccgcgccgagggcaacagccgcttcacctacagcgtcactgtcgatggctgcacgagtcacaccggagcctggggcaagacagtgattgaatacaaaaccaccaagacctcccgcctgcccat

SEQ ID NO: 7248 - DNA, 363 bp, Homo sapiens
cgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaagg

SEQ ID NO: 7249 - DNA, 281 bp, Homo sapiens
atttatcctgggctttatgtacctctggtttgagggactcttgaacttcattttaagaaacatggcccaatgagtacacagtcaagtcttcatgtccctgaacactgcattacaaaatcagcactccttgttctttgtatatttgtgttatcaaataactatgtgattataatctggcttctcatataccataagtgcagaagagaatcaaaagattgagtacctgattccctaaactgtcaaatttcccgttgtatattaataaaatttgtatcgtttca

SEQ ID NO: 7250 - DNA, 238 bp, Homo sapiens
cggtctcagaactgtttgtttcaattggccatttaagtttagtagtaaaagactggttaatgataacaatgcatcgtaaaaccttcagaaggaaaggagaatgttttgagggaccactttggttttcttttttgcgtgtggcagttttaagttattagtttttaaaatcagtactttttaatggaaacaacttgaccaaaaatttgtcacagaattttgagacccattaaaaaagtta

SEQ ID NO: 7251 - DNA, 386 bp, Homo sapiens
ctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaat

SEQ ID NO: 7252 - DNA, 128 bp, Homo sapiens
cacacacatgcttccctttcctgagtcccatccctgcgtgattttgggggtgaagagtgggttgtgaggtgggccccatgttaacccctccactctttctttcaataaaacgcagttgcaaacacctg

SEQ ID NO: 7253 - DNA, 190 bp, Homo sapiens
  misc_feature 3, 28, 29, 33, 36, 38, 93, 94, 123: n = A,T,C or G
tcnaaaagggggacactagtggatccanntacntcngnacggagattatgctaaatctactctgcctctgctctataaatggaacactgcaannctggatgaccacatatgtgtgtgcagcgnggtttcctgaatattttaagcccactgttgagacctgctcagaaaaaaggattccttttaaaacatt

SEQ ID NO: 7254 - DNA, 437 bp, Homo sapiens
  misc_feature 44, 407: n = A,T,C or G
ccgctccggctgcaccgcgctcgctccgagtttcaggctcgtgntaacctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccanaaagagtaaaaccttttatgacaggggctg

SEQ ID NO: 7255 - DNA, 381 bp, Homo sapiens
  misc_feature 328: n = A,T,C or G
gaaagggagcgaggacagcgctggttcccggctccccgcaccatcatggctttgcctctgaggcccctgacccggggcttggccagcgctgccaaaggaggccacggaggagcaggagctcgtacctggcgtctgctgaccttcgtgctggcgctgcccagcgtggccctctgcaccttcaactcctatctccactcgggccaccgcccgcgccccgagttccgtccctaccaacacctccgcatccgcaccaagccctacccctggggggacggcaaccacactctgttccacaatagccacgtgaaccctctgcccacgggctacnaacacccctgaggccccggacgcccccggacacaataaaggtgtgaagcttcg

SEQ ID NO: 7256 - DNA, 440 bp, Homo sapiens
gggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgca

SEQ ID NO: 7257 - DNA, 146 bp, Homo sapiens
  misc_feature 111, 128: n = A,T,C or G
tgcgtttgcatttttataatcaaaagcttaatatattcccatcttttttagttaaccctttcttgactctgagtgctgtgaatttctttactgatttctctattctccggngagaaacaattaaatgngatttaacgtaagcagtg

SEQ ID NO: 7258 - DNA, 387 bp, Homo sapiens
ccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatt

SEQ ID NO: 7259 - DNA, 332 bp, Homo sapiens
  misc_feature 111, 290: n = A,T,C or G
cgcttgccaagatggttgaatcccaagatgtaaaaatctgatggttaaaccatcggaggagaaactctagactgcaagaactgtttttacccatggcatgggtggaattanagtggaataaggatgttaacttggttctcagactctttcttcactacgtgttcacaggctgctaatattaaacctttcagtactcttattaggatacaagctgggaacttctaaacacttcattctttatatatggacagctttattttaaatgtggtttttgatgcctttttttaagngggtttttatgaactgcatccaagacttcaatcctgattagt

SEQ ID NO: 7260 - DNA, 251 bp, Homo sapiens
  misc_feature 49: n = A,T,C or G
atttaggacagtcatgtctgcttacaggtgttatttgtctgttaaaacnagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaaggagag

SEQ ID NO: 7261 - DNA, 184 bp, Homo sapiens
agaaaacgctgactttctttttaagtgtggcacataaggatctgcagaattttccgtagacaaagaaaggatcttgtgtatttttgtccatatccaatgttatatgaactaattgtattgttttatactgtgaccacaaatattatgcaatgcaccatttgttttttatttcattaaaggaagt

SEQ ID NO: 7262 - DNA, 394 bp, Homo sapiens
cccatttcagaagccccccggcctctcctgggcgggctgtaagtctccaggctttgcatccgtgtgcctgtgtctcacgcagaaggccctcacaagcgaaaacggggccacagggtggcgtaagcaggcagcagggactcaggggacattgaggcaggcagaagaggagaagcggcgagaccgcagggaatgctgggagccgcccaaaaggactctatgatccaaaaagcacccagagctgtttgggttcggctgtaaagccccaaccgttggaacagggtgcctgtgtctctcgcggagggcccccacaggcaaaacgggcccgcagggtggcgtgggcaggccacagtgactcagggtgacattgtcgcaggcagaaaggagaagtggcagg

SEQ ID NO: 7263 - DNA, 430 bp, Homo sapiens
gttgcattaaaacttatagtatgtacattccagtctcttcttagagaagaggaggtggcctgtcgatatctaatgaaaaataacatttaggaaactctcaacagtactggatgttttatttgtagagttataattttgaaacacataaggagccagcagtaaaatgaaagtttataccttttagtgttaatcttattttggctttttgttttgcaaaacaaactgcacatagttatataggggtatatattaagttttcattttttcttgtttggaaaaaaatactaatctttttcatttaggtttcttttttaattgatgccaaagagttccaatattgaacatcttaagtctgttacttggattacggattgagtttggagcttactcagaggactacaggagagtatccaggaagtagcaagaaatg

SEQ ID NO: 7264 - DNA, 413 bp, Homo sapiens
  misc_feature 318: n = A,T,C or G
gtaagatcagaataataatatttggtttgtctatcgtacaagattcctgtatcgtttgaatattgcttttaaagaaatatttgaagcgacttcaaattcagactgtgtttaaaaagatttaaaatcggaatccaaaatcaaagtattaaaaaataatgctgagtgtttaggattcacatacctctgagctctggtggcttttgccagtcctgtccctctgctgagcaccagcccttcatgcagcagtcctgccggtgtgtttctgtgcacctggggatgaagtgtgctcctcccccagcggttagcctcaatgctttncctccctctgttttattatttgaaattagccaaagaaaagctgcagggggcactgctgatcatcactggactggtgggtcgtactgtttgacaga

SEQ ID NO: 7265 - DNA, 108 bp, Homo sapiens; identical to SEQ ID NO: 7172

SEQ ID NO: 7266 - DNA, 439 bp, Homo sapiens
cggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctgg

SEQ ID NO: 7267 - DNA, 436 bp, Homo sapiens
aaatgatctatcccctccagtgtcttttaacttaatgttcaagactttcattgggcctggaggaaacatgcctgggtacttgagaccagaaactgcacaggggattttcttgaatttcaaacgacttttggagttcaaccaaggaaagttgccttttgctgctgcccagattggaaattcttttagaaatgagatctcccctcgatctggactgatcagagtcagagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacagggtgtgattaataacacagtattaggctatttcattggccgcatctac

SEQ ID NO: 7268 - DNA, 116 bp, Homo sapiens
ggggccttcgtgtccgaggccagcacaccaagaccactggccgccgtggccgcaccgtgggtgtgtccaagaagaaataagtctgtaggccttgtctgttaataaatagtttatat

SEQ ID NO: 7269 - DNA, 366 bp, Homo sapiens
ggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttcccccttgcagg

SEQ ID NO: 7270 - DNA, 436 bp, Homo sapiens
ggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcag

SEQ ID NO: 7271 - DNA, 346 bp, Homo sapiens
tgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacacc

SEQ ID NO: 7272 - DNA, 340 bp, Homo sapiens
  misc_feature 44, 46: n = A,T,C or G
attatttgtttcttcagacaagcaaatcatttggtcagagttcntntaacctgtctgttccctggagatgggaatagaggatgatgacagtttattttctacacttcccctccttccacatttgtatcacctttgctatcttggggaaagtgcaaaggacaaacatctcaattgtatgaagggagaaaggagaattgaaagaagaactggggttgttagagctgagatgactgtacacatacccctgcccaatttatatagctctttgtggagataattaggggtgggagcagtttgaaggagtaagcctggttttatacttttaaataaagtgttttta

SEQ ID NO: 7273 - DNA, 184 bp, Homo sapiens
  misc_feature 50: n = A,T,C or G
gtgaaaccccgtctctaccacaaaatacaaaaattagccaggcatggtgntgcacaccctgtaatcgcagctactcaggaggctgagacaggagaatcgcttgaacccaggaggtggaggttgcagcgagccaagatggtgccactgcactccagcctggatgacagagcaagaccctatctca

SEQ ID NO: 7274 - DNA, 456 bp, Homo sapiens
  misc_feature 44, 48: n = A,T,C or G
cgggaacatcctcctggactcagtcatggcttgtggtctggtcnccancaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggccccca

SEQ ID NO: 7275 - DNA, 268 bp, Homo sapiens
gtgcctgtaggggccgcctgggtagcgggaggtggttcatgagtaccaggaaagctggccctggggcagacctgggcagggcagagcacagcttgcaggacctagtacacagtgttgggaattgaatttgggttttgacctttgaagctgtgcataaagtctaaaacaagaagaggagtggaggctggggttgtatttgtattttaaaatgagcatttgccacacaaagccaggagcttcagaccagcgtggttaacacagcgagacc

SEQ ID NO: 7276 - DNA, 417 bp, Homo sapiens
  misc_feature 127, 143, 239, 292, 376, 395, 405: n = A,T,C or G
gaaatttgaaaaaactttctctttgccatttcttcttcttcttttttaactgaaagctgaatccttccatttcttctgcacatctacttgcttaaattgtgggcaaaagagaaaaagaaggattgancagagcattgtgcaanacagtttcattaactccttcccccgctcccccaaaaatttgaattttttttttcaacactcttacacctgttatggaaaatgtcaacctttgtaanaaaaccaaaataaaaattgaaaaataaaaaccataaacatttgcaccacttgnggcttttgaatatcttccacagagggaagtttaaaacccaaacttccaaaggtttaaactacctcaaaacactttcccatgagngtgatccacattgttaggngctgacctanacagagatgaac

SEQ ID NO: 7277 - DNA, 439 bp, Homo sapiens
aacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttg

SEQ ID NO: 7278 - DNA, 461 bp, Homo sapiens
gccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaataga

SEQ ID NO: 7279 - DNA, 108 bp, Homo sapiens; identical to SEQ ID NO: 7172

SEQ ID NO: 7280 - DNA, 245 bp, Homo sapiens
caggtacgaaaccatcaatggacaacttgaaaatgcatgttcctcaggcctatgcagttcccagagactcttgacaccggtctctgctgaggctcccagcctcagtttcccccacagcagcacgggccccactgtgctgctcttcaggtccccacagccctgcctttggttcctggacatttggtattctgccctccactctggtactatcagagtagggcaggctctggattaaagcttttagc

SEQ ID NO: 7281 - DNA, 437 bp, Homo sapiens
gcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctg

SEQ ID NO: 7282 - DNA, 138 bp, Homo sapiens
tcacaaattttaccaaaaatcaaagctattcctcagctccagggctacctgcgatctgtgtttgctctgacgaatggaatttatcctcacaaattggtgttctaaatgtcttaagaacctaattaaatagctgactac

SEQ ID NO: 7283 - DNA, 449 bp, Homo sapiens
  misc_feature 24: n = A,T,C or G
aaaagagcccgcatcgccaagtcnatcctgagccaaaagaacaaagctggaggcatcacactacctgacttcaaactatactacaaggctacagttaccaaaacagcatggtactggtactaaaacagagatatagatcaatggaacagaacagagccctcagaaataacactgcatatctacaactgtctgatctttgacaaacctgagaaaaagaagcaatggggaaacgattccctatttaataaatggtgctgggaaaactggctagccgtatgtagaaaacagaccgtttctttctagcttttatctggggatattctgttttccccataggcctcaagaggttcctaaacatcccttcacagattctacaaaaataatgctccaaaactgctgaatcaaagggaagatttagctttatgagatgaattttcacatctcaggga

SEQ ID NO: 7284 - DNA, 434 bp, Homo sapiens
aaacatcaatctttaaaccaattgctgctacttatataattgccaaaaagtgaaataatgtgtagttcatgtaaataatacattatatttctattttattatgaagaaggtgaatagccatatttgtaaaatgacaatcatgtgtgttaacccagtgctttccattcgtgaaaacacatttgctttttgtgatatgcacaatgtagataagtgttctgtctgactttcttttttgatatagaagtataaagaattgtggtttatatatttaaaagtgtcaagctgagtattaaaatgtatgcatgttgtctaagaaattgaatactttgaatgtgtttcacagtttgaaataagctatttgatgtaatacttcttgtgtgtatgcacatgaacttagattttacatgaagtattttttcagtattatatgtacc

SEQ ID NO: 7285 - DNA, 437 bp, Homo sapiens
agaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttct

SEQ ID NO: 7286 - DNA, 459 bp, Homo sapiens
agagtcgcttctaagatgctccgagggaagccggcagtggccgccctgggtgacctgactgacctgcccacgtatgagcacatccagaccgccctgtcgagtaaggacgggcgcctgcccaggacgtaccggctcttccggtagaaccgctccccggcctgacagacccagggagctgcagctggagcccgttcccgtgcgtgttagtttggacacgaatttagtctaaaaagctgtctggttgtataaacggtgcaaacaatgtcgccacagcacccacgcggtttgcattcttttggaactcaatgtgccgatcagtggagtcagtatcgagcctgaccaccgcaagccaggaagcaggtgaagtgcccagcgctggagtgcagcgtgccacgaggagggcggtcggtgcttccctcctcgggctgtgggcacatggggccccgcaggttccttgga

SEQ ID NO: 7287 - DNA, 230 bp, Homo sapiens
tcaagattcagtaagatggcaaaaccaaatccaaggaaaataagaatcacaataaagtgatacaggagctgaaggatgaaatagctggtatcaaaaagaacctaacaggtctgacagagctgaataacacaatacaagaatttcacaatgtaatcacaagtattaacagcagaataaaccaaactgaggaaagaatctcagaacttgaagactggttctctgaaataaga

SEQ ID NO: 7288 - DNA, 255 bp, Homo sapiens
tgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccaatcgtggccctctggacaagtggcgggccctgcactcatgagggcttccaatgtgctgcccccctcttaatactcaccaataaattctacttcctgt

SEQ ID NO: 7289 - DNA, 500 bp, Homo sapiens
  misc_feature 18, 29, 31, 47, 51, 106, 107: n = A,T,C or G
caaagctggagctcgcgnttctccaagangnactagtggatccaaantttnccgcacgagggaagatttataggtagaggcgacaaacctaccgagcctggtgatnnctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcatt

SEQ ID NO: 7290 - DNA, 328 bp, Homo sapiens
gtttactgcacaggtgcatcacttcatggagttatgttgggataaatgtgtggagaagccagggaatcgcctagactctcgcactgaaaattgtctctccagctgtgtagaccgcttcattgacaccactcttgccatcaccagtcggtttgcccagattgtacagaaaggagggcagtaggccatcccccaggagaatgacagaagcaaaggacttgttactaagcagatttaagggtcagtgggggaaggctatcaacccattgtcagatcagcatcaggctgttatcaagtctgttggtgctaaaaagtaaaagatgaaatgttc

SEQ ID NO: 7291 - DNA, 218 bp, Homo sapiens
attttcggtgtttaaaaaatgagcccagttgctcaactgtttggttgaaaaccttgctcattttttaatgcgaaggctaagtgtcaccccctttctctgcctctggctgggccttgctaagggccaaggaaagaaagacattttttagggggcagccagtccaaatgccaaaagaagaccagttcttgccctgattgtatgaaatttgacattttggc

SEQ ID NO: 7292 - DNA, 440 bp, Homo sapiens
  misc_feature 112: n = A,T,C or G
ggccactgcgcagaccagacttcgctcgtactcgtgcgcctcgcttcgcttttcctccgcaaccatgtctgacaaacccgatatggctgagatcgagaaattcgataagtcnaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtgggg

SEQ ID NO: 7293 - DNA, 360 bp, Homo sapiens
ctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaac

SEQ ID NO: 7294 - DNA, 498 bp, Homo sapiens
  misc_feature 26, 29, 48, 49, 107: n = A,T,C or G
caaagctggagctcgcgttctcccangangacactagtggatccaaannttcccgcacgagcggcggttggggtggtggggccccgggcggcgttgaccatgactcngcacggcgcggcgctgcagaactacaacaacgagctggtcaagtgcatagaggagctgtgccagaagcgggaggagctgtgccggcagatccaggaggaggaggacgagaagcagcggctgcagaatgaggtgaggcagctgacagagaagctggcccgcgtcaacgagaacctggcacgcaagattgcctctcgcaacgagttcgaccggaccatcgcggagacggaggccgcctacctcaagatcctggagagctcccagactttgctcagcgttctcaagagggaagctgggaacctgaccaaggctacagccccagaccagaaaagtagcggcggcagggacagctgaccagaccacgggcagggcctgcctccgtgtgcccctcag

SEQ ID NO: 7295 - DNA, 353 bp, Homo sapiens
  misc_feature 17, 24, 51, 98, 104: n = A,T,C or G
tggagctcgcgttctcnaagaggngactagtggatccaaattttcccgaangagggggacatgggcacctcgggaggcccgggccctgcccagctacntttccncccctcagcttgaggaccaatgactgaggtctatgccagttcctgatcccatctcactctctggacctaccaggtgactgctgctgggtgactcccctgaggcggctatacccttaagccagccccactacttccttccctgcctcccagctcagtatttaaacatcatctcccttctctttctcgcataactccccacccctttctccccgatccacccaggcctttctgtaaataaaagctcccaag

SEQ ID NO: 7296 - DNA, 318 bp, Homo sapiens
gctgtatagcctgtgactctccgtgtgtcagctccttccacacctgattagaacattcataagccacatttagaaacagatttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggtcgtgtgag

SEQ ID NO: 7297 - DNA, 439 bp, Homo sapiens
ataaaaatagggctgattatatttttaggaaccatcctacagaggagaggatggggagaggcagctgcatcctcctctttactaaaccaatatagcttgatcaatttaccttacaacttgaacactaacgttacaacacaaaggggaaaaatcttgattcatgtatcaaaaccttggataattcactatttgagccctctcttgtcagatgcaatttcacagctttgtctgtaacataaaacaaaatcttgccttttgggctgatgaaatgagaattgtctcttttccttctctggatttgactgacgtggccaaagaaatgaagtttctgtcaggctaccttgaagagtgggtcagtcatctgtcttcaaggtcaaacctgtggcttcagagcggcttcccaaagtcctgtctgcctgctgcattctgggctttgcag

SEQ ID NO: 7298 - DNA, 440 bp, Homo sapiens
cagaaagctatttctgactgcatgttgaggaacccaataaactcaaggagggaggaaaaaaagagatatccaatgatctcagtaagccggccaggaaataattgatgcagccgggactgggcatcagcatatcacagggagcatttccaagatgcacatctagctcttacccctgacatcctacatagaaattccttgggttgaagatcatgcacccaagttttaaaatgtctttttagttaattctttttcaggcccttcattaacttctgctctaaggagctgtcccctaaaacactgtctaaaacaacaggtatgtctcttttgtcctttctgtatccccaaattcaaataaactaggatgcacaggttgtcaagtttttattttgtgagtgtatcatctgtgcctgtacctgggattccatcctgagccaggcaag

SEQ ID NO: 7299 - DNA, 439 bp, Homo sapiens
ccttgctgaagggtcaggaatgattaaagccacttttgggtgagttaaatgaagcactgagtagtgaaaggatgtgcccaaatattcatggaggcagggtcaaaaacccaggcctcccattcaccagtgtagacacagcccagtggatgcacctgcctatgtacctttggccaaccaacctcaaaggatttcttagataaataatcagtaaatgtctactattgttattgttattgcgttgtcgacacatatgacaacggcaatgcaatgttatcaataacgagcgtgtttctgctgttaataagttggaggaattgagtctttagttctttaactctcaaagcatcatcttgccttttttgttgtgaatctaatatagttttacagtattgctttgagtgaatctgtgaatagatgttttgttgaatgctcagctaag

SEQ ID NO: 7300 - DNA, 456 bp, Homo sapiens
aagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgctgggcag

SEQ ID NO: 7301 - DNA, 349 bp, Homo sapiens
  misc_feature 22, 27: n = A,T,C or G
gtcgcggcgacatggccaaacntaccnagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaac

SEQ ID NO: 7302 - DNA, 395 bp, Homo sapiens
  misc_feature 3, 19, 31, 78, 84: n = A,T,C or G
ggngactagtggatccaanttttccccaaangagccacattgttggagagacagctgcctttctatgccccaggctgnttgctnccacggggtgggaaggatggatccccaaagcctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatg

SEQ ID NO: 7303 - DNA, 489 bp, Homo sapiens
  misc_feature 3, 5, 48, 52, 62, 316, 321, 355: n = A,T,C or G
aangngcgtctgcatatctttattgaaaattttcttgtatttatggcntttntccccatttntataaatgttccatgagtgaatgagaatatgtactttctaattatttgttgcagttaaatattgacacacttgacaaatatgtgatcactttacttaccaatttcttcatgaagttctgactgtgcatagttgatattatgttcttaggtttagacaaaaactgttgtctatttctgaggagttgtatacttgaccctcatgtactgaatgtatttattcctaatgatacattttactgtatggtttattttgntgganggtaataataccatggtggctttcttctgattanaaaatgtctgctatatattttccttccttttatattaatatgtctatttccctatactatacacatgtttactctcaacatttttctgttataaaatatttcaatacgaatatctatgtctttttattggcatg

SEQ ID NO: 7304 - DNA, 416 bp, Homo sapiens
  misc_feature 43: n = A,T,C or G
ctggcttcttggcgcgatgaggttccggttctgtggtgatctngactgtcccgactgggtcctggcagaaatcagcacgctggccaagatgtcctctgtgaagttgcggctgctctgcagccaggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtg

SEQ ID NO: 7305 - DNA, 376 bp, Homo sapiens
  misc_feature 331: n = A,T,C or G
ggtccaaagcacattattaactggggattaatttcctagtagtcatctgtcgggagggctgatccaccccgaggcacattaactggcgtgactttcaggacggcggggctgtgggagccactggacacatctgccccccaacccctagcctcttgaattactcaagtccctcagctctgttggcacaaatacgtgctggatgatagaagaaccgtttttcccatggatgaactttttttggcttgaattcttacaaggcctgacttctggatctggagaaagaagacttctttgtgtcccatcttcaaaatgcctcctccacttgttgcanaagcctaaaattcctttagttggggcagaaagcctattattattt

SEQ ID NO: 7306 - DNA, 426 bp, Homo sapiens
  misc_feature 3, 29: n = A,T,C or G
cangtcgacactagtggatccaaagattncggcgaggaattcgtggccttccgggcattaaggggccccctggtgctcttggtttgaggggacctaaaggtgacttgggagaaaagggggagtacggtttctgtgagccagcctcctgcaccatgcaggctggtcagcgagcatttaacaaagggcctgacccttgaaaggcttactgctgcatggctgtctgcatgaaccacgcctggtgaaggagcctgggtgagaaacaccatccaaagctggggcaaagatgattaccttcagcatgattacaatgtattaccttcagtatgattacagaagtcctacttgacaatcacatatagaagaacggtgctattcagtaagttctctttcctttcccttggagggaagacagcagagtcatcagtt

SEQ ID NO: 7307 - DNA, 437 bp, Homo sapiens
gttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaag

SEQ ID NO: 7308 - DNA, 439 bp, Homo sapiens
cggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagattgctcacaatgtttcctccaagaaccgcaaagccatcgtggaaagagctgcccaactggccatcagagtcaccaaccccaatgccaggctgcgcagtgaagaaaatgagtag

SEQ ID NO: 7309 - DNA, 500 bp, Homo sapiens
  misc_feature 23, 30, 54, 104: n = A,T,C or G
caaagctggagctcgcgttctcnaagaggnactagtggatccaaattttcccgnacgagcttcattcgagatgagtttctgaggatcagcactgccagtggagntgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaaca

SEQ ID NO: 7310 - DNA, 458 bp, Homo sapiens
  misc_feature 49: n = A,T,C or G
atcacaagcctgtggggcaaggtgaatgtggaagatgctggaggagaanccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactggagtggccagtgccctgtcctccagataccactgagctcactgcccatgatgcagagctttcaaggataggctttattctgc

SEQ ID NO: 7311 - DNA, 355 bp, Homo sapiens
gccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagtt

SEQ ID NO: 7312 - DNA, 465 bp, Homo sapiens
gatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctcca

SEQ ID NO: 7313 - DNA, 468 bp, Homo sapiens
  misc_feature 6, 16, 29, 53, 56, 103, 104, 105: n = A,T,C or G
taagcnggagctcgcnttcctcaaaaggngactagtggatccaaattttcccnaangaggccgcctcttggggccatcaaggacagggccatgttctgtcccnnnacacctggtcttgggatggccgtgtgacaggcatgctccacccctccagcttcgtcctggggcagggctccctccaagcctgtctccccactccccggccagaggtcagcaaccacagaaggccccccagaccacgcatggcagaccaggctgcagtggcagccctgaggtgccccccgccgagtcccagggccctgcaggggcctcgacaggagccgggcctatctctaaagcagagggaatggctgggcatgaacttcgacattccaaaaccccaagccaggaaaaagggcagggcctggtcctagggatgcttactggcagcaagagcagtgcccagtcagggtgggaggtagcaccagg

SEQ ID NO: 7314 - DNA, 275 bp, Homo sapiens
  misc_feature 49: n = A,T,C or G
ctgcattcaggttggcaggaacatcattcatggcagtgattcattaaanagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccgg

SEQ ID NO: 7315 - DNA, 187 bp, Homo sapiens
  misc_feature 27: n = A,T,C or G
accttctacccacgccgtacgtcgctncagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggt

SEQ ID NO: 7316 - DNA, 463 bp, Homo sapiens
  misc_feature 23, 48, 55, 110: n = A,T,C or G
caaagctggagctcgcgttctcnaagaggacactagtggatccaaatnttcccgnacgagcggagccggactggacatggtcactcagtaccgcctgcagtgtctccatnactgatcatggctcttgcatttttgggtaaatggagacttccggatcctgtcagggtgtcccccatgcctggaagaggagctggtggctgccagccctgggtcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 7317 - DNA, 223 bp, Homo sapiens
  misc_feature 45: n = A,T,C or G
aacgtcaaggagctggaagtgctgctgatgtgcaacaaatcttantgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcat

SEQ ID NO: 7318 - DNA, 321 bp, Homo sapiens
  misc_feature 43: n = A,T,C or G
gcgcagcccagcctcgaaatgcagaacgacgccggcgagttcntggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaac

SEQ ID NO: 7319 - DNA, 415 bp, Homo sapiens
catcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaaga

SEQ ID NO: 7320 - DNA, 226 bp, Homo sapiens
gcttggggtctgcagtggccagcagctcttgaaaagacgcatgcctttccttccagtgtgtgaaagtgtcctgactttcacctctttgcagaccatcttctgaggtgagcaactgcctgcagggcctcctagtaccaaacctacagtggcttcccctggcttcgttcccaagcaaaagaatcagtcaagaatcacatgtttgcttatggcttacaaataaaaacgc

SEQ ID NO: 7321 - DNA, 456 bp, Homo sapiens
  misc_feature 45, 48: n = A,T,C or G
attgcatacatggatcaggccagtggaaatgtaaagaaggccctnaanctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccacca

SEQ ID NO: 7322 - DNA, 183 bp, Homo sapiens
  misc_feature 2, 11, 31: n = A,T,C or G
tncaaaggggngacactagtggatccaaatntcccattaagatggattctcagatatttatatttttattttatttttttctaccttgaggccttttgacatgtggaaagtgaatttgaatgaaaaatttaagcattgtttgcttattgttccaagacattgtcaataaaagcatttaagttg

SEQ ID NO: 7323 - DNA, 360 bp, Homo sapiens
  misc_feature 329, 344: n = A,T,C or G
accaaggtgcagagatggacaagagcagccaggagacccagcgatctgagcataaaactcattaaacctgcccctatcactagtgcatgctgtggccagacagatgacaccttttgttatgttgaaattaacttgctaggcaaccctaaattgggaagcaagtagctagtataaaggccctcaattgtagttgtttccagctgaattaagagctttaaagtttctggcattagcagatgatttctgttcacctggtaagaaaagaatgataggcttgtcagagcctatagccagaactcagaaaaaattcaaatgtacttatgttctcnttctatggccattgngctgcctctgttactg

SEQ ID NO: 7324 - DNA, 215 bp, Homo sapiens
atttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagt

SEQ ID NO: 7325 - DNA, 410 bp, Homo sapiens
  misc_feature 39, 41, 399, 401, 407: n = A,T,C or G
cttctgttgctgtgaatacttctctcagtgtgagaggtnanccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgccagccctgctgaagggccctaacnanagttcnaga

SEQ ID NO: 7326 - DNA, 380 bp, Homo sapiens
gggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaag

SEQ ID NO: 7327 - DNA, 319 bp, Homo sapiens
atttgagaagaaatactcctgtattgagttgtatcgtgtggtgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatattgagt

SEQ ID NO: 7328 - DNA, 257 bp, Homo sapiens
cttactgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaat

SEQ ID NO: 7329 - DNA, 414 bp, Homo sapiens
  misc_feature 45, 347, 358, 397, 398, 400: n = A,T,C or G
gtgcagaaatggcacctcgaaaggggaaggaaaagaaggaagaanaggccatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccantcggccctcanagcccttgcccgctcgggtatgaagatcgggcggtttgnngntgtccccccccttc

SEQ ID NO: 7330 - DNA, 316 bp, Homo sapiens
  misc_feature 43: n = A,T,C or G
gccagatggttttagtaacagtgaattgaattaaatcaattgnaaaagattggtagctgctgtccttatcctgcaggtctgctttaaagaagagtctggcagggagccagggacctgttcctaggaaaggcaggcaagatgctgctggagaggaacaatatgcgttcctctctgagaccatttcctttgaaacatgttctggggcaggagcttgattggctgccaaggcacatgtgagttgggaagcaccatgtcagacatgcaaaccagggagcccctgggccgtgtttattatacgtgttctgactggcccttg

SEQ ID NO: 7331 - DNA, 184 bp, Homo sapiens
cccggacgtctaaaccaaaccactttcaccgctacacgaccgggggtatactacggtcaatgctctgaaatctgtggagcaaaccacagtttcatgcccatcgtcctagaattaattcccctaaaaatctttgaaatagggcccgtatttaccctatagcaccccctctaccccctctagagcc

SEQ ID NO: 7332 - DNA, 289 bp, Homo sapiens
  misc_feature 2, 48, 50, 168: n = A,T,C or G
gnttaccaaaatggctgtttacagtgcatttagttctgatatttatancnatgacatttcacagaataactttaaaatagtttgaaattctatatagtttagacatcgatcacatctggagacaaaataaaatgtgcaatattttttatgtaggcgagctaacacagngtacctaattgcagaattatctgattaatttgtaatagataagttgtataacattttcatatcttaaaatgttttttagatcaatcttgaagtgaaatattttcaaaataaaattctacag

SEQ ID NO: 7333 - DNA, 107 bp, Homo sapiens
ggctctgattttgagttatttataataaagtttggggattatcataacatctcatatctttgtgtatgttgttttaatgctcggcagagcacaacactgatgataac

SEQ ID NO: 7334 - DNA, 442 bp, Homo sapiens
  misc_feature 440: n = A,T,C or G
cacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagncc

SEQ ID NO: 7335 - DNA, 440 bp, Homo sapiens
  misc_feature 43: n = A,T,C or G
tccaggctcaccctcgcgcctgtctacaccagcccccagctgnacatgtcctgtccgctgctgcagcagaacaagcaggtggtcccagtgtccagccaccgcaaccccctgctggacctggctgcttacgaccaggagggccgccggttcgacaacttcagctctctgagcatccagtgggagtccaccaggccagtgttggccagcatcgaggctgagctgcccatgcagctggtgtcccaggacgatgagagtggccaaaagaagctgcacggtttgcaggccattttggttcacgaggcatcaggaaccacagccatcactgccactgccactggctaccaggagtcccacctcagctctgccagaacaaagcagccgcatgaccctctggtgcctctgtcggcctccatagagctcatcctggtggaggacgtgag

SEQ ID NO: 7336 - DNA, 439 bp, Homo sapiens
gaacatgttctccaaccacaatggactcactagaaatcagtaacagaagggcaacaggaacaccttcaacacttggaaactgaacagcacacttataaataatctatgggtcaaagaagaggtctcgagggaaatccaaaaacatactgaactgaatgaaaatgaggataaaatatcaaaaattgtgagacatggctttatccactgctttaatacagccgcactgagaggaaattttgggcaagaagaaaattctgaaatgaatagtttatgctcttacctccataacctagaaaaaggagaacaaactagacccaaggcaagcagaaggaaggagataataaaaatctaagcagaaatttaaaaagatacagagaagtaatagagaaaataaatgaaagaagtggttctttgaaaagatcaataaaattgacaaacc

SEQ ID NO: 7337 - DNA, 440 bp, Homo sapiens
  misc_feature 43, 44: n = A,T,C or G
cacaattgtggaacccacattggcctgagatccaaaacgcttnnaggcaccccaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcagctcctttaacgctaatatttccggcaaaatcccatgcttgggt

SEQ ID NO: 7338 - DNA, 230 bp, Homo sapiens
  misc_feature 1, 44: n = A,T,C or G
ngaacttgtcaatgatggatggtaaattttcatggaagttatanaagcgataaataaaaacccttgcttttacccctgtcagtagccctcctcctaccactgaaccccattgcccctacccctccttctaactttattgctgtattctcttcactctatatttctctctatttgctaatattgcattgctgttacaataaaaattcaataaagatttagtggttaagtgc

SEQ ID NO: 7339 - DNA, 439 bp, Homo sapiens
  misc_feature 45, 50, 113, 127: n = A,T,C or G
atctcatccaagcaagttagagtccagcctaatcaaatgtcatanttgtngtacctattgaaagtttttaaataatagatttattatgtaaattatagtatatgtaagtagcntaatgaagaaaganatcatgaagaaagaaattgataggtgtaaatgaaaagaccatgtaaaatatgtaaattctagtacctgaaatcctttcaacagatttttatatagcaactgctctctgcaagtagttaaactagaaactgggcacatggtagaggctcacatgggagttgtcctcacccttgttaatctcaagaaactcttatttataataggttgcttctctctcagaacttttatctattacttttttcttcttatgagtatgtttactctcagagtatctatctgatgtagacagttggtgatgcttctgagactcaga

SEQ ID NO: 7340 - DNA, 234 bp, Homo sapiens
gtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttc

SEQ ID NO: 7341 - DNA, 458 bp, Homo sapiens
  misc_feature 9, 13, 39, 47, 48, 49, 51, 95, 98, 99, 101: n = A,T,C or G
ggagctcgnttcntcaaaaggggacactagtggatccantttccccnnnangaggaggcggcacagctgcgggaggagcggctacggcagtacgnttnnanccaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 7342 - DNA, 398 bp, Homo sapiens
  misc_feature 36: n = A,T,C or G
gatactttgagattgtgttctgagagatgatatgantacctaaaatacaattaaaaatgttataatataatgaaaatgtagtaatttaagaaaacaccagatgagttaggaataaacctataacatttacaaaaagagcaaaactaagtgatagaaaatatttcacacatgttcttatagatcatgtatcacttgcaagttttaggagttcatatcctatatcatttcaaattaagtacataataaagtaaaattttgaaatgaacactttaggtatttttgccaagatttagatgtttttaattaaacttttctcttcctttttttttcactaaagcatgtttattcccctaatccattaaagagcatgaaaaaaagaataaatgtatttgaaaatt

SEQ ID NO: 7343 - DNA, 439 bp, Homo sapiens
  misc_feature 49: n = A,T,C or G
gaaacttgtcacttgcatgtcccatcacgtgtactggctcctttgtggngtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatga

SEQ ID NO: 7344 - DNA, 403 bp, Homo sapiens
aagcaacatttcaaatgtctctccacaaaccaaactcaacagaatactttggcttgaagccggcacacccagggttactgaggacttatgctgcctgacctggttagatgtacatggaggtatctcccgaatcatacaaaattaaatgtgaagaccgtttatgcataccttcatgtgcctgacagtcttggcttttgaagatttttttttcttttttgctctgcatagctagaccatcttattaataatactctgaaaaaaatgatttcaaggcatggaagttctctgtgatacaacaatagtatttcttcaaatgcgccttatgctacttatctcagaaacaggttttaaaatgaagtgctttccagagaaccatcatataaataaagattaatagaaaaat

SEQ ID NO: 7345 - DNA, 438 bp, Homo sapiens
  misc_feature 50, 293, 317, 347, 349, 385: n = A,T,C or G
cagtcttcatttctcctggttattggtttgtttgtcattaaagatatatnttgaatccatgaaattgctatgctaaacagcctttacatgtatggtctggttaaagttcctttgttccttttgttttaataaaatgtgtcactgattttttagctcaaaatcatcactgttaatttccagtcaccccaaatatggttaaaagattttttttttaatcatgaagagaaaattagtagcatttctttctctccccattatttcttggttttcctcactaatcttttttttttagnccaaaagccaaaaatatttatctnggttttacattttaatttccattcttaatngnaatttttttctttaaataaggaaaccaatataatcncatgtataaaaacttaaatattttacaagttacatatagcatcattctaaaat

SEQ ID NO: 7346 - DNA, 486 bp, Homo sapiens
aaacagctcatgaggctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtattt

SEQ ID NO: 7347 - DNA, 445 bp, Homo sapiens
  misc_feature 46, 49, 342: n = A,T,C or G
gccaacaccaagattggcccccgccgcatccacacagtccgtgttnggncaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaanaaatatgatgaaaggaaaaagaatgccaaaatcagcagtctcctggaggagcagttccagcagggcaagcttcttgcgtgcatcgcttcaaggccgggacagt

SEQ ID NO: 7348 - DNA, 274 bp, Homo sapiens
  misc_feature 50: n = A,T,C or G
ccaccccactcttaatcagtggtggaagaacggtctcagaactgtttgcntcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgaga

SEQ ID NO: 7349 - DNA, 237 bp, Homo sapiens
ccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttg

SEQ ID NO: 7350 - DNA, 500 bp, Homo sapiens
  misc_feature 2, 16, 42, 44, 48, 49, 96, 100, 106, 108, 444, 481: n = A,T,C or G
anttccttaaaaaagngggctaggggatccaaatttctccanangagnngggctgtgaatttcatttagatacagaaagatagatgtccctttttncccnaaaaanangggcctagaaccaataattaatcaatatggcttagaacaagcaatgagtagccctaagttcattctgtactctaagacaagttctgctacaggcaggaaagacatgaagaaataccttcctttgcaccaagacactattttttttaatatggggaattttaaaaaaaagaactccagatggattttaaacacagtggggaactgggcggtgtgatggcagatggctatttcagctgcacatgggtaaaaataattccaactccccaatacccaggactgctctgaacttgtgaaaaccttttaaggaaaagctgcagtgtgatgctcaaagcgcanagctgcagcagactgggggccaagggcttggaactcnccaataagaaaacagctac

SEQ ID NO: 7351 - DNA, 438 bp, Homo sapiens
aacgccaatatagatctgcttattatcctgaagatctctttattgacaaccaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggt

SEQ ID NO: 7352 - DNA, 405 bp, Homo sapiens
tggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactggagtggccagtgccctgtcctccagataccactgagctcactgcccatgatgcagagctttcaaggataggctttattctgcaagcaatacaaataataaatctatt

SEQ ID NO: 7353 - DNA, 344 bp, Homo sapiens
  misc_feature 2, 3, 28, 35: n = A,T,C or G
gnnactagtggatccaaattttccccgnacgaggnggcttaagccatggcgcttctcacggcattcagcagcagcgttgctgcaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttgg

SEQ ID NO: 7354 - DNA, 459 bp, Homo sapiens
  misc_feature 46: n = A,T,C or G
cacgacacgtactacgttgtagctcacttccactatgtcctatcantaggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgaaacatcctatcatctgcaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcg

SEQ ID NO: 7355 - DNA, 156 bp, Homo sapiens
  misc_feature 45: n = A,T,C or G
gaagaaccctccataaacctggagtggctatatggatgccccccnccctaccacacattcgaagaacccgtatacataaaatctagacaaaaaaggaaggaatcgaaccccccaaagctggtttcaagccaaccccatggcctccatgactttttc

SEQ ID NO: 7356 - DNA, 417 bp, Homo sapiens
  misc_feature 21, 27: n = A,T,C or G
tggaggaggaaattatggaantggaanttacaatgattttggaaattataaccagcaaccttctaactacggtccaatgaagagtggaaactttggtggtagcaggaacatggggggaccatatggtggaggaaactatggtccaggaggcagtggaggaagtgggggttatggtgggaggagccgatactgagcttcttcctatttgccatgggcttcactgtataaataggagaggatgagagcccagaggtaacagaacagcttcaggttatcgaaataacaatgttaaggaaactcttatctcagtcatgcataaatatgcagtgatatggcagaagacaccagagcagatgcagagagccattttgtgaatggattggattatttaataacattaccttactgtggaggaag

SEQ ID NO: 7357 - DNA, 465 bp, Homo sapiens
  misc_feature 1, 55: n = A,T,C or G
nccgcacgaggttgggggccgtcccgctcctaaggcaggaagatggtggccgcanagaacacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgtttt

SEQ ID NO: 7358 - DNA, 436 bp, Homo sapiens
  misc_feature 46, 300: n = A,T,C or G
gcaaggtccaagatggccgctggcatcagacactcttcaccttttnggacccaagacccccaacagctgcccatcatcagtgtggacaacctccctcctgcctcatcagggaagcagtaccgcctggaagttggacctgcgtgcttcctctgacctctgacctcgtggccactctaggcctcatggaggagggaagaggaagaggcaaggggagggtactgaggggcagatggctccaggagaggcagctcccctgcccaagggtccttgggcagaccccagctgttgtctgcccagtanaagtgggtgggggtaggaggggatagggtgtccttgggaacaatggatcccagcttagccccaaagaccaaccaaagagccagccagagtaagctggacctgcaacctgcctgagccccgtggcctctcagctctg

SEQ ID NO: 7359 - DNA, 403 bp, Homo sapiens
  misc_feature 44: n = A,T,C or G
gacaagtcccacccctagatctgaagcaagctctaccagcagcntgtcctggaagcctgcctgcctgcctgcccgtctgcacaggtgtcttgatccagccctgcgtcttcgagcccctgtgccaccggtccccacggcccgccaggagtctctttgtacccactaggcttccctgatgaccatctgtctgtccgtccctgtttttgctgtacataactcctgctgcaccctctccccgcacacccgtcacccatgagagagagaaacctctctagggaaaggcagggtggctgcacccagcaactaatccaaatggcaaatattttgtaacaaaatagcccagaggtattttatctgttcaattcatagagttttagagattatattgaaagatgtcacttga

SEQ ID NO: 7360 - DNA, 407 bp, Homo sapiens
  misc_feature 18, 26, 29, 48, 52, 107, 108, 113: n = A,T,C or G
caaagctggagctcgcgnttctccangangacactagtggatccaaantttncccgcacgaggtcgcggcgacatggccaaacgtaccaagaaagtcgggatcgtcnntaaanacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatg

SEQ ID NO: 7361 - DNA, 437 bp, Homo sapiens
ctgagagagcaggaagagaagaagtggagaatcataatctaggttttatcagagtcattctgggaagactgaaatagctacttaacacataaagatacagaaatgcacaaccaacagatccatttcaagccaaattaagacaggccttgtttctgtcacaaaatacattccaagttaaatgggaggtgccagaaacaatttctttaaatctcaccagtttcatggaaagactaaaggggtgaaccaatgattcttagtccccatcccagtagtaaactaagtttttattcccctgtcaattcacttagaactggtgtgtatgtggttgtttgtggtgggggtagcagtggaaggattctcactcatttgtactatacagaagcgattcccaatacttatgttttctataacttactagaagacaaatcagaagagag

SEQ ID NO: 7362 - DNA, 498 bp, Homo sapiens
  misc_feature 47, 48, 105, 111, 261, 326, 329, 486: n = A,T,C or G
caaagctggagctcgcgctttccaagacgacactagtggatccaaanntttccgcacgagcagcagcatcccacccctgggagtctggccagctgagccccaggntggcangggcattatagcctggtggacatgtgccttcagggttcctccggggccaccttcctcaggccagtgctgggttcaaagggctgtgtgtgtgtgtgtgtgtgtgtgtatgtatatgtgtgtgggtgcacacatctgtcccatgtatgcagngagacctgtctacctcccacaaggagcaagggctctgcccgccctctgctcattcctacccaggnagngggaccccgggcccccttctgcctggcttgcctgcttctgccctttccagaggggtctcactgacagccagagacagcaggagaagggttggctgtggatcaaggaaggctgcccctgtaccctgtggggaaatggtgggtgcatggctggatgcanaggtggaaggcc

SEQ ID NO: 7363 - DNA, 362 bp, Homo sapiens
  misc_feature 26, 49, 57, 106, 107, 112: n = A,T,C or G
caaagctggagctcgcgtttctccangaggacactagtggatccaaatnttccccgnacgaggctatttccaggctgggcgcggtggctcaagcctgtaatcccannacttnggaaggccgaggcgggcggatcaggaggtcaggagatcaagaccatcctggctaacacggtgaaaccccgtctctactgagaatgcagaagattggccgggcgaggtggcgggcgcctgcggtcttggctgctcgggaggccgaggcaggagaatggcggaaacccggggggcggagcttgcagtgatcttggctcacgcggtgagccgagatcgcgccactgcactccagcctgggcgacagagggaga

SEQ ID NO: 7364 - DNA, 500 bp, Homo sapiens
  misc_feature 23, 25, 30, 55, 105, 107, 110: n = A,T,C or G
caaagctggagctcgctttctcnangaggncactagtggatccaaattttcccgnacgagataaatctaagaagaaggcctttaccaagtactgcaagaaatggntnganccaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgc

SEQ ID NO: 7365 - DNA, 111 bp, Homo sapiens
gagtacttctagagcggccgcgggcccatcgattttccacccgggtggggtaccaggtaagtgtacccaattcgccctatagtgagtcgtattacaattcactggccgtca

SEQ ID NO: 7366 - DNA, 496 bp, Homo sapiens
  misc_feature 18, 29, 49, 52, 57, 108, 112, 345: n = A,T,C or G
caaagctggagctcgcgnttttccaagangacactagtggatccaaatnttncccgnacgaggaatgtcctgccttcctgaccctctatgatatagagtttcagtatnaaangggagaaaacaggagaaaatctctaatttgttttctccagatttcagtctgtaatttgaaaaggttaactgagtatcatgcaaaagtaatgaaagtggcctaaatgtatcctgattccaaggagaaaagtttaatcaagggaaaacaacaacatcagcacacaaaaaccctgcaattatctagatgacaaaaacaggttgcctcagaggaaaaaaaaataatgctggcattanatgtcttccttgaaatattacatttcagaaagcattagcctaatattacagttttaaggaaaaaaaattaggacaataatttttaactgtccaaattacctgatatggttaaggtataaagaaagttaagacatcacaataaaaatgaatg

SEQ ID NO: 7367 - DNA, 188 bp, Homo sapiens
  misc_feature 49: n = A,T,C or G
ggggagatgtaggtgtagaattattgcttatgtcatttcttaatcagtnctgctcttaatgcttaaaagaaggctagcattgtttgcacaaaaagttggtgattcccaccccaaatagtaataaaattacttctgttgagtaaactttttatgtcatcgtaaaagctgaaaaaatccctttgtttcta

SEQ ID NO: 7368 - DNA, 357 bp, Homo sapiens
  misc_feature 44, 49: n = A,T,C or G
gtgaatttttctaaaggtgctatttaacatgggaggagagcgtntgcgnctccagcccagcccgctgctcactttccaccctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccccctaggggtgggaggaagcaaaagactctgtacctattttgtatgtgtataataatttgagatgtttttaattattttgattgctggaataaagcatgtggaaatgacc

SEQ ID NO: 7369 - DNA, 487 bp, Homo sapiens
  misc_feature 49, 51: n = A,T,C or G
ggcaggggaagtattgaatgcctaattaagaaatatgtgttctgtttancngaaaacaataggggagtgtttaatagccactatgatagcacaaggatgaggcaaagcagctgtagggaaaggggagccatggcagagcagatgcacattttacagggcttggtgacagatgtgtgttgtgatttcaggaaagagaaactgaaactgtaaggaagcaggtagacccctgaacaggccagtttctcttgaaaacttgagattccagttcacctaagtaagcaagtcctctgtttttgtttttttgtttgtttttttgacagttataccactgtcatttgctcaatggaaatataaagttggcatcactgaaattaacaagtttttaagaaagaaatgatcgctcagagcttaaggaagactgcctaaatcctagtgatctcctaacggggacgggggatgtgatgatgagctttagagctgagagagt

SEQ ID NO: 7370 - DNA, 263 bp, Homo sapiens
  misc_feature 45, 50: n = A,T,C or G
ccacactgagctggagggaggagagaaggagggaggagaaagacngggcntgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccat

SEQ ID NO: 7371 - DNA, 498 bp, Homo sapiens
  misc_feature 5, 10, 30, 75, 76, 85, 91, 94: n = A,T,C or G
ggggnctagnggatccaatttttcccaaangagaaagtacttggagtctgcaggtgcgagagttgtaccagtaanntttttcccnacaaanaangactatgaaatacttttcaaatctattaatggaatccttttccctggaggaagtgttgacctcagacgctcagattatgctaaagtggccaaaatattttataacttgtccatacagagttttgatgatggagactattttcctgtgtggggcacatgccttggatttgaagagctttcactgctgattagtggagagtgcttattaactgccacagatactgttgacgtggcaatgccgctgaacttcactggaggtcaattgcacagcagaatgttccagaattttcctactgagttgttgctgtcattagcagtagaacctctgactgccaatttccataagtggagcctctccgtgaagaattttacaatgaatgaaaagttaaagaagtttttcaatgt

SEQ ID NO: 7372 - DNA, 499 bp, Homo sapiens
  misc_feature 15, 26, 28, 74: n = A,T,C or G
actagtggatccaantttccccaaangngggcgcgtggtctacgccgagtgacagagacgctcaggctgtgttntcacgatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcaggacggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggat

SEQ ID NO: 7373 - DNA, 338 bp, Homo sapiens
  misc_feature 24, 25, 27, 52, 100, 101, 107: n = A,T,C or G
tggagctcgcgtttcctccaaagnngncactagtggatccaaattttcccgnacgagggaagaagggagaagaaaggtgagtttgagctgccttccctanntttacnccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtt

SEQ ID NO: 7374 - DNA, 232 bp, Homo sapiens
  misc_feature 44: n = A,T,C or G
cagagacaccagcttcagtggcctgtcgttggaagagtacaagntgatcctgtccacagacaccttggaagagcttaaggaaatagataaaggcatgtggaagaaactgcaggagaagtttgcccccaagggtcctgaggaggatcataaggcctgagctcaggccttacctcgtgcacatacctaggtgtggagtcttgtacattgccatcgtcaataaaactgccccagt

SEQ ID NO: 7375 - DNA, 500 bp, Homo sapiens
  misc_feature 26, 105, 111: n = A,T,C or G
caaagctggagctcgcgttctcccangtggacactagtggatccaaattttcccgcacgaggaggaggatttgcaggaagagctcgtggaagaggtggtgaccantttagnggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggtttt

SEQ ID NO: 7376 - DNA, 362 bp, Homo sapiens
  misc_feature 43, 49: n = A,T,C or G
cgccgcgccgccatcatggacaccagccgtgtgcagcctatcntgctgnccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacagtctgctccttttttttgtccgccacacgtaactgagatgctcctttaaataaagcgtttgtgtttcaag

SEQ ID NO: 7377 - DNA, 438 bp, Homo sapiens
  misc_feature 44, 49: n = A,T,C or G
gctccgctgtacctggatcctgctcctctgggttgaaacccggncgccnccaagatgccggcttaccactcttctctcatggatcctgataccaaactcatcggaaacatggcactgttgcctatcagaagtcaattcaaaggacctgcccccagagagacaaaagatacagatattgtggatgaagccatctattacttcaaggccaatgtcttcttcaaaaactatgaaattaagaatgaagctgataggaccttgatatatataactctctacatttctgaatgtctgaagaaactgcaaaagtgcaattccaaaagccaaggtgagaaagaaatgtatacgctgggaatcactaattttcccattcctggagagcctggttttccacttaacgcaatttatgccaaacctgcaaacaaacaggaagatgaagtg

SEQ ID NO: 7378 - DNA, 251 bp, Homo sapiens
  misc_feature 49: n = A,T,C or G
gctgtacttccctgtggcacgttaccatggaagccgctccagggtgggncagggtgcaagctgctggtgaggtttggaagcatcaggctcacgggtgttcatgtgtgttcgtgcgtgtgtgtgcgtacgtgtatataactgaagtgtctgtacggaatgccctttgctagccatgggctggtcaccagattgttttgtaatgcccgccccttgcctcgatattgccagtttcttgtgcaataaacaatcag

SEQ ID NO: 7379 - DNA, 439 bp, Homo sapiens
  misc_feature 45, 49: n = A,T,C or G
gctgaccatgaacatccccttccagtccatccacttcatcacctntganctcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctggccggctacttcaaaggcatccaggcgcgtgtcatctaccagatgccctccaccgccatttcttggtctgtctatgagttcttcaagtactttctcaccaagcgccagctggaaaatcgagctccatactaaaggaagggatcatagaatcttttcttaaagtca

SEQ ID NO: 7380 - DNA, 465 bp, Homo sapiens
  misc_feature 45, 46: n = A,T,C or G
cagcacatggaagaagtaccaagaggcgatgaagacatccttggnnagttccacaacgtggtgacctggaagacctggaggagcatctgccagggcagacagtctctgaggaagccacaggggttcacatgatgcaggtggacccagccacaccggcaaagaaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaagattcctcgaccaccaggaagggccccgacgtggggatgtcaacatggctcagacttgatgtggatcgtgatcatttcgggaaatgtgttac

SEQ ID NO: 7381 - DNA, 131 bp, Homo sapiens
  misc_feature 49: n = A,T,C or G
tccaagtgtaaaataattttgactccagcagctacaaatacagacgganttttcttttcatgcctcaaatactacagtgtggccacgagcaaagagattttgtgtgtgtctgtgtgacagagcgagacctt

SEQ ID NO: 7382 - DNA, 500 bp, Homo sapiens
  misc_feature 2, 5, 27, 28, 90: n = A,T,C or G
cncangtcgacactagtggatccaaannttcccgcacgagcttccgaggaagctaaggctgcgttggggtgaggccctcacttcttccgncgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgt

SEQ ID NO: 7383 - DNA, 500 bp, Homo sapiens
  misc_feature 21, 25, 28, 51, 61, 104, 111: n = A,T,C or G
caaagctggagctcgcgttcnccangangacactagtggatccaaattttnccgcacgagngatgccctccggggccaggaggacctgaaggagcagctggcgnttgtgcnagcgcagagccaacctgctgcaggccgaggtggaggagctgcgggctactctggagcagacggagagggcccggaaactggcggaacaggagctcctggactccaacgagagggtgcagctgctgcatacccagaacaccagcctcatccacaccaagaagaagctggagacagacctcatgcagctccagagtgaggtagaagatgccagcagggatgcaaggaacgctgaggagaaggccaagaaggccatcacggacgctgccatgatggcggaggagctgaagaaggagcaggacaccagcgcccaccttgagcggatgaagaagaacctggaacagacggtgaaggacctgcagcatcgtctagatgaggccgagcagctggcg

SEQ ID NO: 7384 - DNA, 440 bp, Homo sapiens
  misc_feature 2, 45, 50: n = A,T,C or G
gnggtcccacttgactgttccaaagagcagcttctcagatcttcngtgtncactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcga

SEQ ID NO: 7385 - DNA, 438 bp, Homo sapiens
  misc_feature 45: n = A,T,C or G
gtgccttgcaggaatttaaactctctacccttaaagaaggaaatntatttgtacaaaagccacagataatggtccttttactcaagcgacctgctggataaatgacagcctgcagggattgagtttggagatctagtctcaattctgcttccgatttagatgcagttcacttttgttttttaaagtaagttttattaatggaaaggaagaactttttccaagaaagcattttgaaagccactgggggagggggacatttatgcttttgggctgtggagatcctttaggtggagagactgctctctcatccctagtggaatggaggtttgggttggtgagtttctatcaatagcctgctctctatagtgggtcagtgactggcaccaaattgtagtcctgttccatggacattgccctgttttggttttatgagctttt

SEQ ID NO: 7386 - DNA, 313 bp, Homo sapiens
ctgaagccggccaagaagacaaagcttgtagcaccattggcatccccgtgttccagcaatctttcccatgcaaaccggcccttcagagggtctcagcttggggtctgcagtggccagcagctcttgaaaagacgcatgcctttccttccagtgtgtgaaagtgtcctgactttcacctctttgcagaccatcttctgaggtgagcaactgcctgcagggcctcctagtaccaaacctacagtggcttcccctggcttcgttcccaagcaaaagaatcagtcaagaatcacatgtttgcttatggcttacaaat

SEQ ID NO: 7387 - DNA, 468 bp, Homo sapiens
  misc_feature 3, 27, 30, 77, 82: n = A,T,C or G
ggngactagtggatccaaatttccccnaangagaaggacatggcgtattttgtatttaaaagtaattgtattaattntttancccgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtg

SEQ ID NO: 7388 - DNA, 162 bp, Homo sapiens
  misc_feature 48: n = A,T,C or G
gtcagataagttttttcatgaacccgttgtggaaattattggaattanctgagccaaagtgattatgcattcttcatctattttagttagcactttgtatcgttatatacagtttacaatacatgtataacttgtagctataaacattttgtgccattaaag

SEQ ID NO: 7389 - DNA, 207 bp, Homo sapiens
  misc_feature 9, 36, 49, 50, 75, 108: n = A,T,C or G
gctgatcantattttttatcaacacctgagaactgntacaccttttatnntgtcttttaggaaatccctgtcttnccattttttcatgtaaattttgcacagttactnggtcatatgtaaatattttactttcagaaatgaagtttttaattgctattgttttatataggattgaaagaaaattaactcctttattaaaaacaaatt

SEQ ID NO: 7390 - DNA, 209 bp, Homo sapiens
  misc_feature 2, 5, 52: n = A,T,C or G
gnggntgatcagtattttttatcaacacctgagaactgttacaccttttatnctgtcttttaggaaatccctgtctttccattttttcatgtaaattttgcacagttacttgttcatatgtaaatattttactttcagaaatgaagtttttaattgctattgttttatataggattgaaagaaaattaactcctttattaaaaacaaat

SEQ ID NO: 7391 - DNA, 106 bp, Homo sapiens
  misc_feature 48: n = A,T,C or G
ctcactcctgtaatcctagcactttgggaggccaaggcaggaggatcncttgagcccaggagttcgagaccagcctgggcaacgtagtgagattctatctctattt

SEQ ID NO: 7392 - DNA, 286 bp, Homo sapiens
  misc_feature 44, 49: n = A,T,C or G
gccgccgctgtggctctaaggcctaccaccttcagaagtcgacntgtgncaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggttttaaaaaat

SEQ ID NO: 7393 - DNA, 500 bp, Homo sapiens
  misc_feature 4, 7, 31, 37, 82, 85, 88, 90, 95, 100: n = A,T,C or G
aagnggngactagtggatccaaattttcccngaacgngaggatatcaaaacagaggttccagaagaagatgcactaagtagnttngancnctcanaaagnagtgttaagaaaaatttacctcagaatttactgaatatatttaatcagatagctgaatttgaaaaagaaaaaggaaataagtcaaaaaattaatacaccaaggatatcggcaccattacacaaaatgccattaagtgaagtttttggttgtattagtcataacagttgagtgcagaaatctctgcttctaaaattatttgtagagattacaggaaacaaatgcttttaagtaagtttttctcaaattttgtttcagttctaggtcccttgtcacagcttggtttttagactttttatgtatatgtttatgtacagtatattactcttgacagtttgaatttcttcacctaaagataattctctgaaagtactgtttcttcattctattgcggtatatgag

SEQ ID NO: 7394 - DNA, 497 bp, Homo sapiens
  misc_feature 2, 18, 27, 75, 76, 78, 81: n = A,T,C or G
gncactagtggatccaantttcccccnacgagcaagaggcgtttctataagaattggcataaatctaagaagaanntnttncccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgc

SEQ ID NO: 7395 - DNA, 172 bp, Homo sapiens
  misc_feature 3, 12, 27, 32, 39, 86, 91: n = A,T,C or G
tcnaaagggganactagtggatccaantttcnccggaangagcttgtaaccctttaccctataattgctatccttaaagatttcanataanctcggagggaactgcagggagaccaacttatttagagcgaattggacatggataaattttttattttttttaaaaaattat

SEQ ID NO: 7396 - DNA, 460 bp, Homo sapiens
cacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaata

SEQ ID NO: 7397 - DNA, 438 bp, Homo sapiens
  misc_feature 1, 44, 50, 51: n = A,T,C or G
nataccccttggttccttgggctggaagacagttaaacaaccantatatnncgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcgatgggtagcaagagtctttgaaataagcccatttgagccctggataacaagggataaagtggagcggatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagcc

SEQ ID NO: 7398 - DNA, 456 bp, Homo sapiens
  misc_feature 43: n = A,T,C or G
cattaggctgttggttcaaacttttgggagcacggactgtcanttctccgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatctttcaaaataaaaag

SEQ ID NO: 7399 - DNA, 148 bp, Homo sapiens
  misc_feature 48: n = A,T,C or G
gttcaaggcagaaccacgacccttgactcccgggtggggaggtggccnaggatgctggagctgaatcagacgctgacagttcttcaggcatttctatttcacaatcgaattgaacacattggccaaataaagttgaaattttaccacc

SEQ ID NO: 7400 - DNA, 439 bp, Homo sapiens
ctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggtggttcttttccttgaagggcagcctcctgcccaggccc

SEQ ID NO: 7401 - DNA, 165 bp, Homo sapiens
  misc_feature 58: n = A,T,C or G
agcagccggcgacttcatcgagcatgccgagttctcggggaacctgtatggcacgagncaaggtggcggtgcaggccgtgcaggccatgaaccgcatctgtgtgctggacgtggacctgcagggtgtgcggaacatcaaggccaccgatctgcggcccatctaca

SEQ ID NO: 7402 - DNA, 437 bp, Homo sapiens
gtatgtgcttttctgtgggggtgggatttggaaggggggttgggttgtgctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgat

SEQ ID NO: 7403 - DNA, 423 bp, Homo sapiens
  misc_feature 88, 399: n = A,T,C or G
cttcggtgaagcgtcacagaaatttggatttgaagtggggccggcttgcttcatgggctaggagccgccgagcccgggctcccgagancaacctcgtgacctcagcatgccattcgttcgtgagtgtcccgtgcacgtcctgatcctggacagtgaaggcttctccctcccctcccacctgacttcatctacgcctcggcaccacggggtgtgggaccccagcccggagagaacagagggaaggagccgcgcccccacctggagctgaatcacatgacctagctgcaccccagcgcctgggcccgccccacgctctgtccacacccacgcgccccgggagcggggccatgcctccagccccccagctcgcctgacccatcctgttcgtgaataggtctncagggggtgtggggggagggattg

SEQ ID NO: 7404 - DNA, 400 bp, Homo sapiens
gcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaag

SEQ ID NO: 7405 - DNA, 439 bp, Homo sapiens
ctaggggggcatatgactaccctgagtggtgaagaaatcagttacactggttcagacggcattgaagggggactccttgctagcatcagaatgaaccaccaggccctggtcagaaaactcccagatctagaaaagacaggacataaatgagcataactgattacagggtacagttcttcacagctgaaatggttagcctgagatgctggaagcttcaaaggattggtggagactatgcatggttaaggccatcccgaactttttaaagtatttatgaagcatcagagacttattttccctgtaatagaatgcaaaatcagggaaaatgggttgctttgtgtctcaagtattgtctttatttttgagactattttcatacagttgtcatacacaaggcgcatatatatatttgtgaattaaaatctgtagctgagtctac

SEQ ID NO: 7406 - DNA, 246 bp, Homo sapiens
caggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagcgaaaaaggtgtgaagcacccaccatgttcttgaacaatcaggtttctaaataaac

SEQ ID NO: 7407 - DNA, 433 bp, Homo sapiens
cctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacctgggctggggaggacactgccccgtctaggtttttataaatgtcttactcaagttcaaacctccagcctgtgaatcaactgtgtctcttttttgacttggtaagcaagtattaggctttggggtgggggggaggtctgtaatgtgaaacaacttcttgtctttttttctcccactgttgtaaataacttttaatggccaaaccccagatttgtacttttttttttttctaactg

SEQ ID NO: 7408 - DNA, 116 bp, Homo sapiens
cctgtagtcccagctactcgggaggctgaggcaggagaatggcgtgaacccaggaggcggagcttacagtgagccgagatcgtgccactgcactccagcctggggacacagcaaga

SEQ ID NO: 7409 - DNA, 439 bp, Homo sapiens
atttgccattattgcacatcacatttttgggggggaaagtgcttatgaatggtgcaggttgactctgatattcattcccaaatgacagtatggcagagtgttccagaaatgagagtggcatctttatggaatcactgtggatactgactgtctcagtaaacagctgtcttgtctgtgtgtatattgtttgatcagggtacatggcagccagtcacagattggaattacatatgacaaagtatcagtgtactataaacaggtttttagttatccctgcattatttttgcaattaatctttatatgcaatgagattgaaaagctttgtatgggaagactcaaaatgtaaagctgcttccgtagagtctcactgattctgagatggcttttgctgctctgttctccctctacatttctctgcagaactcgcgttagaaacac

SEQ ID NO: 7410 - DNA, 223 bp, Homo sapiens
gtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagtt

SEQ ID NO: 7411 - DNA, 342 bp, Homo sapiens
ggagagctgagcagtcaagatgtgtgacttcaccgaagaccagaccgcagatctgatcccaagcactggagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaattttgtatctagcctaaagtttccctaggctttcttgtctcagcaactttcccatcttgtctctcttggatgatgtttgccgtcagcattcaccaaataaacttgctctctgggcc

SEQ ID NO: 7412 - DNA, 457 bp, Homo sapiens
agagcacatacagggctccagaaccagattaaaacaagaagtgaaggtgggaaagagagaaaatgcagaattggaaacaaagcgtgaaacaattcacaggaactgagaggcagcagccagcacagggtagaagggcagtggcagttcagctccctgtcaggtgtgtctgccgtgtaaaataataatacgcccccacccatggctgtgtggcctgcacactcccacatgcatgcccacacacagactgaaggaattgtacccccttccccagcaggtgccctttctctctgccaggtgagcagagcagacaggggctgctccttcattccaggggttgggaggagagagtgaccaggaacggagctggcagcatggctaaccttgactcaacctgcaactagagcaaggaatgagccttggttgctataagtcacagaggcatggtggatcagggatt

SEQ ID NO: 7413 - DNA, 125 bp, Homo sapiens
  misc_feature 106: n = A,T,C or G
acataatctagtttacagaaaaatcttgtgctagaatactttttaaaaggtattttgaataccattaaaactgcttttttttttccagcaagtatccaaccaactnggttctgcttcaataaatc

SEQ ID NO: 7414 - DNA, 349 bp, Homo sapiens
  misc_feature 202, 330, 340: n = A,T,C or G
ccccgctctcccctgtcccgaaggattactctgcccctcagcggttccagtgccctcaaagcaatctgtctctgaagtactggctatcttctgagcgtgtgccagaagatccagctttgttgaaaagcgaagccgttagtcccttaatacaaaggatcagggatagcagaaatgaaagtataatggaagccagctgggaggngaattccaggtccactttcacccaagtaatggagacggaaggttcatcgaaacttcttcagctgcagatctagaagtcattagctattctagcaaagtatctggtccacagaaaagggggctttcatnaaaagggctngccctgggg

SEQ ID NO: 7415 - DNA, 386 bp, Homo sapiens
  misc_feature 378: n = A,T,C or G
gctttaagatgtttgctgtgggtgtgggcaatgccgtggaggatgagctgagggaaatagcctcagagcctgtggcagagcactacttctacacggctgacttcaagaccatcaaccagataggcaagaagttgcagaagaagatctgtgtggaggaagacccgtgtgcctgcgagtccctggtgaaattccaagccaaagtggaggggctgctgcaggccctgaccaggaaactggaagctgtgagtaagcggctggccatcctggagaacacagttgtctaaggctgcctgtcaccactgtggcctctccaagcgtcctgcacgtgtccgccgtagctttaccattttagtgagggaagccagcccgggggtgggnagggggtg

SEQ ID NO: 7416 - DNA, 439 bp, Homo sapiens
ggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatgga

SEQ ID NO: 7417 - DNA, 395 bp, Homo sapiens
  misc_feature 172, 186, 211, 265, 305, 330, 381, 388: n = A,T,C or G
acagggcaagtgtttttcttcctaaaaaaagttctttcttttattattttcacctattggctgctgcattttacgaagtggacttcccggtgtttgtttgtttgcaatacactcagtgcagccttaagcaaatgagatcattttcagatttcattttattttttttttcagnctttctacttttgnaataataggaagttagtaggactcncttctctgattaataagcaatttgcagcacacagcgttccactgcggggtttcncgctcacctgaaaacacctgttcccaacctacttcttggngcaagttgaccaaatcgttttaagnggtaactctttccaaccgtagcagggttgttttctgttaagcaaagccganatccagngcaatac

SEQ ID NO: 7418 - DNA, 425 bp, Homo sapiens
cgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccattaaagaaggaaaaaaataaatcccacatttgtgtatgcacccactcacccctccaaatcagcaaaaccgcatctaatttgtccgccgaatgccaaagcaaagcaaacttattataacccttggactgagtttagagacatttcttcaatttcccatcgtgcctttccagggaccagtgcagggacaagggggagaaaggggaaggggttaagttaaataaagaagattatttttgtttcctgacttt

SEQ ID NO: 7419 - DNA, 439 bp, Homo sapiens
cttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagca

SEQ ID NO: 7420 - DNA, 439 bp, Homo sapiens
ttgatggcgtgatgtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcagggatgaggatggca

SEQ ID NO: 7421 - DNA, 109 bp, Homo sapiens; identical to SEQ ID NO: 7127

SEQ ID NO: 7422 - DNA, 439 bp, Homo sapiens
ggaaagagtagcttccctgtattacctcccctactcccttatctgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagactttttttaacactttggacttctctgaaatatttagaagtgctaatttctggcccacccccaacaggaattctatagtaaggagggaggagaaggggggctccttccctctcctcgaatgacgtt

SEQ ID NO: 7423 - DNA, 361 bp, Homo sapiens
caagaaactaagtcttagtgcacagtatcacaacaaagaaaaagctttgtttttataactggtaaaaacaagaaaagattctcatcaaaatgaaaatataaaattaatcatttctcaccaaagagtatgcctgggagcctccagctgttaaaagacaatgctattactacttcttatcaaaaatctgtaatgccctgtgatttttatgatacttcttcaatacaaagtgttaatatgtgtcatcagtataataacaaccaacaaaatgccactttcagaaaactgtatgtaaattttttgtaacaatgtaaaaaagaaatggggagtaagtgttcacatcattaaaaggctttgaattcat

SEQ ID NO: 7424 - DNA, 394 bp, Homo sapiens
caagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcagggg

SEQ ID NO: 7425 - DNA, 417 bp, Homo sapiens
agactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctca

SEQ ID NO: 7426 - DNA, 439 bp, Homo sapiens
tgcaggacgcctggtctgccttgtgggtcctggacggagcccctacctctgcaaagatgacttggagacaggccgtcctgctgtcttgcttctccgccgtggtgctcctgtctatgctgagagagggaaccagtgtatctgtgggcaccatgcagatggcgggagaagaggcgagtgaagatgcaaaacagaagattttcatgcaggaatcagatgcctcgaatttcctcaagaggcgcggcaagcggtcccccaagtcccgagatgaggtcaatgtggaaaacaggcagaagcttcgggttgatgagctgcggagagaatattacgaggaacaaaggaatgaatttgagaacttcgtggaggaacaaaacgatgagcaggaagagaggagccgggaggctgtggagcagtggcgccagtggcactatgacggcctgca

SEQ ID NO: 7427 - DNA, 439 bp, Homo sapiens
  misc_feature 237, 239, 269, 302, 327, 330, 399: n = A,T,C or G
gttatatctcctggcttcagaagcagatactgagcctcaaatctgctaagattgccctgagtgagattcttatctcctgtagagaaaactgaaattgtggaaagacagacacaagctcttattatgtgcatggctgacttgcaatgaaaggcgcacctacagccctgccaggtgtctactgttaaagtgagggcattgattggaaaaaaaaaaatgggaacctgcaacttgggatgngngggaggaccgtgatgaagctggggacacanattttgtaaactttgatgaatctcttttgccanaaggaatagtttttccatccacagnagnggcaacatctcctccctgacccatgctgacatcagcctttccaccttggtctgaggagataaaccctgngctgactgacacaacagtgatggcctcccctgaggcagtt

SEQ ID NO: 7428 - DNA, 439 bp, Homo sapiens
atgatctcaagagatgcagaaaaatttttcaattacattctaatttctttcatgattttaaaactttcttagcagaccaagaacagaacattcttaatctgataaaaggtagctgtaatgacatttagcgcctcagtcatatttaatgataaaatggaaagctttccttttcagatcaggaacaaaacaagggtgcctcctgttaactattttcctcaacagtgctttagaagttctggccagtgtactagtataagaaaaagaaataaaatataaaaattagagggggggaaacctgtccctttatttgcagatgttatgaatatgtatttagaacatgaaagagaacctatggataagtcattagtattaataagagagtagggttcctgagtataaaatctgtacataaaaatcagttcttcctgccagcagaggt

SEQ ID NO: 7429 - DNA, 218 bp, Homo sapiens
atgaggtggcaagaaatgggctacattttctaccccagaaaactacgatagcccttatgaaacttaagggtcgaaggtggatttagcagtaaactgagagtagagtgcttagttgaacagggccctgaagcgcgtacacaccgcccgtcaccctcctcaagtatacttcaaaggacatttaactaaaacccctacgcatttatatagaggagacaagt

SEQ ID NO: 7430 - DNA, 439 bp, Homo sapiens
gtgggcgactaccagagcgaagcgagcggcgtgtaggcggggtgaagacaacgccaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagc

SEQ ID NO: 7431 - DNA, 355 bp, Homo sapiens
gtgatctagtcaattgtcagtctaccagagaattaagaaaaacattgaacttcacaattgaaaggggagcaatctgttttttcctctccttcctgaagtttcctggtttatgtcaaatatcttcctcctccactctcttaatatcaagacacagtagaggagacactttttgtcagggttctattaaatattcttccttgggatgtgggagcctacttgacttatatttacacatctaaaaggactacttggtaattcatccaggaagaaagatccactctagtgttgattctttattttatagatgaacaacaatagcaacaaaacatttgaaagctttcaatttgatgacttt

SEQ ID NO: 7432 - DNA, 439 bp, Homo sapiens
ggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccggg

SEQ ID NO: 7433 - DNA, 439 bp, Homo sapiens
cggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggc

SEQ ID NO: 7434 - DNA, 437 bp, Homo sapiens
atttgggacaccctcttaccggaatccttaccccaggcacaacaccatatgattagaaagagactgccaaaccctcagcttttccgcggagaaagaattggttcatgcctctagcacattcaggagctcagagtagcttgtcttgccagccacatggggggagaatagagatggctgtttggccttgtagattctacagttcctcctttcccatcagcacagagagatcagatgaaaaatctcagctctcaacttcctcctgggagagaaagagttgatccttgtgtccagcgttctaacttctctggggctgccccagagaactggtatctgttttgtcagccttagacctctaacgggtgttgtgcagtctaactgcctgggggagaacagagacagtggcttgggttggtagatgccatagtgccttcccctga

SEQ ID NO: 7435 - DNA, 337 bp, Homo sapiens
gaaaacaataatgaaaagcacctggtgtaaatcctggttcacagtaggtgttccataaatttagctaatttgctactagtgacaattcaactggacctttcccagtagcaggcagtacctatttttaaaaaattagctgttgttaaataggtactattctaagtggttgtaaatagtgtgaaacatctgtttgagttctcacagtaaattacaactgttttacgtctgctttgtttggcattacgctcagttatgacctaagcttgattttattcagctgttaaaatgagttttatcagagatctgaaatgtaatcattgaactttaatggtaaatt

SEQ ID NO: 7436 - DNA, 437 bp, Homo sapiens
tgatcagagtcaggcttctggaaccacaggtggccgaagggtctcaaaggctctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattctttggagaaggtatttgggattcaattga

SEQ ID NO: 7437 - DNA, 439 bp, Homo sapiens
catggctgttatactgacttgttttctttcaaattcatgttagaaaaatctgtgcgtgtgtgtgtgtgtgtgtctgtgtacacaaatatttatattaccgtgtctcagtgctttgagactgtgtgaggcgggggaagagctgttgaggctttttatagataaagttgataatgcttttttgacttggttttctgttaccatcttttttgtctctattatgatatctattatataagtcagaaggagaaatgacacaaatgccagtataccagttcaagataggatcttggtttgatttagctaaaatttaccctacttattggtgcaatttttaataatagaaaaccattcctcattgcttggaatttttatctgcactttccattttgaatattattgttagttgttgaacaccaggtttactctgcaggacaccaag

SEQ ID NO: 7438 - DNA, 439 bp, Homo sapiens
ctcgtgccggcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgac

SEQ ID NO: 7439 - DNA, 320 bp, Homo sapiens
caggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttacgctatctgcggggccattcgtaggatgggtgagtcagatgattccattctccgattggccaaggccgatggcatcgtctcaaagaacttttgactggagagaatcacagatgtggaatatttgtcataaataaataatga

SEQ ID NO: 7440 - DNA, 417 bp, Homo sapiens
ttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggc

SEQ ID NO: 7441 - DNA, 188 bp, Homo sapiens
tcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatg

SEQ ID NO: 7442 - DNA, 137 bp, Homo sapiens
atgaaattgtacattgtgtataattgttcattagaaaggacagttttacatgaatattcatatatttattttgttttaatttgaattgcctgttcagggttccttatgcagagaaataaagcagattcaggaattgg

SEQ ID NO: 7443 - DNA, 439 bp, Homo sapiens
caggcatgtgccacgacaccaggctaattttttgttttgacgaggtctccctatgttgcccagtctggtcgcgaactcctagcctcaagcaatccttccaccttggcctcccaaagtgctgggttactggcgtgagccactgtgcctggccaaggctgcttttaatcggttctgattaccaccccaaagtgactggcatgagaatcttaaccccggctgaacagagggaaatttctttggcagtttggccatcttcccagagccagacctacatgtttagtaagaaatgactcaagtatctaaataatcaccgcagcaaggattctcattttttccccttttccaaaagtttgggtgttcttataagtactcagaaaacaattctttgcttaagaaaaaagcttaaaattgggggaaaaaaaattcaagaaaattaaat

SEQ ID NO: 7444 - DNA, 435 bp, Homo sapiens
ctcagagtgtgcccgctgcgccgccgctgtccgtacctgccgccgccgccaccgccaccatgcccaacttcgccggcacctggaagatgcgcagcagcgagaatttcgacgagctgctcaaggcactgggtgtgaacgccatgctgaggaaagtggccgtagcggctgcgtccaagccgcacgtggagatccgccaggacggggatcagttctacatcaagacatccaccacggtgcgcaccactgagatcaacttcaaggtcggagaaggctttgaggaggagaccgtggacggacgcaagtgcaggagtttagccacttgggagaatgagaacaagatccactgcacgcaaactcttcttgaaggggacggccccaaaacctactggacccgtgagctggccaacgatgaacttatcctgacgtttggcgccg

SEQ ID NO: 7445 - DNA, 436 bp, Homo sapiens
gtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtggggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatc

SEQ ID NO: 7446 - DNA, 439 bp, Homo sapiens
tccagactgaggaagacccggaaacttaggggccacgtgagccacggccacggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcgggctactacaaagttctgggaaagggaaagctcccaaagcagcctgtcatcgtgaaggccaaattcttcagcagaagagctgaggagaagattaagagtgttgggggggcctgtgtcctggtggctt

SEQ ID NO: 7447 - DNA, 439 bp, Homo sapiens
gaaacttccagctcatgagggacctagaccaaagaacagaggacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagaaaggccggactcaaaaggagaagaaagctgctcgtgctcgttccaaagggaaaaactcggatgaagaagcccccaagactgcccagaagaagttaaagctcgtgcgcacaagtcc

SEQ ID NO: 7448 - DNA, 439 bp, Homo sapiens
gccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtggggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcag

SEQ ID NO: 7449 - DNA, 300 bp, Homo sapiens
ccccaagtgtcacacaggcactttgtacacatcctggttttctaagaagggaacttgccatcaagattcctgtaccaggcccacggccgtctcgggcagagccacctgggccccgggtgcagccggagaccccgccgagcccctcctcccagtattcccatccccgcatgcttctagggagcgcctcttttccgttcttgaggaatttctgttctggggcttgtccttcctttgcagctgttttgaatgtagttttccttttctatttatttgcacattaaagttaataattgaatattg

SEQ ID NO: 7450 - DNA, 109 bp, Homo sapiens; identical to SEQ ID NO: 7127

SEQ ID NO: 7451 - DNA, 313 bp, Homo sapiens
gaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctatt

SEQ ID NO: 7452 - DNA, 439 bp, Homo sapiens
cctgaaattccaaaagcattttccaatggaaacactgttataaatggtgtctcctttccaccaatagtacatccaggtaatagggaataaataggcttctgcaggctggcaaaggcaacctggctcatttataagattacacaaaaaaagcctattccaagttccacacaaccttcttgttgatttctttttccttcttcaaacgttcatttaatatctttttgctgaacctgcatttccttctgcctggaattcactgctctccttgaaagttcctatccgccattcaaaaaccaactgaaaggtcttcagtgaaggttttcctgagaactatcacacttctgttaggccccaaatacacataaaaaccctctcccatcttctatgttccgcagcattttggatctatcttttcacttatctgtttccatcagggttg

SEQ ID NO: 7453 - DNA, 439 bp, Homo sapiens
tgcacaacccgtgttccaggtgcacatcctcccaaggagacacccagacccttccagcacgggccggccaagttgctgcggcggaggcagcatttcagctgtgaggaaggtcattggattcatgtgttttatctgtaaaaatggttgtcttaacttcttaacctcatattggtaagtgattgataaaaattggttggtgtttcatgacatgtggacttcttttgaaatagcaagtcaaatgtagtgaccaaattgtggaagagatttctgtcaaataggaaatgtgtaagttcgtctaaaagctgatggttatgtaagttgctcaggcactcagatgacagcagattctgggttcctggggagtgttctgtgcctcttacatgccctggaggcctcatggtctcagtgctgaggcggcacacctgtagcacacctgcgt

SEQ ID NO: 7454 - DNA, 347 bp, Homo sapiens
ctgaatggctgacctgacctgatgtccattcatcccaccctctcacagttcggacttttctcccctctctttctaagagacctgaactgggcagactgcaaaataaaatctcggtgttcttatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattat

SEQ ID NO: 7455 - DNA, 440 bp, Homo sapiens
attttgtggtgttaagtgtctttttaaaaattgttatttaaatcctgaagagcatttggggtaatacttccagaagtgcggggtaggggaagaagagctatcaggagaaagcttggttctgtgaacaagcttcagtaagttatctttgaatatgtagtatctatatgactatgcgtggctggaaccacattgaagaatgttagagtaatgaaatggaggatctctaaagagcatctgattcttgttgctgtacaaaagcaatggttgatgatacttcccacaccacaaatgggacacatggtctgtcaatgagagcataatttaaaaatatatttataaggaaattttacaagggcataaagtaaatacatgcatataatgaataaatcattcttactaaaaagtataaaatagtatgaaaatggaaatttgggagagcc

SEQ ID NO: 7456 - DNA, 428 bp, Homo sapiens
taaagcttgagagcaactttgcctccattgtgtttgccatcatggtgttggaggggcttggccgctcactggaccccaaactggacatcctggaggcagcgaggcccttcctcctcacgggcccagtgtgccccccgtgatggggcagtggcctctgtgggcccttgtcaagagctggaggccactcccaagagcctctcctatggcagctgggacgttttaaaattgggacaccaatttcaaatgtaaccctccagtggtggaaggcacaccatggcttcctctgcttggtttgagggtctgttcaaaagctttgggccaattagggagtaaaaggagggaaggggcctatccattccattgtggaagctgggccaggtgccagggacactctccttcagggaaaatgttattgtggaggaggacga

SEQ ID NO: 7457 - DNA, 183 bp, Homo sapiens
caaggttgggaccatcactggttaactggccttcctgcctttgggctgttgttctttagcccattctgcacactgataccagagtgatgatcctactgtgcccatctgatcagttcacacctctgctcaagaactttctttggctccctactgcctcctgaataaaattcaaacgtagcctga

SEQ ID NO: 7458 - DNA, 292 bp, Homo sapiens
tcgccaggaagattatcccagcttgttcaggagggcttgatgtcctcacccgggtctgtataacagaagagcaggtgacgggagaggaggttggaggtgtagcgatggagcaggaaactggagttgaggagggcagctcaagccacagagtccaggccacctcagagccaggaaatgcatcctcccacagagccctggaaggccccagccctgctcccacctggactggctcagtgaggctaattttataattctggctgattttagaactctaagggaataaatttgtgtt

SEQ ID NO: 7459 - DNA, 439 bp, Homo sapiens
atgactttatacccttggtactatactaggaactttacatagtatctctacttctcacagtcttgcaaagtaggtgatattattcccattttatagttgagaaaacggaattagtgactgtacctataacaccagtaaatgcagagccaagattctgacccaggtctttttgttgtaccataagtttaaaagatgagtctcatttttcttgtggtagatggtggtaaaaaggagtaggcagagtgtacatagataaaaaaaagtaaaagggtaagtaaaaaattgattgtggtatatgttattctaatcagccaaaaaagtttagaagattgatgaaatgatcttttaaatatgtatttctgaataaaatgtaaaaccaagaaagttatttcaggaaggatagtgaccctttccttgaactgttagaagggcatttatt

SEQ ID NO: 7460 - DNA, 122 bp, Homo sapiens
cccagccttatgtttcttttaatgacttctggatcctgagctccctttgcagtctgaaaaaggtattgcagtcagaactgtgtactgatgataaaagcctctggtagcaataaaaagttgtc

SEQ ID NO: 7461 - DNA, 356 bp, Homo sapiens
ctcgtgccgttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatc

SEQ ID NO: 7462 - DNA, 439 bp, Homo sapiens
gcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagat

SEQ ID NO: 7463 - DNA, 439 bp, Homo sapiens
ctcgtgccgcttggttgcagatctgttcgcagaagctacctagaagatatttcattcctttgtatggggagacattcaaatatttgaaatcacaaatctgctcttataaaaaattggctaagtaaattcttctttgactgtgtagaataaacatgcatacagttgtctttgaagtcgttagctcacattgaaaagaaaaagtttagaagaaattaaatatataattttgggggaaaatttatctataattttagctcatagtttacaattcctatatgactgtttggaaggtatttattttagaatggatggatgttccgtattaacctgtaggaagggtttgtgaatattctgttgctctgaattattagcggtctagatctaggctggactttgagaaatatgaaataaaaaaatacctctttggagtgtggtgttg

SEQ ID NO: 7464 - DNA, 169 bp, Homo sapiens
aaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatt

SEQ ID NO: 7465 - DNA, 437 bp, Homo sapiens
  misc_feature 89: n = A,T,C or G
ctttctatgcacagatttcaaggtgctaacatagacacgacagtgtgcgtagtgtggtggattgagactagatgttcaagaagcctcanggaaactggagaggaagggcagaacgtgtgattgttaaaaacgtcagagaaaagggcaaggttaggtaaggcattttgactactcaaggtagaagtctgagaagagagaaagctagtaagtggttactgatatatgtttggaaattctaggggagaactctgggtttttcctaaaaactggaataaaacaagggattttcatttcaagccttagtcgctttggggttcattgtgaaatacgatgcaaaaacagtgttatttgttgtgaagctgcctaagaaaaggtctcacctcgcaccacctcagaagccttacaaaggtgtagggtttttccctgcacctttatcc

SEQ ID NO: 7466 - DNA, 439 bp, Homo sapiens
gcttagtgtcatctttggatgctgtcatatgctgctttgagtgaaccagagaaacagccatttgcagcatgagaaagccccaaaagctctgggatttacctccactttagtaataatgaatattttttagcattagaatgtgttatgtcatttgaattaattttgactacactttggcttgggagaggaattattttaaatagacattggtactttttgaacttgatagctaaagattctaaaatgcatgttttatactaagttttaaccagtcaggaaaattttatgtaactagtgatagtttatttttttgtatgaattttgtttaggctgcaatgtttagcttttgttaactcctcactcttgctgtcttaagttcattactatgtttaatggcctacttgccaagatatttagcatgtaaaaagcagggttttga

SEQ ID NO: 7467 - DNA, 415 bp, Homo sapiens
ggcaaccgccaagcccccctcaaggtgggacagtaccccggacccatccactcactcctgagagggctccggcccagaatgggaacctcagagaagagctctaaggagaagaaaccccatagcgtcagagaggatatgtctggcttccaagagaaaggaggctccgttttgcaaagtggaggagggacgagggacaggggtttcaccagccagcaacctgggccttgtactgtctgtgtttttaaaaccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaaggg

SEQ ID NO: 7468 - DNA, 439 bp, Homo sapiens
ccgcatcttcttttgcgtcgccagccgagccacatcgctgagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgacgcccccatgtt

SEQ ID NO: 7469 - DNA, 439 bp, Homo sapiens
gttcaagtgtcctctccaacttgagaagctctcccttctcctggtgtctatgatccaaggctgtctcctgtttaccctcagcctccttccccagtgtttactcagcactggaacatcctacccaggcctactgcccttaaggctggtctgcatgtagaacccatattcatccaatcttctgtcaaaaaattgacttctgtaactaacggtagagtagaatgaactcttttgtacaatttaacttcagtaaatgaatttctaattgccatttttactttaggtcagaggctgtaaaacttgaagaaaggagccaagatcgccagaaatacagtggtggtattatagcaaacatgagatcctaagtcctttttcaaagcgtgcctgctccctgcaagaggaggaacagtggccaacccactcaatcagctgttgccatgtg

SEQ ID NO: 7470 - DNA, 195 bp, Homo sapiens
cataagcttcagtgcaggatttttcaaagacgagctgttgtgcaatttgctgtatttaatgcatgttctgaaaggattcacttttgactttatatgacagttgatcaagaacaggtactacccctttttttcatttcaaacttgaaactgtgaataaggtaagaaaactattttgaataaataaactatttattt

SEQ ID NO: 7471 - DNA, 322 bp, Homo sapiens
cgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 7472 - DNA, 228 bp, Homo sapiens
ggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttg

SEQ ID NO: 7473 - DNA, 116 bp, Homo sapiens
ctttgagaagaatttaattatgtctcatgaggtatcaaactatgtaattttgtccttgttatttttgtttcctttgtaatttacttgatgagtttatatcttcattaaagaatgtt

SEQ ID NO: 7474 - DNA, 243 bp, Homo sapiens
  misc_feature 239: n = A,T,C or G
aattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtatttttttttttaaataaaagcncaag

SEQ ID NO: 7475 - DNA, 274 bp, Homo sapiens
atggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggtttcgttggcttgtaagaacctaaagttcttatgagattgtccaaaacaaagaaacatgtcagcagggcctatggtggttcccatgtgtgctaaatggggttccgtgg

SEQ ID NO: 7476 - DNA, 135 bp, Homo sapiens
ccaccgtggaggaggaaggcaagagggggtggaggggtgtggcagtggttttggcaaacgctaaagagcccttgcctccccatttcccatctgcaccccttctctcctccccaaatcaatacactagttgtttct

SEQ ID NO: 7477 - DNA, 458 bp, Homo sapiens
ggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttc

SEQ ID NO: 7478 - DNA, 313 bp, Homo sapiens
  misc_feature 219, 288, 302, 309: n = A,T,C or G
gacagatgaacagccgaaagctggccagaccctcctgtatgcctctgcccttgtcctgtgggttgagggggtctgaccaggaggccacctacagcaggaagtgaggctgccatgtttccttgagacacagctgcctctccccagctctgtccctgtagtcacctgccggtgggcgaggatcctctccctgggataagcactcccagccccgtttatcanaaacacaggcaaggaaattggaactgccacccagcccagcatggtggctcaattggttggttgcgttgncagttgtctcttcnttttgtnaagg

SEQ ID NO: 7479 - DNA, 437 bp, Homo sapiens
gacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtacttttt

SEQ ID NO: 7480 - DNA, 439 bp, Homo sapiens
tcaccctgtatgagagggatgaggacaacaaccttctgactgagaagcagaagctgcgggtgaagaagatccatgagaatgagaagcgcctggaggcaggagaccaccccgtggagctgctggcccgggacttcgagaagaactataacatgtacatcttccctgtacactggcagttcggccagctggaccagcaccccattgacgggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagaaggatatcgacaaggatcttgtgatctaaatccactccttccacagtaccggattctctctttaaccctccccttcgtgttt

SEQ ID NO: 7481 - DNA, 436 bp, Homo sapiens
gcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgcctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatat

SEQ ID NO: 7482 - DNA, 270 bp, Homo sapiens
ggagggtggagtgggcctcgggtccccctgaactccctgtatatctgtataaataacgggattttcatggcgccgccccacccgcattatcactgcgtgatggtctcagtcagtctcctccctgtctccactctttccctctatttatttcactctcttgtttggttctaccctgcaccctcggtccccttccaggttcctgtttataagccccaacccctctgtccccatcttgtatgtgaaaacttgtctcaataaaccctttggagt

SEQ ID NO: 7483 - DNA, 439 bp, Homo sapiens
cctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaacctggtttttttgggttttttttt

SEQ ID NO: 7484 - DNA, 345 bp, Homo sapiens
tgaactcctaggttcaagcaatctttctgactgggcctcccaaagtgctgggattacaggcgtgttacaccctgtgcccagctaattttttgtatttttagtagagacggggtttcaccgtgttagccaggagttcaagaccagccttagcaacatggtgaaacaccatctctaccgaaaatacgaaaattatccgacttgatggcaaatgcctgtaatcccagctttccagctacttgaaaggctgaggcaggagaatcagttgaacctgggaggcggaggttgcagtgagctgagattgcaccactcactaaagcctgggcaacgagagtgaaactccatctc

SEQ ID NO: 7485 - DNA, 436 bp, Homo sapiens
gccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtg

SEQ ID NO: 7486 - DNA, 452 bp, Homo sapiens
ccctggtgtgccttggtgtcatcatcttgctgtctgccttctccggacctggtgtcaggggtggtcctatgcccaagctggctgaccggaagctgtgtgcggaccaggagtgcagccaccctatctccatggctgtggcccttcaggactacatggcccccgactgccgattcctgaccattcaccggggccaagtggtgtatgtcttctccaagctgaagggccgtgggcggctcttctggggaggcagcgttcagggagattactatggagatctggctgctcgcctgggctatttccccagtagcattgtccgagaggaccagaccctgaaacctggcaaagtcgatgtgaagacagacaaatgggatttctactgccagtgagctcagcctaccgctggccctgccgtttcccctccttggctttatgcaaatacaatcagcccagtg

SEQ ID NO: 7487 - DNA, 169 bp, Homo sapiens
ccggggtttcccgccgcactcagtgtgttccttcaggctagtgaggtttcattctgttttatttgcaagcttatcaaaagtttgtggaagatacattgttgggttccagaggctggagtcatgctgcccacatcttgtttgggaaagcaaaagctcccagtgagctggt

SEQ ID NO: 7488 - DNA, 326 bp, Homo sapiens
tccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggc

SEQ ID NO: 7489 - DNA, 437 bp, Homo sapiens
  misc_feature 426: n = A,T,C or G
gccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatggcggccgcaaactgacacctcagggacaaagagatctggacagaatcgccggacaggtggcanctgccaacaag

SEQ ID NO: 7490 - DNA, 360 bp, Homo sapiens
  misc_feature 355: n = A,T,C or G
ctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggggngaggg

SEQ ID NO: 7491 - DNA, 276 bp, Homo sapiens
gttgtcattttttgtcttagttcaccgtgatgttctcagtgttatgtgcttacagtctgtgccatctttcagactttcctctaagggggaaatggctttaatggagctctcaatgtaaaatagatgcattaacaaaatatggacgagagtagggagatcatcacaaagaatagctaatggatgctgggcttaatacctaggtgatggggtgatctatgcagctgtttaccatggcacgtgtttaactatgtaacaagcctgcacattaacccctga

SEQ ID NO: 7492 - DNA, 441 bp, Homo sapiens
cagcctctagccttcactcctgggctccaaaagctatcccagttgcctgtttttcaaatgaggttcaaggtgctgctttgcatgcctgccaacccatggaagttgtttcttacttcttttctctcttatttattaaccatggtctgagagttgtttttgttctatgtaacagtattgccacaaaactataggcaaatcgtgtttgcagggagatttctgatgcctctgtgggtgtgtgtaagttaaagtggccacatttaagaaggccaagctttgtagtggttgcacagtcacactgatatgctgatttgctctttctcattgtatgtctatgctttgtcatcagtgctatagtaaattacaaagaaataggtagattgtatgaacatacccacaaatgcctatgatttaggttaccaatgtattctttctcatttgggg

SEQ ID NO: 7493 - DNA, 439 bp, Homo sapiens
  misc_feature 339: n = A,T,C or G
ggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctanatattatcctactgaagatgtgcctcgaaagctgttgagccacggcaaaaaacccttcagtcagcacgtgagaaaactgcgagccagcattacccccggg

SEQ ID NO: 7494 - DNA, 448 bp, Homo sapiens
gaaaaaaatgaatgaaaaatatcttacagaaatgtttaaatattgattacatgttgaaatgataacattgtgaacatattggttagatagaaatatattaccaaaatgaatttcacctgtttctttttgctttttaaatgtggctcctggaaatgtaaactcatgtatgcagctcacatgctttttctattggacagtgctgcgttaggcaattaaacaagcaattacaatgtaaactcataaaattatggtgagcattaaatgagatactgccagtaaaatgcttagttcagggcaagcactttgtcaatattagctacagctaagcatcagacactggactgcaccccaacttactcctttccctgtctcagagctgagctctagttcccattgctgagggtgatttctttcctaggagtctcctgggtctttcatgtaaataggg

SEQ ID NO: 7495 - DNA, 430 bp, Homo sapiens
tataaaagcaccagcatccctacttgggtgatggggattaattttatagcattccattttcctagtgccacatgtgaaattggattttgatgatcttaatctatattctacccttataataaaagatcaaaagatatatctcctatgaacagattggagataggagatgaaaagttgggaggatgtctttattctaatgtgagggtagggaaaatgtggataacattactggggtgaaggaggcattgttctttagttggagttctcatttttattctccagtactgacttgtggggaaagcatactttttcactgccaggtactgaatgcagaggctcagtgaagtatatatgtgggaagtgcatgcatttcgtttattagcaaacatagctggattaagacaaagttgttggttttggaaaggggtta

SEQ ID NO: 7496 - DNA, 439 bp, Homo sapiens
ctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaagaggggatctttggactacgttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttat

SEQ ID NO: 7497 - DNA, 428 bp, Homo sapiens
agagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattggagggagtaggagactaaaagaatg

SEQ ID NO: 7498 - DNA, 328 bp, Homo sapiens
  misc_feature 199, 265, 271: n = A,T,C or G
cccacctgaagtttttataaatgtccattaccctgcactctcacccaaatttccatttagatttttgcctatctgatgtgattctaaaggaaacaggtttacttgacactatccttatattttattgagacatgttcaatggatgcatctcagttttatgcttttgagactctttttgagggcttgggtttttttttgngtgtgtgcccttatgcatagtcaactagtaagctgtacattgattatattctcttttgatgtatgngtttgngtgtatctttatatatttaggtttatatcatcaaatttattaaaaccctttatattc

SEQ ID NO: 7499 - DNA, 357 bp, Homo sapiens
gcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtg

SEQ ID NO: 7500 - DNA, 121 bp, Homo sapiens
tcaaaagcttaccagtgtggacttggtgttagccacgctgtttactcatacagtacgtgtcctgtttttaaaatatacaattattcttaaaaataaattaaaatctgtatacttacatttc

SEQ ID NO: 7501 - DNA, 439 bp, Homo sapiens
cgccgccgcttgtgctgcagccatgtctctagtgatccctgaaaagttccagcatattttgcgagtactcaacaccaacatcgatgggcggcggaaaatagcctttgccatcactgccatttaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccac

SEQ ID NO: 7502 - DNA, 375 bp, Homo sapiens
cctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtg

SEQ ID NO: 7503 - DNA, 260 bp, Homo sapiens
gcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactca

SEQ ID NO: 7504 - DNA, 234 bp, Homo sapiens
gaaaactgcagagaaagagcgattatttcttgtatatgctaagcagtggtggagagaatatttgcaaattcgaccctcacacaactcacgactggttaagatttttgcacaggtttgtaaattatattagaataattttatgcctgtatttgagatttactgttatgtgtgtaaatttcatttaatatttatttgtaaaatgtattccaaaaaataaaagtgtatttgtaaaat

SEQ ID NO: 7505 - DNA, 401 bp, Homo sapiens
ccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaaggaatg

SEQ ID NO: 7506 - DNA, 319 bp, Homo sapiens
ggaatttgagctatcccagtcaagagactactttattttacccctatcctgtggcatatagtaactgctaaggtacaggctgaactgaactaggctagaagacagggttttgcaggtatctgatgatgtatcttagaagttatgtctaactccaaatactgagtcctttccattatacatcaaactaccttctacccctataatatttctaataaagaaatattagagggaatgtaatgatttaagagagaggtggagaacttggtaataaagacccaatttatgcctccgatttaactgcttggctttttaaccaggt

SEQ ID NO: 7507 - DNA, 462 bp, Homo sapiens
tgagaagccatgagcagcaaagtctctcgcgacaccctgtacgaggcggtgcgggaagtcctgcacgggaaccagcgcaagcgccgcaagttcctgggagacggtggagttgcagatcagcttgaagaactatgatccccagaaggacaagcgcttctcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctggccaagaagtatgatgcgtttttggcctcagagtctctgatcaagcagattccacgaatcctcggcccaggtttaaataaggcaggaaagttcccttccctgctcacacacaacgaaaacatggtggccaaagtggattgagg

SEQ ID NO: 7508 - DNA, 438 bp, Homo sapiens
tgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctat

SEQ ID NO: 7509 - DNA, 342 bp, Homo sapiens
gttttaagtcattcaggaaaatctaaacttttttttccactaaggtatttactttaaggtagcttgaaatagcaatacaatttaaaaattaaaaactgaattttgtatttattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgtcataaagaatttcttttatttttgaaatcgagtttgtaaatgtccttttaagaagggagatatgaatccaataaat

SEQ ID NO: 7510 - DNA, 439 bp, Homo sapiens
gcccctcagaactcaagacatccaaattttattgcgtctctacttatactggtttgcttttgatttattcctctattagttctataggagtgatctcaagtgagatagcagagcaagatgccaaaagaccataaatagagtaaggtttctatagatgtgagacagatttgagagagcatttactctgtctccctgtggatgaaactgctgctgaaatggttccaatttttaggaatctgcttacccacttcattatttgacagctttccttggtgacccaaaccttgtagcctaagccatttgtctttttctcagtggagggagtgtatggacctggccccatggctttgcatgttagagacctggcagactaaagtctctagtgtttgtttgctcacatttgctgagtgacagctatgtgccagactgcataaagggt

SEQ ID NO: 7511 - DNA, 365 bp, Homo sapiens
  misc_feature 329: n = A,T,C or G
ggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcanaagtgtctatagaacaataaaaatcttttacttctg

SEQ ID NO: 7512 - DNA, 359 bp, Homo sapiens
gcggtggctttccagattttatgccagttgcaccagcatgcagaatatttgtaatgcatttcaaagtggatataatggcaccctttgtcagaatcacaaagctcactgcggcactgctacaagaggacactgaggaaaatctggccctatgaacctagtcaaccccaagcaaaaagaatgactatgtgtgtgagtgcagcacatggccagttcgtttctcactgttttggaaagccctgtgtgccaaaccaaggacgtgtctttcagggaaaggttaattttccgaagtttattaaaatagaacttggaaaaccaagcattttgaatttattccagcctgggcaacagagcaaaacccc

SEQ ID NO: 7513 - DNA, 430 bp, Homo sapiens
gcaaagttatttaacatatgaggaaataatctagagtaacagcacaaataacaaacagaaggactaaccccaaagaacttcagattattagcattaaagttttataattttaagattttagaagctggaaaacagatagtctagtgacaactgatttagcaaacaggagaaaccgtactgtaaaactgcagagaggagcactagcaagaggctctctgccccttccctgcttggtctcgaaacactaacagcctggctcctactccctaaattgggggtggcagtatacctctgggtaaactgagcagtcggaagatgaagtcatgtgggggtgatcctcaaatgaaaaaattcattccttatcttgcccccactcctcacctaactgccagtcaactatttaatgtgaacaaaaagccaggtatttggg

SEQ ID NO: 7514 - DNA, 401 bp, Homo sapiens
  misc_feature 264, 392: n = A,T,C or G
cgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattancccacataccagtaacttaaagatgggatggagttgtaaagtgcttttataatacaatataattgttaaaggcaagggttgactctttgttttattttgacatggcatgtcctgaaataaatattgantcaatatgg

SEQ ID NO: 7515 - DNA, 357 bp, Homo sapiens
ggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatg

SEQ ID NO: 7516 - DNA, 439 bp, Homo sapiens
  misc_feature 436: n = A,T,C or G
gcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaaaaacatgggnggc

SEQ ID NO: 7517 - DNA, 165 bp, Homo sapiens
  misc_feature 102, 161, 163: n = A,T,C or G
ctgagacagagttttgctctgtaacccaggctggagtgcagtggtgagatcttgacttactgcatcctcccccctcccaggttctagcagttctcctgcctnaccctactgagtagctgagactacaggcatgtgccaccacacctggctatttttttttncntg

SEQ ID NO: 7518 - DNA, 398 bp, Homo sapiens
  misc_feature 370, 372: n = A,T,C or G
ctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttcccctgtacagtanantttccaaatgtaataaactttaatat

SEQ ID NO: 7519 - DNA, 408 bp, Homo sapiens
gtaacacctcgttttcatcctaacagaggagtaggtgcgaatggcaccagcatggatcgttcctttcttgatcattactcatgcttgccactgtagcaacacaacaaagccatgattgtaattaatactaggctaaagaccttgatcaaaatgggagctcatttactgttctatgaggtatgtaagtaacttctcttcacattttccctcagagataaaccacacgtggtagtcttgtttgcgttagtactaaggtcatgtttgatctgtcccagacgagtcgcatatttcctgtagctggagtgttgctcaccataaatggtcattttcaaaaagtattgtgtaattccagctgtacaactgaccagtgagttatctgtcatcactgttgcccacatacccgtcctt

SEQ ID NO: 7520 - DNA, 415 bp, Homo sapiens
ccctccccccgagcgccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaacagattacatgaaatcaataccgtgaggatggtgtgaccc

SEQ ID NO: 7521 - DNA, 437 bp, Homo sapiens
ggcgtcaaaggtgaagcaggacatgcctccgccggggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctggaggaggaggccatcatcatgaaggacgtgcccgactggaagggtgggggagtctgtgttccacacaacccgctgggtgccccccttgatcggggagctgtacgggctgcgcaccacagaggaggctctccatgccagccacggcttcatgtggtacacgtaggccctg

SEQ ID NO: 7522 - DNA, 334 bp, Homo sapiens
  misc_feature 313: n = A,T,C or G
gaaacgcctttacatttgtgcggatagagaagttaactctccctcatatgtcactgtgctaccataatccctacattttctgtctgttctagtctaagaatattgttatagatggaagttaggaccattagcccacagatgcgtgtattctctcagacataccggtgtagatgccatatttctgatgtcttcttaatgtctgtgaaagcaactggcatctacaataaatcacacttagaactggttagaggactccctcacttttgttgtccatgtggttcccttccgtggaccagccgtaataaagagccangggagtgatggtggccacgtg

SEQ ID NO: 7523 - DNA, 435 bp, Homo sapiens
tagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttcc

SEQ ID NO: 7524 - DNA, 257 bp, Homo sapiens
ctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcaga

SEQ ID NO: 7525 - DNA, 303 bp, Homo sapiens
gctaaatagaacacaagattttgaaagacttgagtcaaaaacagtaggcaaatcaaagaagcaatcccaaacagatgctatctttcagaaattaacagattatttcacctgcaacatattcccatcctagaaagggcattcctgcattacaatcatttatgcttggataaaggcaaaacgaacagatgtccaagaaccaccctcattacctgaggcctatggcagaaacatgtctcctttcttggagtctgagtagacttgatcaaaatcacccacaggtataaattcacattataatatcac

SEQ ID NO: 7526 - DNA, 437 bp, Homo sapiens
  misc_feature 177, 243, 287: n = A,T,C or G
gcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaanacctcacgcctccccatcattgacattgcacccatggacataggagggcccgagcaggaattcggngtggacatagggccggtctgcttcttgtaaaaacctgaacccanaaacaacacaatccgttgcaaacccaaaggacccaagtactttccaatctcagtcactctaggactctgcactgaatggctgacctgacctgatgtccattcatcccaccctctcacagtttggacttttctcccctctctttctaagag

SEQ ID NO: 7527 - DNA, 314 bp, Homo sapiens
ctgaggctccagctgcgggactactgcgcccaccacctcatccggctgctcaagtgcaagcgtgacagcttccccaacttcctggcctgcaagcaggagcggcacgactgggactactgcgagcaccgcgactatgtgatgcgcatgaaggagtttgagcgggagcggaggctgctccagcggaagaagcggcgggagaagaaggcggcagagttggccaaaggccagggacccggggaagtggaccccaaggtggccctgtagggggtgcaccccccaccctatggaccagtcaaataaaagccttcaggccc

SEQ ID NO: 7528 - DNA, 245 bp, Homo sapiens
gaaaaatgggctcaataatgagcatagtgtatgcccatggaaaagagaaagcattctcattaagcatttgtggtgatgatgatgatgatgatgatgatgatgacatcatcaaaagctccaaagggtaaattgctgcatttgccaaaggcagaactggatgagatgcatgcttcataaaataaatcaagggtagacaggatggcttcatcgactcttccttcagaggataagcagcaatttggaat

SEQ ID NO: 7529 - DNA, 336 bp, Homo sapiens
gtagcacggttagtagagcttcagatctgagggaatgtactcttgtcaaataaaagcctgtttaaatgggaacagttcactgtctgagcgttaagagaaaactgtctaaatagcatcaaggtggcaacacatagcgacataagctgggaattcaaagaaaagctgtgaccctcagtatggaattcagattgctttgcacaagggaggaaagccttcctctggactggggtgaatatgaagctcttgaattactgctgtgtggcttctgctttcacccatcatagccttgctctttaaaatgtttggcaaaaatcctcattttttgagggttttgtg

SEQ ID NO: 7530 - DNA, 415 bp, Homo sapiens
  misc_feature 411: n = A,T,C or G
gttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgngttg

SEQ ID NO: 7531 - DNA, 174 bp, Homo sapiens
ctgagctataatcaacggtgagctttaatgtctatgctgacagttaggttttgctctcttttgtaacaggttacgtagaccagcagtgtttaaatctaaatacgttgtgagtctgttatctgtcctatcgcgttttttaaatgactttttattctttatcatagctaagtaaat

SEQ ID NO: 7532 - DNA, 176 bp, Homo sapiens
cctgtctctactaaaaatacaaaattagctggatgtggtggtgcacgcctgtaatccagctactcgggaggctgagtgaggcaagagaatcgcttgaacctgggaggcacaggttgtagtgagtcgagatcacgccactgcactccaggctgggtgacagagtgagatattgtctc

SEQ ID NO: 7533 - DNA, 424 bp, Homo sapiens
  misc_feature 308: n = A,T,C or G
caaacattcataatgaaataaggagaaaatacttagaacaattacagttcttgtttctgtaactggtcacatggttattgctggtatttataacttatctattcaatttttttttcttgtttgccttctgcaagaacctcatgattctttacccagcagggtgacccaaaggtttggcccatttgtagttctgcctggattgcatttttgtagttatccattggccctaatcacaacgtggagtaatactgagaaacaccctaaggtatctcctgtactgtagacatactcttcaattcttccattgnggagtagtagttcagtttctccttgatagtccagatgaatcacctcagccaacaacaccacaactccctctttacctgttgactcagaggcacaaggagcccagagtagctgggtg

SEQ ID NO: 7534 - DNA, 439 bp, Homo sapiens
gtggcttaatccttgtcatgttttcggctcatggacacaaggacacattttcatgccttctctcacagggctctgcggctccggttcacttctgtgtctttacactcccttcacagagacacttgctcccccttctctcgttcttggcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggag

SEQ ID NO: 7535 - DNA, 222 bp, Homo sapiens
ccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgacc

SEQ ID NO: 7536 - DNA, 425 bp, Homo sapiens
  misc_feature 405: n = A,T,C or G
acgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcgggaattganggatgtcaccccccatcccc

SEQ ID NO: 7537 - DNA, 446 bp, Homo sapiens
ctcgtgccgcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaagg

SEQ ID NO: 7538 - DNA, 442 bp, Homo sapiens
  misc_feature 293, 400, 422: n = A,T,C or G
ccgcctgcagctgaacgacctcctcatcaaacctgtgcagcggatcatgaaataccagctgctgctcaaggattttctcaagtattacaatagagctgggatggatactgcagacctagagcaagctgtggaggtcatgtgctttgtgcccaagcgctgcaacgatatgatgacgctggggagattgcggggatttgagggcaaactgactgctcaggggaagctcttgggccaggacactttctgggtcaccgagcctgaggctggagggctgctatcttcccgaggtcganagaggcgcgtcttcctctttgagcaaatcatcatcttcagtgaagccctgggaggaggagtgagaggtggaacacagcctggatatgtatacaagaacagcattaangtgagctgcctgggactgggangggaacctccaaggtgaccc

SEQ ID NO: 7539 - DNA, 177 bp, Homo sapiens
ctcgtgccggacaaagcaagaatgtaggtttgctgtgtaggtttggtgctctattgattggtgagtgaccagagcaagtatgaaggtgatgctgccaaagcacaagccagtttcttgggaaaattcaagttacagtggagtatttttttgaagaccatatgcttggaggtagaaaca

SEQ ID NO: 7540 - DNA, 334 bp, Homo sapiens
ggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccac

SEQ ID NO: 7541 - DNA, 439 bp, Homo sapiens
ggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggctgctgctaaggcacctacaaaggcagcacctaagcaaaagattgtgaagcctgtgaaagtt

SEQ ID NO: 7542 - DNA, 147 bp, Homo sapiens
cagatgccttcagattgtttttcagccttttcctggcctctcttttgagtctgtcatttatctaattcaggcatacctttcttgacctagtagatgtctatcaactgttgtgtccacacctagaaaatcaagtgccctattaagaag

SEQ ID NO: 7543 - DNA, 125 bp, Homo sapiens
aataaacaaacatgccctctaatatatgaattcatcacacaacacgcacactgtccccacaaacacctttttggtgtcaagaagaaaaagactagcttcactgaacagagaaatgctggacagtg

SEQ ID NO: 7544 - DNA, 439 bp, Homo sapiens
ctttacctgattcagaagaggagggtcatgataaccaggaagctcatcagaaatatgaaactatgcagtgcttcgctgtctctcaaccaaagtccatcaaagaagaaggagaagatttgcagtcctgcttgatttgcgtggcaagaagagttcccatgaaggaaagaccagttcttccctcatcagaaagttttactactcgccaggatctccaaggtaaatttcctctccaaagaagaccaaaggaatcattttagaatacttacatatttgggaatgcaaggactctatttagaagactgtaaggatgctagtactagcaattgctgctgcagtagaaatgtcaaggagttggaggaccggagagagagccactggctctcactgtatacccttttgttccatgtacttatgttacctagtttaaataaatacattt

SEQ ID NO: 7545 - DNA, 439 bp, Homo sapiens
cccgatggacaccaacctcttgagcaatatccagaagctattctctgaacgtattgatgtgttcagccctgtggagttcaacaaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggac

SEQ ID NO: 7546 - DNA, 440 bp, Homo sapiens
  misc_feature 301, 304: n = A,T,C or G
tagaatttagtgatactggctcagaagaatttaagttctattcagctttcctgggtgttagaacctagattcaaaatggcttgtctttgctacttttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagnagntccagtcctaactttctgaattatttttaaagatcttctctaacaagctatgggaatttggcttcatactctttctttgcaacagcagtgttctgggtgataattttgaattgatacctgttcctttttctgggtt

SEQ ID NO: 7547 - DNA, 215 bp, Homo sapiens
taacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtacttt

SEQ ID NO: 7548 - DNA, 460 bp, Homo sapiens
  misc_feature 353, 433: n = A,T,C or G
aagatttgtagatagtgtattagttaagacagctttgtcgatctggccagatgttttttctcctttgtccaaaggccagagaccatcccaggaagagtggtgggtggtttatacactggaaatgttgcgtttatgctttttaaaaacacacgttaacttcagaggaaggatgggcaaatctggtctagctgggtgaaacccttattttcccagagatgccttaacctttgttggttttggctttagggttcagagtcacttttgttcccttctccattctggagagggacttcccctacatagagccctgatttttgtggctgtggggattggaggtagcattcaaagatcanatgtgcttttcctcactttggagatgaacactctgggttttacagcattaacctgcctaaccttcatggtgagaaatacnccatctctcttctagtcatgctgtgca

SEQ ID NO: 7549 - DNA, 439 bp, Homo sapiens
ccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagtttgtgtagtagttaaggactatggcaaggagtctcaggccaaggatgtcattg

SEQ ID NO: 7550 - DNA, 438 bp, Homo sapiens
tgcaagcaagtttatcagagtatcgccatgaagttcgtcccctgcctcctgctggtgaccttgtcctgcctggggactttgggtcaggccccgaggcaaaagcaaggaagcactggggaggaattccatttccagactggagggagagattcctgcactatgcgtcccagcagcttggggcaaggtgctggagaagtctggcttcgcgtcgactgccgcaacacagaccagacctactggtgtgagtacagggggcagcccagcatgtgccaggcttttgctgctgaccccaaaccttactggaatcaagccctgcaggagctgaggcgccttcaccatgcgtgccagggggccccggtgcttaggccatccgtgtgcagggaggctggaccccaggcccatatgcagcaggtgacttccagcctcaagggcagccca

SEQ ID NO: 7551 - DNA, 287 bp, Homo sapiens
caaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttcttttta

SEQ ID NO: 7552 - DNA, 121 bp, Homo sapiens
  misc_feature 19, 20, 23, 67, 101: n = A,T,C or G
caaatccatgcacctgtannaanctcatttttgacaaaggtgacaagaacatacactggagaaaacnaagtctcctcaataaatggtgctgggcaaactgnatatccatatgcaaaagaat

SEQ ID NO: 7553 - DNA, 381 bp, Homo sapiens
ccaaaatgaaagcaacagtgatgtattgaaatcttagttttgatattttaaagaaatgactttctagattaaaaaaatagttttgtagcattttaaacttagtgactatttagttcaattgttcatccattttttatttgcttttataattgcctccttgttttggtatattgtaaaataatttaaataatgtatttataaatatgtataattatgatgtaaaataccgtgtgtatatgtatgtatgtgtgtttctgtatatgcacacacataaacggctttgcctagccaaggattttttttatctgtataaaactttttgtataaagtttgctttcaataacagctaatgtataataaaaccatgtaaagttttgttgt

SEQ ID NO: 7554 - DNA, 433 bp, Homo sapiens
cttgatttacacatcagtgaaagaagagaaaaacctcgacttgttgtataagtatattgttcataaaacatacggtttccacttcaccacacctgccttagttgtggaaaaggatgccgtttttatacctgcaggctgggacaatgaaaagaaaatagctattttacatgaaaattttacaaccgtgaagccggaagatgcatatgaagactttattgtgaaacctcccgtgagaaagctggtccacgacaaagagttggcagcagaagatgagcaggtgttcctaatgaagcaacagtcactccttgccaagcaaccagccactcccacgagagcttctgaatctcctgcaagaggaccctctggctctccaaggacccaggggtcggggagggccagccagtgtgcctagctcctccccaggcacgtcagt

SEQ ID NO: 7555 - DNA, 287 bp, Homo sapiens
atctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 7556 - DNA, 268 bp, Homo sapiens
cccgattgaagcccccattcgtataataattacatcacaagacgtcttgcactcatgagctgtccccacattaggcttaaaaacagatgcaattcccggacgtctaaaccaaaccactttcaccgctacacgaccgggggtatactacggtcaatgctctgaaatctgtggagcaaaccacagtttcatgcccatcgtcctagaattaattcccctaaaaatctttgaaatagggcccgtatttaccctatagcaccccctctacccc

SEQ ID NO: 7557 - DNA, 439 bp, Homo sapiens
ggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtagg

SEQ ID NO: 7558 - DNA, 284 bp, Homo sapiens
  misc_feature 100, 101, 250: n = A,T,C or G
gaccccagatctcctaggcccaggctctctcttgaccccagagaagccactgtcaggaaaggaagtgaaccctactgaagccagagaattcaccccggcnnaaagcaggccctctgggtccagcccctcattccacaccacaccagtattgcatccatctactgcagctacacatcctgagggcagcaccacccactctggcctgctggcccatcgcaggactagcccaggcacctgccgggcattgcangatatccagtggggcctgtgactgctccctgatg

SEQ ID NO: 7559 - DNA, 417 bp, Homo sapiens
aaaggatctttcaaaggtgtccaacaccttatgaatctggtctatcagattaatatctgaagatctacagtgtttttacatttaatttaaatgccattcttagaaggatcttgtcacaaagaagcctttacatagccccaccttgtctcagaagctagagttcattatcaaaacttaatttccatttcatatagctcaaaatcttaaaatctagggcatggccaactaaattactttgattctgtttaccttctctgatgacaattccatcaagccttaaataggaaaatgtcgaatctagggtaatttatcacttttgtgtgcatcttatctgagtccagccatctggtactgctgtgcattttgaacaccgtgggcataaacaatttgttgaattactaagtgaaaacaataata

SEQ ID NO: 7560 - DNA, 437 bp, Homo sapiens
caattcacttaatataaatgaaagctaaacaaaagctgtaaaagtgatatacaaatgaaaaatagtaatactaggattaggatgttaaatgaacactcatgactgaaaggtcttagaaacgagatgaaagaaagctaagaattagccattatggtgtcaattaataaatacaaagatgtactcagaacctagtagaatatatgcttgtatgcttgttttctttcagcggatggtcaagagtgtaggtgagtgtttcaagtgaaactatttgtttgacatacagaaaggtaaaagaacagaatatttgaagctaaaataactataaaaagctcagaacaactcctttgattattcactttgaataagtataataaaaacatttttttccctgtctggtggacaaaggtaaaaaataacatttaattacagtaaaatac

SEQ ID NO: 7561 - DNA, 346 bp, Homo sapiens
gacctgtttgccaacatggtgctgtctggtgacacccccgtgtacctgggcatcacctacatgatgcagaagatcacgaccctggtgcccagctccaagaagatcatcaccttccctgagcgcaagtcccttgtgtggattggcagcaccatcctggccgccttccagcagatgtggatcatcaagcagggagtaggatgaatcaagcccctgcatcacccactgcaaatgcttctaaatggactgcaagcagacgcgtgtcatgtgcttcatggattaatgcagaagtataaatttgcccctggcaaatgcatacacctcatgctagcctcaataaaccagaata

SEQ ID NO: 7562 - DNA, 416 bp, Homo sapiens
ggtttgctttgtccttccaaagcaggtgagtcagccccaccgagagccaggcagctttgagtggcagcgtggtgctagcagcttcagcggaacagggtgagagttaattatgcagtcttcttgacagcggcattaatttggaaggaaactgacaagtcatgggtcaagtttcagtgacttcctccttcctctgatggcagtatatagttttcacattttaattcctcctcctgagatgcactatacttaaaaccattctctcccctgctaacagaagggtgtgaatctggtttactttgagcattaggatttgcccctttggaattctgcactccagttacttaactttcccttcagaatacatgtggaaagaaagaaagaaatagcgatgactccacttttgcccctgtggcacc

SEQ ID NO: 7563 - DNA, 456 bp, Homo sapiens
aatataaaacagaagaagcttttcccccctcaagattaacatccctaaccgtgctgttctcccacctcttgtttcaattgtgtttcaggtcgtcatgttggcaatgtacaacttgtctctggaaggaagtggacgtcaaggttatttcaggtggaaagaagatatctgtgcttttattgagaaacattggacttttttactagggaataggtaatgtgtttttaaaaaatcttatacttcaaggaatatgtaaagaatgaagtatacaggatttgagacagcctaatgtagacttgttagagatttattttaatttttttgagatagagtctcccaggctggagtgcagtggcatgaccatagctcactgcatcctcaacctcctgggctcaagtagtcctcctgcatcagcctcctgagtagctggggattacaggtgtgcaccaacatgcctgg

SEQ ID NO: 7564 - DNA, 167 bp, Homo sapiens
gaaagctgcaccaaatcatctgcctgttttttcttgatacttactgaaatagaaggttttattgcagggtttattttggtttgtttatatctttgttgtgaatgatgcttttttgtatttattaatatcaaattcacttatgaataaacttgataatggaaacggcc

SEQ ID NO: 7565 - DNA, 274 bp, Homo sapiens
ctgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaat

SEQ ID NO: 7566 - DNA, 289 bp, Homo sapiens
ccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagt

SEQ ID NO: 7567 - DNA, 131 bp, Homo sapiens
  misc_feature 120: n = A,T,C or G
gctttgtcctgcatgaacagagttgatgaaagtggggtgtgggcaacaagtggctttccttgcctactttagtcacccagcagagccactgggagctggctagtccagcccagccatggngcatgactctt

SEQ ID NO: 7568 - DNA, 435 bp, Homo sapiens
gtcctcattgatttattatctgatataagggacatataaggagacatatcaatctcaaaaattgtctcaaaaggttttattttttttaaccacagataatgaaacaaccaccatcggttaaatttgatccaaaaatattgcatctaccagcattttcagtggataagttataatttctgaaagaccaagattggaatgactttttgtaacaagtgtgctcgcagatcgactccagtgagaagagctcggggacctcctgagccaagtttaatctcctttgctatttgtgcatggtggctggtcaccaggaggtggccaccaggcttctcctttccccgctgttctaattgctaatccagtatttgcggatagctccaaactgggatattgttctcaggcgctgtggtctcaccttccactggggcaacaatgggc

SEQ ID NO: 7569 - DNA, 310 bp, Homo sapiens
gctaaatgaataacatatggtggactgttattaagagtatttgttttaagtcattcaggaaaatctaaacttttttttccactaaggtatttactttaaggtagcttgaaatagcaatacaatttaaaaattaaaaactgaattttgtatctattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgtca

SEQ ID NO: 7570 - DNA, 434 bp, Homo sapiens
aaaatattcaaaaataagtcatcttgaaatgtagttcagaaggaactgggagaacatgttcatcatagaaccaacaattttaaaacataaactacctgagaagtcatgtaggtccaaccatattatttctcaggtgagaaaacaggctaataacttccatgattaaacacattactagtgggagaactccagagttcttttctgactcccattggtgctcctcctacaaggcaaggaatctttatattaggtttattctagcatgaccccttttaaggtttaaactggtgataaatatattatttgctcatgtcattcttcagtgctttgaagattttatagagaagaactcaggctcttttactgcattgagtcttaaaaggggggttgaattccgaagggatcaaataaatccaacgtagtagttgcatcag

SEQ ID NO: 7571 - DNA, 439 bp, Homo sapiens
attgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaat

SEQ ID NO: 7572 - DNA, 434 bp, Homo sapiens
gccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatct

SEQ ID NO: 7573 - DNA, 322 bp, Homo sapiens
aagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttcttttt

SEQ ID NO: 7574 - DNA, 461 bp, Homo sapiens
caacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacagca

SEQ ID NO: 7575 - DNA, 101 bp, Homo sapiens
gttttaagttattagtttttaaaatcagtactttttaatggaaacaacttgaccaaaaatttgtcacagaattttgagacccattaaaaaagttaattgag

SEQ ID NO: 7576 - DNA, 388 bp, Homo sapiens
gtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgtt

SEQ ID NO: 7577 - DNA, 388 bp, Homo sapiens
tgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaccctatggagctttaatttattaatgcaaacagtacctaacaaacccacaggtcctaaactaccaaacctgcattaaaaatt

SEQ ID NO: 7578 - DNA, 345 bp, Homo sapiens
  misc_feature 137, 262: n = A,T,C or G
gtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgnggcaaaaccaagatgaagagacgagctgtggggatctggcactgtggttcctgcatgaagacagtggctggcggtgcctggacgtacaataccacttccgctgtcacggtaaagtccgccatcanaagactgaaggagttgaaagaccagtagacgctcctctactctttgagacatcactggcctataataaatgggttaatttatg

SEQ ID NO: 7579 - DNA, 437 bp, Homo sapiens
  misc_feature 43: n = A,T,C or G
ggaagatttatagggtagaggcgacaaacctaccgagcctggngatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagt

SEQ ID NO: 7580 - DNA, 423 bp, Homo sapiens
ataaataaggattctgtttttgttgagtactccatccttagcacctaaaacaatgttaaaacaactagatgatactaaaagcatattttttgaatgcatgaatgatcataatgaagaaaagcttactattttatccccttgcaactaaggaataaggaaggggaaaaaaagtccattttcaccttttgacctcttcttgcccttcaccaaaaactgagttccctggtgttttttctctcatatgctgatgtggtgcaaatagcctaggcttgagggtgagggtgaaggtcgagttcctatgattgtatgctccattgcagctcttgacagtctattagaaatccataaccatagatacttctgcttctagggctttctttgtgagcctaagatttaactaccaacacctatgttgtcatgtgg

SEQ ID NO: 7581 - DNA, 207 bp, Homo sapiens
agagactgaagattcgaggctcccctggccaggggcagcccttcaggagctccttagtaaaggacttatcaaactggtttcaaagcacagagctcaagtaatttacaccagaaataccaaggggtggagatgctccagctgctggtgaagatgcatgaatagggtccaaccagctgtacatttggaaaaataaaactttattaaatc

SEQ ID NO: 7582 - DNA, 437 bp, Homo sapiens
  misc_feature 367, 373, 375, 400: n = A,T,C or G
gtgtattaaaaagggatcacaccaaaaaatgaattgcaaaattcatgacctcatgtgaaagatagtgactgtggtagatagaataatggcccctaaagatgaccacatcctagtccttggaacctgtgaatctgctactttacttggtaaaaggggctctacagatatgattaagttaaggattttgagatgggaaggtcatcctggattatctgagtgggtgcagtgtaatcacaagggtcctttaaagatggaggcagactgtcagaggaattggcacaaaagcagaggtcacacacacacacggggggatagagagagagagagagagagaggaagatgttacactgctggctttaaagatggnggaagngnctattaagtcaagcaaggcatgcancctcaaaagctccaaaaaacaaggaaatgaccttcag

SEQ ID NO: 7583 - DNA, 439 bp, Homo sapiens
gtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcatagggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaagggggaatgtgttcaaaaacaagcggattctcatggaacacatccacaagctgaaggca

SEQ ID NO: 7584 - DNA, 204 bp, Homo sapiens
gcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacagg

SEQ ID NO: 7585 - DNA, 125 bp, Homo sapiens
ggcacctgtagtcccagctactcgcgaggctgaggcaggagaatggcgtgaacctgggaggcggagcttgcagtgagcagagattgcgccactgcactccagcctgggtgacagagcgagactcc

SEQ ID NO: 7586 - DNA, 279 bp, Homo sapiens
gtgaaactacatgggcctgtagttttcactgtgggaaggatttcataaattcagtttatttaatagatatagggctacttagatttccagtttcttcttgtgtcagttttggtaagtagtatttttaaagaaatttgttcattgtaatttttccattgattagcataaagttattcaaagtatattatcacaaatgaaaaaggggttaccgcagattatgtagacattaagtaataatatactttgaataactttatgctaatcattgtattttttccc

SEQ ID NO: 7587 - DNA, 395 bp, Homo sapiens
  misc_feature 54, 349: n = A,T,C or G
ggcgagggctgacattgaaggtgaccctggaagttggggccctgctggacatgngtcaggctgtggcgtccagctgtgtgagatggaaaaccattctgttgtcatgactccaacgtgtctttacttctcttataggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaaganggtgttgaagagatgtgcgcaggagtacctgtccccggggtgaaga

SEQ ID NO: 7588 - DNA, 417 bp, Homo sapiens
  misc_feature 84, 214, 320: n = A,T,C or G
gttggggggacccttttctttctagttgtctttaaggaaaattaattttacttttttttttgttctggccgaaatttttatganatatctctcacttgtcttccactttgaaccggttaaagctcatagctgtcagctctgaatgaggaggggagaagcccctgggtctttctttgaaaggaatccgctgcttgagggctgcctccctcatggngtgcgtgtcgtttctcttcctgacgcatcttgtgatatcagaggtaactatgcaaagcatccaggcggttctgaatgtgaagcactacacccagcagagtcccggngccctctgtccccactgccggcccatgttctctctccggaggtcaccaaggaatgcacaggtttcgactaccagaaaggggagtcccttgggttctt

SEQ ID NO: 7589 - DNA, 209 bp, Homo sapiens
agcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttag

SEQ ID NO: 7590 - DNA, 363 bp, Homo sapiens
gcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatccctgttgatttgtttgtgccttttattaactgccattttctaaaatttttttcaataaaaggaaggaagatgtg

SEQ ID NO: 7591 - DNA, 458 bp, Homo sapiens
gggaagcgtctccgttgggtccggccgctctgcgggactctgaggaaaagctcgcaccaggcaagaataccctccaataccctcgggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacacc

SEQ ID NO: 7592 - DNA, 437 bp, Homo sapiens
  misc_feature 401, 415: n = A,T,C or G
ggagcgtggccctccaggaagaggtcccaacggtttgcctggagctataggtctcccaggtgacccaggccctgccagctatggcagaaatggccgagacggtgagcgaggccccccaggggtggcaggaattcctggagtgcctggacccccgggacctcctgggcttcccggtttctgtgagccagcctcctgcaccatgcaggctggtcagcgagcatttaacaaagggcctgacccttgaaaggcttactgctgcatggctgtctgcatgaaccacgcctggtgaaggagcctgggtgagaaacaccatccaaagctggggcaaagatgattaccttcagcatgattacaatgtattaccttcagtatgattacagaagtcctacttgacaatcacntatagaagaacggngctattcagtaagttctctttc

SEQ ID NO: 7593 - DNA, 461 bp, Homo sapiens
ctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagt

SEQ ID NO: 7594 - DNA, 343 bp, Homo sapiens
gtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaattta

SEQ ID NO: 7595 - DNA, 439 bp, Homo sapiens
cttatttaatgggcttttgattctaatgataattgtacctttatctttcaaaagctgatatttcctacctaagcatctcccgagaaaaatatctcattaaaaagcccataaataataggggagaagaaagccttaggtatcaattccaaaacagtgattgaaatttcccaaaataattatggcttctgtcatctccagagataatctggcttggtttaccccataatctaatttcagaaaagaaagctttattttaacactcatctgaatcaacattaaagccttttctctcaaagcgtttattgagaaactcaaatgaatatactttttgaattactgtcatcaaaagtgtacggcttcctgtgctgcttgtgtcaaatggaacctgccctctaaagcactttctttcctttacttgcatggtttcatgtaagctgtg

SEQ ID NO: 7596 - DNA, 439 bp, Homo sapiens
tggagcttcggcctatgcctctgcccgccttacagagcctggatccatcaaggggccttgagcatcaggcccagacagagcctggcaggcatcctggcgggaaggaccaggtcccctctgggtggacatgcacccatccccagtccaggaaaccatctcccccaggaccttctgtctgggactcaggagtcctaaggaaaaggaattctaaaacatgggggaaggggaggtagagcactgatgggtgaaaaagtgaggccaacacacagggcaagtggtgtcgatggagtcgaagcgctgaaggaatagggcggctttccttccagcgagcatcattcggctgttaccaaaacaaacatcttaatctgcacctttctccactggccatcttgtccttgggtcagtgggacatgggcacctcgggaggcccgggccctgc

SEQ ID NO: 7597 - DNA, 439 bp, Homo sapiens
gtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcac

SEQ ID NO: 7598 - DNA, 437 bp, Homo sapiens
  misc_feature 382, 401, 418, 423: n = A,T,C or G
cagcattgatacattattattaacgcaagtccttagtttacattagggtttactctttgtattctacagttttatggtttttcccaaatacatgtcaagtatctactgttaaagtatcatacagaatggttttactggcctaacatcctttgtgctccacctattcatccttcctccccccacttccccaaccccaggtaaccactgatctttttaatcgtttttttactctgcgtttttcacttaacattatatcacaaaaatttcccagggcatattaagtagtctccaaaaaccatagttttgaaattacggtttttggagaatacttgggatgctgaggcgggaagattgcatgagtccaagagttcaaggttattgngaggtattgattgctccantgtactccagcctgggnggcangagcaagacccctg

SEQ ID NO: 7599 - DNA, 206 bp, Homo sapiens
catgaacaaccatgcctggtcttttttattttttattttgagacggagtcttgctctgtcttccaggctggagtgtgtgatcttggctcactgtgacctccgcctgccagcttcaagaaattctcctgcctcagcctcccgagtagctgggattacaggcacctgttaccatacccggctaatttttgtatttttaatagagacag

SEQ ID NO: 7600 - DNA, 341 bp, Homo sapiens
gacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccac

SEQ ID NO: 7601 - DNA, 364 bp, Homo sapiens
cggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaaggggccaggggtggggctggggctggaga

SEQ ID NO: 7602 - DNA, 222 bp, Homo sapiens
ccaaggtggcttctccttggctgagagatggaaggcgtggtgggatttgctcctgggttccctaggccctagtgagggcagaagagaaaccatcctctcccttcttacaccgtgaggccaagatcccctcagaaggcaggagtgctgccctctcccatggtgcccgtgcctctgtgctgtgtatgtgaaccacccatgtgagggaataaacctggcactagg

SEQ ID NO: 7603 - DNA, 111 bp, Homo sapiens
cttcaccttgccagcaatttttgtatattgtggcctggtcatatacaaaacttgcttgatactaatattgaaggatcttacagagtttcataatgttaaaataaaacaagt

SEQ ID NO: 7604 - DNA, 437 bp, Homo sapiens
ccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccac

SEQ ID NO: 7605 - DNA, 439 bp, Homo sapiens
caggatcttcctggcaggaatatgataggccacctgcttcttttaggggaaaacattctgttttgagggtaagagaagatttgagtgaggtttgctttggtcatggcttctgaagcttgataattgcagaagttccatctgtaagatgctcgattaaaattctagatgaattgagtaatctccacaaggccaagagaatctaatgttcttgaatttgttccatattcacgatagatctagtaaccatgtgtagtaatcagacaaattctccaaaacatacagccagctggattcctgaactttaacaaagtttttatgctgactgcttctgcaacctcactaactagccagcctagataggaaactcccttcttaattcattcataaagtacctttcgatatatagacccaatctctaataaaccttttggagatcaat

SEQ ID NO: 7606 - DNA, 319 bp, Homo sapiens
gtcatgtggccatcttgagtctactctgtcgctcttgtgccctagcaccccgagaactgtcagtttgagccagatggaagctgagctgaacacattacgatggatgatggaaacataagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggtccgtgataattaaataaaatgcttaattcatgtggcta

SEQ ID NO: 7607 - DNA, 149 bp, Homo sapiens
  misc_feature 39: n = A,T,C or G
ctctaatggatatgtttatataattccaaaccctcaggngtgtgaatgcatttaaaaacattaatgggaaaataatggctgataatatttaattgatcatgcaattccttcaattatgatggaaagacttgaactttctgaaataaaac

SEQ ID NO: 7608 - DNA, 342 bp, Homo sapiens
  misc_feature 245, 265, 303: n = A,T,C or G
catcttcccattgccagtgcctacgaagggcttgacccattcattgttagacgctcagtaagtgtgtattgaggcagccctctgtgccactccagggctctttccactaaatcatgagtatgttggtttaccagatggaatgagtagcctcttctttggatacataaacacccgatggatattgtgggtcactgtggagggagaatgaacgtatgggatccctgacctgtggttactggaaaacngttgacatttagagagaggntgaattcttgggcttcccgtagcccccatcctgagtgngccaacaggggactagaagcatctctagtctgcaaagcg

SEQ ID NO: 7609 - DNA, 439 bp, Homo sapiens
  misc_feature 400, 438: n = A,T,C or G
ctcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgancacaatgcataatgtctttaaaaagcatgttgtgatgna

SEQ ID NO: 7610 - DNA, 439 bp, Homo sapiens
cggcgccgcatgcaggaggcccgggaaagcctcccgcaggacctagtgagcccctctggaaccctggtctcctagctcacagcagccctggcccacagtgcaagaggacaagatgggggatatctgaggccagtgctctcctgcctcttcgtctttctgattagagaccacgttggtctgctgagaaccagaaaagctgggaaattcccggctggcccctctgcctagccttctgcagggtcttctccctaccctgtggaaataaagccagagaccctgtggccccccctttatatttgcagccactgtcaatgggcatcacagcaaggcaggctttttgatctgaagcctggtttggggtgaccccataagtgagtctggccttgactcacttttctggcttgtctcacagtagcaggggatctgctgttctccaccc

SEQ ID NO: 7611 - DNA, 274 bp, Homo sapiens
aagtactgtgctcaaattttacatttttttcctttgcaaattctgtaatttcactcaacgattaagtctaccaaagaacacactgcatgtaaaagatgtattacaatctcaaagccagtaaaagaaatcttgcttcactgttcacctgctacaagtaagagtttggtgctggtagaaacatttgactctgatgtctattttattctacataagagccatatgtaatgtactgtaacaaaggagcttcttgtccccttggtcttttaattaaaag

SEQ ID NO: 7612 - DNA, 416 bp, Homo sapiens
gttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatgggtatctatgtctctgaaaaaggaactgttcagcaggctgatgaataagatc

SEQ ID NO: 7613 - DNA, 399 bp, Homo sapiens
gccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggtaggtcgggcgggggaacaatggcccggcggtggccggctttgtgcggcagcgtccgctcactcctcccctgctcgctgcaggcccgggaccgtggcgcttcgagagattcgtcgttatcagaagtcgaccgagctgctcatccggaagctgcccttccagaggttggtgagggaga

SEQ ID NO: 7614 - DNA, 436 bp, Homo sapiens
gtccagcccaccgcctgccgacttgtgtcatgccctacgttggtataatcacatcaagtcttacgaaaaggaaaaggccagcctgccaggagtgaagaaagctttgggcaaatatggtcctgcccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtggggatacgggaattaag

SEQ ID NO: 7615 - DNA, 185 bp, Homo sapiens
ggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatag

SEQ ID NO: 7616 - DNA, 334 bp, Homo sapiens
ctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgctt

SEQ ID NO: 7617 - DNA, 396 bp, Homo sapiens
  misc_feature 198, 379, 386: n = A,T,C or G
tctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgactcaagaaaggtggtgaagcaggcgtcggagggccccctcaagggcatcctgggncctacactggagcaccaggtggtctcctctgacttcaacagcgacacccactcctccaccttcgacgctggggctggcattgccctcaacgaccactttgtcaagctcatttcctggtatgacaacgaatttggctacagcaacagggtggtggacctcatggcccacatgggcctccaangaataanacccctggac

SEQ ID NO: 7618 - DNA, 377 bp, Homo sapiens
aaactgcagagaaaactgaaagttatgttccagataactttccgttgtttaccaaattttcttagatttggtcatcatcaggaagcatttgtaaaaataaaaatctccacaaattactggcccatctcggacttgctgaatcaatttgataggattaatctccagtgaagctgtgtttacagggcattccaagtgattcttatcaggaaatgtgaaaaacactcctgtacataatcggttaatttaaaattttacttaataagtgaacaagtaatgaagatttcacctgtttacttagggtatctacccagacccatcgattctgagttcgggagatgattttgaaattactgttttccaaataaaggtgctccctt

SEQ ID NO: 7619 - DNA, 439 bp, Homo sapiens
  misc_feature 413, 438: n = A,T,C or G
cttagatggacctgtgctgcctctttcctcttgtgccactctcccaatcactcaaccctgctccaactgtactggctgctattcttcttgaacaaaccttcctgcatgaccttgggtaagtgacttaccctgagtctcctcatccatagaagagtgaacaatggtactttagaatcgtaaagcacttatatacagagctccctataggaagtgaacagattggatagtaagggttacttgcatttgctgaaggagtgaagagtgaggatactgcctgcattttccataattttttcattatacttaagccatgtacaaatagtgcacagatgttgtcagtcaattgtttggctgtgcacttgttacaaagttcagacttcacagctgaaagtgagtcagttctttatctgggnatggttatcttggaacaagggtcana

SEQ ID NO: 7620 - DNA, 351 bp, Homo sapiens
gcccccgggagctacggacgtggcacgcactgccactataaggctcccaccgtggtcttgcacatgactaagacggacccctctttggagaaccccacacacctctagccacacaggcctggcgcggggtggctgctgccccctccttgccctccacgccctgccccctgcatcccctagagacagctgactagcagctgcccagctgtcaaggtcaggcaagtgagcaccggggactgagggatcagggcgggaccccgtgaggctcattaaggggagatgggggtctcccctaatgcgggggctggaccaggctgagtccccacagggtcctagtggaggatgtggagg

SEQ ID NO: 7621 - DNA, 257 bp, Homo sapiens
gggcagaggaggcagcagaaaaccaaacatttcactgagaaagccccctccctgctctaagaaggggctccgtgaagttcttcccagagccgcgctgcctgcagtgcgctctgaccttctcttcatgtgtgtaaatctgtaatataccattctctgtggcctgtttttcctggaagaagaaaaaaaaaggtttggcaggccatctttttttgtacttaaaagtagccttaagaacaataataaagtgctcttaaacc

SEQ ID NO: 7622 - DNA, 350 bp, Homo sapiens
  misc_feature 199: n = A,T,C or G
atgaagtcagagaggtggggtgagggtgagcttactcagggcccccagaggaagccctcagcctctgccctccccccacacagggcgggagcccaggcctgttcctggcagctgtggctgcagctgtgctcctgctccctcctggaatgtgcgacaagcccaaatgttccggggaggcggccggggcaggggggcttanaagtgctaatatggttctgtgttttgcctgaaacgataccaggttcccctgaatagcaactttacaaggtccatgtgggagggaccaacccagatgccctgctgagtgtccctgaaaccatggcagctccatctgtcaagatggcagggcc

SEQ ID NO: 7623 - DNA, 392 bp, Homo sapiens
accgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctgggggtggatgatgtgaccttccttgggggactgcggaagggacgagggttccctggagtcttacggtccaacatcaggaccaagtcccatggacatgctgacagggtccccagggagaccgtgtcaagtagggatgtgtgcctggctgtgtacgtgggtgtgcagtgcacgtgagagcacgtggcggcttctg

SEQ ID NO: 7624 - DNA, 330 bp, Homo sapiens
gtgaaatcacttcatatatcatgtgctgtaaaataagaactagctgaagagacaaccaaagaagcattaaggcaggttgatgctgatgggaccataaaatatttttacactcaacctgagcggttattcttgacactcttaacagaattttttcaattgttttccagaactttagtatatgcaaatgtactgaaagggtagttcaagtctaaaatgccataacccctttattatttgttattttttatttgcattgctttgccataagtcttcccttgcttgtatcttccaaagctattttgaaataaacatgaaaatttacagtttgcc

SEQ ID NO: 7625 - DNA, 212 bp, Homo sapiens
aatctgtacatgtctcccatcagaaagattcattggcatgccacaggggattctcctccttcatcctgtaaaggtcaacaataaaaaccaaattatggggctgcttttgtcacactagcatagaagaatgtgttgaaatttaactttgtaagcttgtatgtggttgttgatcttttttttccttacagacacccataataaaatatcatatt

SEQ ID NO: 7626 - DNA, 245 bp, Homo sapiens
ctttgggaggccgaggcaggctgatcacgaggtctggagatcgggaccatcctggctaacacagtgaaatcacgtctctactaaaaatacagaaaattagccgggcatagtggcgggtgcctgtagtcccagctactcgggaggctgaggcaggagaacggcatgaacccgggaggcggagcttgcagtgaaccgagatggcgccattgcactccagcctgggcaacacagcgagactctgtctc

SEQ ID NO: 7627 - DNA, 309 bp, Homo sapiens
  misc_feature 38: n = A,T,C or G
ccaaaacctagaagatgcttgtgatgacatcatgcttngcagatgatgattgcttaatgataccttatcaaattggtgatgtcttcattagccattctcaagaagaaacgcaagaaatgttagaagaagcaaagaaaaatttgcaagaagaaattgacgccttagaatccagagtggaatcaattcagcgagtgttagcagatttgaaagttcagttgtatgcaaaattcgggagcaacataaaccttgaagctgatgaaagttaaacattttataatactttttttatttgtttaataaacttgaata

SEQ ID NO: 7628 - DNA, 439 bp, Homo sapiens
ggcccaaagggatctgcaggtaatcctggggaacctggcttgagagggcctgagggaagtcgggggcttcctggagtggaaggaccaagaggaccacctggaccccggggtgtgcaggaattcctggagtgcctggacccccgggacctcctgggcttcccggtttctgtgagccagcctcctgcaccatgcaggctggtcagcgagcatttaacaaagggcctgacccttgaaaggcttactgctgcatggctgtctgcatgaaccacgcctggtgaaggagcctgggtgagaaacaccatccaaagctggggcaaagatgattaccttcagcatgattacaatgtattaccttcagtatggattacagaagtcctacttgacaatcacatatagaagaacggtgctattcagtaagttctctttcctttccctttgg

SEQ ID NO: 7629 - DNA, 438 bp, Homo sapiens
  misc_feature 426, 432: n = A,T,C or G
ccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtanaaaggnggagat

SEQ ID NO: 7630 - DNA, 355 bp, Homo sapiens
gcaagattactgatttcatcaagttcgacactggtaacctggtgtatggtgactggaggtgctaacctaggaagaattggtgtgatcaccaacagagagaggcaccctggatcttttgacgtggttcacgtgaaagatgccaatggcaacagctttgccactcgactttccaacatttttgttattggcaagggcaacaaaccatggatttctcttccccgaggaaagggtatccgcctcaccattgctgaagagagagacaaaagactggcggccaaacagagcagtgggtgaaatgggtccctgggtgacatgtcagatctttgtacgtaattaaaaatattgtggcaggatt

SEQ ID NO: 7631 - DNA, 112 bp, Homo sapiens
aaaataattttcgctgataatttgatgattaattctagaagatccaatcgtttcaggaattggagaatggttagaaatggggtcatttgggggatgtagaaagatataaaat

SEQ ID NO: 7632 - DNA, 164 bp, Homo sapiens
caggcactgagcaaatgtctgttaattgaatccatgatttaaatgaaatctggagttggctggattcagggactcatgcctgtaatcccaacactttggaaggttgaggtgggggaattgcttgaagtcagaagtctgagagcagcctgggcaacataatgaga

SEQ ID NO: 7633 - DNA, 228 bp, Homo sapiens
cctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttggaccaaatggaaataaagctttttgatgc

SEQ ID NO: 7634 - DNA, 428 bp, Homo sapiens
caagcacctatatagtatcacggggacagttgaggcaactcgtagatggagatttgggaaaagacgatgtggcctcctacctttccagtttctgttggcagcccttcacgtagcctcctgcctcgcctctacacctactaccctgtcggcccttttgccatgctgtcctcgtataactcggattctctcctcaggtgtaggtgcagggagtcagggaacccttagactcccctgtgtgcaagagcccaggtgttggtgtgtccctttaatgctactgtgctctctggtgtttctgattttcctgcctttattctgtcttctcttgtcctatctcattccagcccacatcttctcctttcctgattacttttgttgtcctgcctcttcaggtaatggtcacagatttggctgtaggcacgttaccagcc

SEQ ID NO: 7635 - DNA, 436 bp, Homo sapiens
gacagagtctcacttaggctgaagggcagtgatgaggtttcactatgttgcccaggctggttattttgttcattagttgatgcagtttcttcctagcctcgatggtctttacaatttggcatgttttgcagtggctggtaccagttgttcctttccatgtttagtgcttctttcaggagctcttttggggcaggcctggtggtgacaaaatctctcagcatttgcttgtctgtaaaggattttctttcttcttcacttatgaaattctgggttgcaaattcttttaagaatgttgaatattggcccccactctcttctggcttgtagagtttctgccaagagatcagctgttagtctgataggcttccctttgtgggtaacccaacctttctctctggctgcccttaacatgttttccttcattgttgatgtgtct

SEQ ID NO: 7636 - DNA, 435 bp, Homo sapiens
gtaaatacagtttaaagagagaataattacttcagagctacccttttaagagaaaaccatcagaaattgataatgtttatataaagtttataaagccattgtgttttgttatataacaaatcagagatgttattttagaatcgattcccatctaaagaactcaattttgagtctgacatttccaggaccagatattgtcttactcacatttcctttgctttgaaatagggctttccttccaaatggctatttttaggctagggatgttaacatcagggatttgtgtgtggaataactggaatgtcatttttgcttttaagccatttctgatgatatagccaaagcaggttgtctgactatgtaggatttttacatcttgaaactaaatcagaaatccagacatgaaaataacctttctagaatgcctaggagcag

SEQ ID NO: 7637 - DNA, 439 bp, Homo sapiens
  misc_feature 316, 336, 426: n = A,T,C or G
ggtgcccccactgcaggtgtaccagctactcacgttgaccatgggaggagccctttataataaaagaatctcagaatcctggaaagctggggatccacaggcagatgcagtagtcagtgatgccgtgcgcaagtgataatttttgtcatggggctttttctagacacttctagtgaaacaaatgtgggtttaggtaagaaataacttttaattctagaccttgaagtcagcttgtcattaaaagaggtcatttaaaaaaaaaaagtctaggtactggacttgtaagtaaaaataaaaagattaaatacctaaaaanggggttgtatataggcttanaaggagtcagtcaaaaattcaggggctgctgggcgtggtggctcatacctgtaattccagcactttggggaggccgaggtcaggagttanagaccattctgac

SEQ ID NO: 7638 - DNA, 407 bp, Homo sapiens
cgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaatt

SEQ ID NO: 7639 - DNA, 239 bp, Homo sapiens
cagcctctcaagtagctgggactacaggtgcaccaccacacctggctaatttttgtattttttgtaaagaggggggtctcactgtgttgcccaggctggtctcgaactcctgggctcaagcggtccacctgcctccgcctcccaaagtgctgggattgcaggcatgagccactgcacccagccctgtattcttattcttcagatatttatttttcttttcactgttttaaaataaaacc

SEQ ID NO: 7640 - DNA, 430 bp, Homo sapiens
  misc_feature 430: n = A,T,C or G
cagcagctgaaggtctcagagaccagtaatcagaaggcatccgactgcattaagtgtgcagcgctgaaaagacatttacaactaggccagggattagccactggtgggagggtggacaggcaatggttcagtggcctggctgttggcaggaactccaagtgcccaggcctcttgggcagcttagggccctgcctctgtttcatgatgcatgggtcatttgtcttgggtgtcctatcccatatggagaagaaaggggctctaagttctggctcttctttctttggggttctctgtacctgaggaaaccaggccctgggtgactttgcagatctgctcaccctcggtgagcaacagtgtcagccatgcaagcaggacagaatggtgactgggtgccctttggtgaacctgtgtattttccctaaggagggan

SEQ ID NO: 7641 - DNA, 438 bp, Homo sapiens
gtttactggaattgctctggcgatcgaggggtcctagtacaccgcaatcatgtctattatgtcctataacggaggggccgtcatggccatgaaggggaagaactgtgtggccatcgctgcagacaggcgcttcgggatccaggcccagatggtgaccacggacttccagaagatctttcccatgggtgaccggctgtacatcggtctggccgggctcgccactgacgtccagacagttgcccagcgcctcaagttccggctgaacctgtatgagtttgaaggaaggtcggcagatcaaaccttataccctcatgagcatggtggccaacctcttgtatgagaaacggtttggcccttactacactgagccagtcattgccgggttggacccgaagacctttaagcccttcatttgctctctagacctcatcggctgcc

SEQ ID NO: 7642 - DNA, 436 bp, Homo sapiens
tcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattag

SEQ ID NO: 7643 - DNA, 118 bp, Homo sapiens
gaagaaggtgaagaagcggatgagggttatcagctctttgaagaagtcaaaagctgcagtaaacttttccaacgttggctgcagtaactattttcaataaaagctgtctggatgtctc

SEQ ID NO: 7644 - DNA, 444 bp, Homo sapiens
  misc_feature 378: n = A,T,C or G
gccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttganagcttctcagactatccacctttgggtcgctttgctgttcgtgatatgagacagacagttgcggtg

SEQ ID NO: 7645 - DNA, 417 bp, Homo sapiens
ctttcactctaagactggcaaaaggacagcagtcttctatgtttagtcaatattcatttcagtagaagataatcttatctaatttttgagaccagaataagccttttaaggtaaacctcaaaattatcattttatggtaatactgaccattttagtcccctaggtttgacatgggagatagtgactacactggtgtctgacttttttcctagagatttctccctgaaaaatacaagggctgttggtgagagcagacttgaggtgatgatagttggcctctggtctacaaagatttcataactccttggaaagcttcttataatcattcttaacttcttggtagctagaaatttagagtagttgaaatctttaggaatgaacttctgagggccaaaaaatgtgactgacgggaacaat

SEQ ID NO: 7646 - DNA, 439 bp, Homo sapiens
gcaagacccaccgaggcctgcgcaaggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcatt

SEQ ID NO: 7647 - DNA, 437 bp, Homo sapiens
atcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaaagattgaggactactttccagaatttgctcgctacactactcctgaggatgctactcccgagcccggag

SEQ ID NO: 7648 - DNA, 316 bp, Homo sapiens
  misc_feature 241, 248: n = A,T,C or G
aagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaacccccacaaaagccaaaaaatgggagacaatttcacatggactttggaaaatattttttncctttgnattcatctctcaaacttagtttttatctttgaccaaccgaacatgaccaaaaaccaaaagtgcattca

SEQ ID NO: 7649 - DNA, 500 bp, Homo sapiens
caaagctggagctcgcgcgcctgcaggtcgacactagtggatccaaagaattcgccacgaggatactataagcattattttaaatgacgctgatcttaagtctgaaataaatggaaagcagaaaaggtgagccagttgatttgaatgcattggatattagtgttagaaacaatgtatagtttagattgaaactgaactgacttatttagcacttaaacaaaaatttgacaatgtttttagttttttttaagacagcttagtgtggtgatacttagaattctatggtttgatgtttcttttagaaatgagaagtatagttttattttttaatataaaaaatggttttaatactaaaactagtaatttgatactagttgtttataaacattgtaaaatatatcttttaaacaaattatcttggtagttaattcataagggtgggtttgggtaggaatagcagagtactttcagagggaaaggggagtcattcagaagtgata

SEQ ID NO: 7650 - DNA, 439 bp, Homo sapiens
gtttggactccagtactcaagacaggctcatagcgctgaaagcagtaacaaattttggcgttccagttgaagtttttgactctgaagaagctgaaatattccagaagaaacttgatgagaccaccagattgctcagggaactccaggaagcccagaatgaacgtttgagcaccagaccccctccgaacatgatctgtctcttgggtccctcatacagagaaatgcatcttgctgaacaagtgaccaataatcttaaagaacttgcacagcaagtaactccaggtgatatcgtaagcacgtatggagttcgaaaagcaaatggggatttccattccttcccccgtcatggaaaacaactttgtggatttgacagaagacactgaagaacctaaaaagacggatgttgctgagtgtggaccctggggggaagttgaggctg

SEQ ID NO: 7651 - DNA, 439 bp, Homo sapiens
gaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccgg

SEQ ID NO: 7652 - DNA, 439 bp, Homo sapiens
ccgagcaggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctcc

SEQ ID NO: 7653 - DNA, 439 bp, Homo sapiens
caattctgaaaatagcaaacttaataaacagccactttaaacttgttctggcaaaccagaccctgctgtagatatagtctaaggtagttaaccatataagccttttcaactcttaatgccctccacatgaatcagcagttaagaaggttctagaacccatgaaagcttttgtatgtattactaggttttgtttttcttatgtttgctgattttacagttctgactaaagctgacctaaatggatcagtttatgtgtaatattctagtgctttaatgactctttttttctttggagggagggtaacattatttggacagatgcagaaggaactgttagtgagtcaagacaaacacatctgaaataaaggaactgtgtattaacatgttaacaattcataactgcactttttatgacattttgaaaatctatttataggta

SEQ ID NO: 7654 - DNA, 437 bp, Homo sapiens
ggagtggcaacatggcgtcttcgggagctggtgaccctctggattctaagcgtggagaggccccgttcgctcagcgtatcgacccgactcgggagaagctgacacccgagcaactgcattccatgcggcaggcggagcttgcccagtggcagaaggtcctaccacggcggcgaacccggaacatcgtgaccggcctaggcatcggggccctggtgttggctatttatggttacaccttctactcgatttcccaggagcgtttcctagatgagctagaagacgaggccaaagctgcccgagcccgagctctggcaagggcgtcagggtcctaatctggatggggtattgatcatgtccaacctgctggagccccttcacatggtggatgatgccccatgaccctgtagaaattgaatcctgctcacaacattgttggc

SEQ ID NO: 7655 - DNA, 259 bp, Homo sapiens
gtagcactgtttttgtatcatttttaatgatactcttttcttctcttcttagagtcgtttttcccttggatattgtgattttgatttaagaccatgtcatgaaacaacagtagacatttttcataagaagcatacaaaaaatatatgatgggtggtagcctaatttgtattatgtctactttaagtgaatattggattttttttaaaagatcacttttataatgtatgaatttaacaataaacttttatatttctacta

SEQ ID NO: 7656 - DNA, 434 bp, Homo sapiens
  misc_feature 383: n = A,T,C or G
ctcaaggaaacctttccaacacagatgtccaagctgccaagaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagngaggtaaaataaggcataaatgcaggtaattattcccagctgacctaaagt

SEQ ID NO: 7657 - DNA, 415 bp, Homo sapiens
gagagtttgggttctctccaattccacctttttaatactaaagcagtggttctcaaactttagctacagtagaatcacctggagagtgtgttaaagcatagattttaggctccatcatcagtatttggttctgtaggcctagagtggaccccaaatttgcatttctaacaaattccaatgacactgatgttgctatttcaggcactatgctaacctaacacatgagtctgatcattcaactcaaatatctttatggatcagtcaagagaagttaattcaaaaagccttggaaaataaaatcaataggcagtggtgagaattagataaatagaatgtgctggactaatttaaaggctttctgtctcacatcttttaagacagtgtaatgaggaaatgaaacatgtccaaattcagc

SEQ ID NO: 7658 - DNA, 439 bp, Homo sapiens
ggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagag

SEQ ID NO: 7659 - DNA, 439 bp, Homo sapiens
ctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatac

SEQ ID NO: 7660 - DNA, 436 bp, Homo sapiens
  misc_feature 165: n = A,T,C or G
tggtaccccagatagacatggaaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcanaagtatattgagcggcccctcctcatctttggcaccaagtttgacctcagacagtggttcctgctcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacacc

SEQ ID NO: 7661 - DNA, 437 bp, Homo sapiens
caattggttcctctgagccaaagctgatttaactcctgggccagtatctaaaaaataaagaaacccccaaaacctaaaattgactgagttctttttgaggatttataatctgagaaagttattcgagcataaacaggaaccaaaatcataatgaaattggagaaattgatcatgcagccctcttattttttactttcttttaggggacaatttttttggagggaagtcaccactgtatttagcagttgttgaaatcacacgaaggagtgaaggatatagctattcaaaacttttggaaaggccaggcacggaggctcacacctataatcccagcgttttgggaggctgagacgggcagatcacctgaggtgaggagttcaagaccagcctggccaacatggtgaaaccgtctctactaaaaatacaaaaattagttg

SEQ ID NO: 7662 - DNA, 456 bp, Homo sapiens
ctcacatggagtcagcgctcacctcattcacacaattatcatagagctccctggacactgaacctctaaagggaaaaggtctaccctggagccaggagcatcagggttggcttgggagcatgagaggtgagcccagggctaggcctgggccaggccccggcagcactgctacttgggaggagccacttcacctttgtattagttattaaaaaatataatttgggctgggcgcagtggctcacgcctgtaatcccagcactttgggagtccgaggcatgcggatcacttgaggtcaggagttcgagaccaccctggccaatatggtgaaaccccatctctactaaaaatacaacaaagttagccgggcgtggtggcaggcgtctgtaatcccagctgcttgggaggctgaggcaggagaatcacttgaaccctggaggtggcggttgcagtgagcac

SEQ ID NO: 7663 - DNA, 410 bp, Homo sapiens
gtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaagggggtaggaaggtgctgtgggctggtcccacacatccaggaaagaggccagtagagaattctgcccactttttataaaaacttacagcgatggccccaccaaggcctagacacggcactggcctcccaggagggcaggggcatttgggg

SEQ ID NO: 7664 - DNA, 439 bp, Homo sapiens
ggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccggg

SEQ ID NO: 7665 - DNA, 438 bp, Homo sapiens
tgcatgctcagccgtacacgcacgcgttccttgctactgccatctaaatatatgcaccgacactctatgccctgcaacgtggccggtgtgtttgtcctgatcctacataaaggtaggcaggtatgtgggagagtccaggcaggaacaaacagccacgcgcaatttaactgcagccaaactcaaagagaccttgagcctgccgaattgtttcactcagccaggtgccccccagaaaccggctattctgcaatcagttgtggaatcctgcaattattcataaaatgtgctgaaaatgtattttaggaaacgtaatcttgctatatatggcaaggtaaaggcgaacctgaaggatgaatgtgtttctgctttttaatgtcatacgtgtagccatctgaccactttttattgggtgacatatcatatgagcactttggtgta

SEQ ID NO: 7666 - DNA, 434 bp, Homo sapiens
gttatttcctgcatttcctcctttcgtctttacaaggtagccgtttggcgtcgtgagagattgggtctctccacattgccccggctgctctccaacccctgagttcaagtgattcacctcccttggcctcccaaagtactgggattacaggcgtgagccaccgtgcctggctgagaagatggatttaagacatattttggagcggaaagtgaccagaagaggtgtgcagtttccaggcctggcccatacagacctccaacaggtgctcccctgtgctgttactccttctgccaactggaagcagatggtgaccaggctctggagaaggcaaggcctgaagatgggagattcctaagtggaggagaactgtgccttactgacctaaatatccactcagtattgttatgtgagaataaataaacttgtgttgaccg

SEQ ID NO: 7667 - DNA, 320 bp, Homo sapiens
aataatcaacaccctcctagccttactactaataattattacattttgactaccacaactcaacggctacatagaaaaatccaccccttacgagtgcggcttcgaccctatatcccccgcccgcgtccctttctccataaaattcttcttagtagctattaccttcttattatttggatctagaaattgccctccttttacccctaccatgagccctacaaacaactaacctgccactaatagttatgtcatccctcttattaatcatcatcctagccctaagtctggcctatgagtgactacaaaaaggattagactga

SEQ ID NO: 7668 - DNA, 366 bp, Homo sapiens
cacatgtataacttaagtatcataaaaagaaagaaatgttttcattaataatatttctcaccttttctagatataaatttaattcacagttgggcagggcatggtgcctcacgcctgtaatcccagcactttgggaggccgagacgggcagatcacgaggtcaggagatcgagaccatcctggctaacacggtgaaaccccgtctctactaaaaatacaaaaattagccgggcatggtgcgcacgcctgtagtcccagctacacgggaggctgcggcaggagaatggcgtgaacccgggaggcggagcttgcagtgagtcgagatcgcgccactgcactccagcctgggcgacagagcgaaactcc

SEQ ID NO: 7669 - DNA, 439 bp, Homo sapiens
ccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatg

SEQ ID NO: 7670 - DNA, 435 bp, Homo sapiens
  misc_feature 366: n = A,T,C or G
atttatttgtttttttgagacagtcttgctcagtcaggcaggctagagtggcacaatctcagctcactgcaacctccgtctcccgggcttaagcagttctcctgccacagcctctggagtagctgggattgcaggcatgtgccaccatgcccagctaatttttgtacttttagtagagatggggattcactgtgttgaccaagctggtcttgaagtcctgacctcaggtaatgtgcccacctcggcctcctgaagtgctgggattgcaggcatgagccactgggcccagcctcttcatatatttttagtcatgaaaatattgtatacacacacataaatatatacatgtattaggcatgctggtanaagcacatcacataagactcataaagatctttttgttttttgccattttaaaaaaaatcttaccctagg

SEQ ID NO: 7671 - DNA, 305 bp, Homo sapiens
cttgcttcaagatagtaggaactgatcagcttataaagctgatgctgcccagttctgttctgagtccagtgtgcatagctctggctcccaccatgcccgttagcctgtgaaattgatttttttaaatggttgtacaggcatttggcctatagccaaagaaatgattgagcaagtgagtcctgtttctgtattgctctatgaataagtagttagaccattcaagactgctgtacatgagtcattcattcccagggacacttatagttcttttacatttggtgcattcagcatcctagaaggccttt

SEQ ID NO: 7672 - DNA, 455 bp, Homo sapiens
gtgatatgtttactacctacctataagagttttatggatttggagaagttttctctgcaatatgaatatatagtctcacaaatgaggataaagtttatagcaaattatcatggatttgattatgtcatggcacttgaaggaaagagagggtgggctgtgaaactcccttaaaaataacccatttttgaactcgacataaattttcagggtcctataattttcttatcaggagtgtctcacactgattgctaggtgtagaaaaatgtatgttgcctgaatctgaaggcatggattgtaggcctggttataccacagttacttgtgggactttaggaaacatgcttcatctggtcctgcttctgtttctgctatcttacaatgaagataattttccccctactttttaaacttatttgcagtgaagactagataaaaaaggatatgactaacacatt

SEQ ID NO: 7673 - DNA, 439 bp, Homo sapiens
aatgagccccttgcctttgcttcctgtggcacagagggatttcggaatgccaagaagggcacaggcatcgcagcacagacagcaggcatagccgcagcggcgagagctaaacaaaagggcgtgatccacatccgagtttgtggtgaaaggcctggggccaggacgcttgtctgccatgcacggactgatcatgggcggcctggaagtgatctcaatcacagacaacaccccaatcccacacaacggctgccgccccaggaaggctcggaagctgtgatggggaaggaggcctgcacttggacctgacctcaagcctcagctccagtgggaccttgtaaaatgctccctgtcagagctctccagaatatgcttgttggagatccttcaggcagtaaggggagagttttgcctcctttacacagtggcctttgcttgcacc

SEQ ID NO: 7674 - DNA, 415 bp, Homo sapiens
ggggagctgtgactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcatctgaggacttaaagaagcatggtgccactgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatg

SEQ ID NO: 7675 - DNA, 341 bp, Homo sapiens
  misc_feature 160: n = A,T,C or G
cttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcanaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaata

SEQ ID NO: 7676 - DNA, 439 bp, Homo sapiens
ctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggtttta

SEQ ID NO: 7677 - DNA, 344 bp, Homo sapiens
  misc_feature 54, 60, 63, 81, 124, 161, 176, 182, 225, 228, 234, 274, 283,302: n = A,T,C or G
tgaacatggttacacaggtgacatgtttatcaaatacattttgggtttttttcngataanaantgcatcaagacaacaggntataaaatgcagcattgatcattttccttataagcttttatcnttaccattgctacctacctccagctgctttccaatcngttggatttgggtancaaacnatattggattgaaacaggaaagcaaataataacagaagactgncantttaangttattttatggcctataaaatctttgcaaaagactctcnagaaccgcnttattcaataaaataatcnctagccatataactattgagcagttgaaatgtggctaatccc

SEQ ID NO: 7678 - DNA, 128 bp, Homo sapiens
gagaaactagtctcgagagtacttctagagcggccgcgggcccatcgattttccacccgggtggggtaccaggtaagtgtacccaattcgccctatagtgagtcgtattacaattcccctggccgtca

SEQ ID NO: 7679 - DNA, 380 bp, Homo sapiens
cccaagtggattctgagacaggcaccatctccttgttccccctctctcttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtccctgcttagaagccagtcaccagccctctgcctgcagccatgggaaaagggggtgtgcacgtgccttctgtgtgtgtggctgagtg

SEQ ID NO: 7680 - DNA, 422 bp, Homo sapiens
tgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggcgaaaggaccgttttgtattgcttcctgattaccagtctgattataccatgtgtgctaatatactttttttgttatagattgtcttaatggtaggtcaagtaataaaaagagatgaaataat

SEQ ID NO: 7681 - DNA, 191 bp, Homo sapiens
attaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcg

SEQ ID NO: 7682 - DNA, 319 bp, Homo sapiens
cagcaactctttatacgttaaaaactttgaaacctgtggccgggcatggtggctcgcgcctgtaatcccagcactttgggaggccaaggcaggtggatcacctgaggtcaggagctcaagaccagcctgaccaacatggtgaaaccccgtctctactaaaaatacaaaaattagctgggcatggtggcgcatgcctataatcccagctactcggaggctgaggcaggataatcgcttgaaaccgggagacagaggttgtggtgagccgagatcacgccattgcactccagccggggcaacaagagcaaaactccatctc

SEQ ID NO: 7683 - DNA, 272 bp, Homo sapiens
  misc_feature 39, 156, 209, 213, 226, 251: n = A,T,C or G
catgatttggctctctgtttgtctcttattggtgtatangaatgcttgtgattttttgcacattgattttgtatcctgagactttgctgaagttgcttatcagcttaaggagatttggggctgagatgatggggttttctaaatatacaatcatgncatctgcaaacagggacaatttgacttcctcttttcctaattaaatacccttnattnctttctcctgccngattgccctggccagaacatccaanactatgttgaataggagtggt

SEQ ID NO: 7684 - DNA, 439 bp, Homo sapiens
ccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcc

SEQ ID NO: 7685 - DNA, 461 bp, Homo sapiens
  misc_feature 17, 374, 387, 427: n = A,T,C or G
ggaaaacataaaatcgntaaatcaataatccattatagattcaatgagccttcaaggcaaagaatccccaaaggggcatctgtggagccctgcttagtttatttactccttggattcatgcttactgagtggcagctttattccaggcacagtcttaggtgctgaagatgaaggtgagaccagtcattgtctttgcagatttcacatgtaaatgggtacgaagacaattagctaattattgcaataagagccatggagggaattatcttgaggtgtgctgacagtgagaacttcagaagagccaactttggatactgaggtgttagagtcaggaagacatacaagaactgaggtcagaagggtgagaagggtcnaattggagagcanacacagcaggtagaggaaactatgagcactgaggcttganagtgacagccctgggcatgttccagggcccagta

SEQ ID NO: 7686 - DNA, 395 bp, Homo sapiens
ctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggtaaggttgggctggtgctcacagctgtaatcccagcactttgagattggctgggagttcaagaccagcctggccaacatgtcaaaactactaaaaataaagaaatcagccatga

SEQ ID NO: 7687 - DNA, 149 bp, Homo sapiens
  misc_feature 57, 76, 89, 114, 137: n = A,T,C or G
caaaacaacacgatttttcttatttttcaagaaatatctgttgttttgagtgaaatnattacacttggccaagtgntgtgggggtgganataccaggcgagtgctggagattgnaatcgacctaatttttgtctgcngcattaatcact

SEQ ID NO: 7688 - DNA, 187 bp, Homo sapiens
  misc_feature 2, 50, 52, 53, 167: n = A,T,C or G
gnacgaggagaggaacagaaaggataaggatgctaaattccgtctgattntnntacccagccggattcaccgtttggctcgatattataagaccaagcgagtcctccctcccaattggaaatatgaatcatctacagcctctgccctggtcgcataaatttgtctgngtactcaagcaataaaatga

SEQ ID NO: 7689 - DNA, 329 bp, Homo sapiens
  misc_feature 48, 169, 302: n = A,T,C or G
caggacgtgcacttcggggggtgcatgtagagtggtgagtggctctcnctgctgctgcggggagagcccgtcatggacctatggacaggagtaaaaacagcctcagcacctggggcagggcctcaagaccaccctctcctccctgtgtgtaggcaagcccagaggccanagctgggctgcccactcaagctctgagaccccagagttgtcctcaagtttatctccaaacagtatctgcggaaagatcactgaccagggtcaaactgagccagagcttccccgcagcccacaatctctctcantccaagggtagtaggatggcccccctg

SEQ ID NO: 7690 - DNA, 443 bp, Homo sapiens
ggtcagtagaggtaattttcagactgcttaattttaacatgaacagttttgtttttgttcttgtttttgtttttgtttgagacagagtctcattatgttggccaggctggtctcgaactcctgcgcttaagcgatcctcccgccttctcctcccaaattgctgggattacacgcgcgagccaccacacgtggccatgaacagtttttaaatctttataagttaaagcaaataggccaggtgggtggctcatgcctgtaaatcccagcactttgggaggtggaggtggggagatcgcttgagctcaggagtttgagcttagcctaagcaacatagccaaaccccgtctctacaaaaattaaccagggcatggtggtgcatacctgtggtcctagctaccggacaggctgagatgggaggattgcttgagcccaggaggtaaagg

SEQ ID NO: 7691 - DNA, 439 bp, Homo sapiens
agacgccctatggcgtccgcctcgacccaaccggcggccttgagcgctgagcaagcaaaggtggtcctcgcggaggtgatccaggcgttctccgccccggagaatgcagtgcgcatggacgaggctcgggataacgcctgcaacgacatgggtaagatgctgcaattcgtgctgcccgtggccacgcagatccagcaggaggttatcaaagcctatggcttcagctgcgacggggaaggtgtccttaagtttgctcgcttggtcaagtcctacgaagcccaggatcctgagatcgccagcctgtcaggcaagctgaaggcgctgtttctgccgcccatgaccctgccaccccatgggcctgctgctggtggcagcgtggccgcctcctgagagttggccctcccttgtgccactgccaggggaggaaaggccttgatgt

SEQ ID NO: 7692 - DNA, 443 bp, Homo sapiens
tgtaattcttattttataaataatgtgatgtagatgtaaccggtgccccctccccgttgtgactgagggcgagtgttatacctggctgcgtgtgcagctgaggagggagtgaacctcaagcctaaatacctgttaggattggagggtctgggtgggcctgggcctagcaatcaagcttctacctgtaccttatgtaaggtagaccctcctagtgtcagtacctgagcttgtttacctcagttccgcaggcaggacagccggtccgggaaccctgagtgagagtgagtgtggatgtgtacagtacacacactggacggcagcgggaggctgggactttccattacaaatagagacttcattcctgttgagtctagttggaatttttagtatgaatgtgagatttttctcctgcttgtgacattaagaataaaaaactgtgatct

SEQ ID NO: 7693 - DNA, 223 bp, Homo sapiens
  misc_feature 2, 4, 48: n = A,T,C or G
angngcttcccaggaaccttgacagtttagattattacagacacttgnccttaaactttcctaggtcatagtctcattattttcacaatttctgatataaaatttgagattttaacaaattttctaattaagtaagcccaccgtagcttctctaccactgattataactaaaaactctggaccccaaatctccttctcccaaaacaacccaaccaacaaacag

SEQ ID NO: 7694 - DNA, 393 bp, Homo sapiens
  misc_feature 10, 260, 268, 276, 314, 359: n = A,T,C or G
tggggacacncagtatatacattttggtgctgtggaatgtttatacctgcaagaattttgaagattgtcattattttttctctgtaagaaattacagattaaaaacaaatgttttgctattattgatgatgtgttttctcataaacatcaactagcagctggacaatctgctaaagattttttttctgactgaagcttttgcttatcttagttattcatatttaaccttgaaatatttggcaaagtgaacaagtattttnaggggacnaattttgnttttatactaagtgattcttatgtgaacaaagtaaagnatccttacaaactatacctacttgtacacaacataatttcaagcnctttttgaaaaaggcatatctatgatgctggctg

SEQ ID NO: 7695 - DNA, 437 bp, Homo sapiens
tggggacaattaacccaccttaatttacctcatagggttttaatatgatagaaagtgagagtccttttttagcagtaaagccttaaaagatgtaagtttttatttttaaattcaaccaatgattagccttggggcaaaatcacttggatgataactagaatttgtcaatttgttagacttaacattcattctcatatgctattttactatatggtcagccaccatcaattcaactttctatctaacaggtttattaatctgccagtttgctggtgttgatagacggttgttatcagtcagctcactataaattcaaaatgatacactgattttaaaacaaccctgaattatcatctgaaggatcattattcttaaatgaaggcataaagactagcaaatccttttgtattgtgttattattaggcctcatttttttt

SEQ ID NO: 7696 - DNA, 407 bp, Homo sapiens
ctcataagcagcgaccttgtggcatcgtcaaaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctcc

SEQ ID NO: 7697 - DNA, 417 bp, Homo sapiens
ggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaagtgagacacctcagctcttcactgtgttgccagagaagagaacagccactgttggaggggccatgatgggatcaacccacatttat

SEQ ID NO: 7698 - DNA, 468 bp, Homo sapiens
  misc_feature 302: n = A,T,C or G
attcctggtctccctgggcccaaaggagacacgggtttgccaggtgtggatggccgtgatgggatccctggaatgcctggaacaaagggtgaaccaggaaaacctgggcctcctggtgatgcaggattgcaggggttaccaggtgtacctggaattcctggtgcaaagggtgttgctggtgaaaagggtagcacaggtgctccagggaagcctggtcagatgggaaattcaggcaaaccgggccaacaggggcctccaggagaggtgggaccccgaggaccccaggggcttcctggcagtanaggagaattaggaccagtgggatccccaggcctaccaggtaaactgggttctctgggtagccctggcctccctggcttgcctgggccccctggacttcctggaatgaaaggtgacaggggtgtagtcggtgaaccgggtccaaagggtgaacagggtgcctctggt

SEQ ID NO: 7699 - DNA, 461 bp, Homo sapiens
gcagcgcggaggccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatggcggccgcaaactgacacctcagggacaaagagatctggacagaatcgccggacaggtggcagctgccaacaagaagcattagaaca

SEQ ID NO: 7700 - DNA, 466 bp, Homo sapiens
  misc_feature 20, 26: n = A,T,C or G
agcggctgctgttggttggnggcccncccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgt

SEQ ID NO: 7701 - DNA, 462 bp, Homo sapiens
  misc_feature 44: n = A,T,C or G
atggaatcaaatgaaatcatcatcgaaaggatcgaatgaaatcntccaccaatggaatcgaactgaaccatcaaatggaaactaatggtatcatcatccaatggaaccgagtgcaatcatcatcaaaagaaacctaatggaatcatcatagaaaggaattgaatggaatcagcgaatggaattgaatgcaatcatcatcaaaaggaattgaagtgaatcatcaaatggaatcgatttgaatcatcaaatagaatcaaaaggaataatcattgaatggacttgaattgaatcataatgggattgaatcgaatggaatcatcaaatagtctcaagtggaatgattgattggactagaatggaatcatcatcgaatggatatgaatggaatcatcatcgaatggaatcaaatggaatcatcaatgaatggaagcgaatgcaatcaccattgaaggaaatcagatg

SEQ ID NO: 7702 - DNA, 457 bp, Homo sapiens
ggaaaacttattctgaatattaacggtggtgaaaaggggacagtttttaccctaaagtgcaaaagtgaaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcatatatgttcaaattcaaaccatttttaaaatgtgaagatggacttcatgcaagttggcagtggttctggtactaaaaattgtggttgttttttctgtttacgtaacctgcttagtattgacact

SEQ ID NO: 7703 - DNA, 439 bp, Homo sapiens
aacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccata

SEQ ID NO: 7704 - DNA, 462 bp, Homo sapiens
gcctcctacacctacctctctctgggcttctatttcgaccgcgatgatgtggctctggaaggcgtgagccacttcttccgcgaactggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggcccttttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgag

SEQ ID NO: 7705 - DNA, 459 bp, Homo sapiens
  misc_feature 42: n = A,T,C or G
ctttggcagtgcagtggcagactcttttagcaaagggctgcntctctaaataactcgagcaccgtctttggaatcaaggtgtgatgaaaagtgctttggagtcacaagcacctgcggttgggtcctagctgtgtgcttaggagcaaggtgacttgatgtaagttagtctgcctcctcctgctcccgactttctcctatgagtgagagctgaaaatgagatacccggtcttgatttcacagtgtggctgggtgtagtgggcaaggcaggtggttgcagagcacaccgcacatgtctggtaccagtagccgtgaacctgagttcattccctttttctttgtttttcagtgaggatctcaggctctatcctgcttggattgtgtgtgtatctttgtgaggggcctttttctcccctcgtgatatactaagacaccatggcagtacatttaaaatgagggaac

SEQ ID NO: 7706 - DNA, 121 bp, Homo sapiens
ctagtctcgagagtacttctagagcggccgcgggcccatcgattttccacccgggtggggtaccaggtaagtgtacccaattcgccctatagtgagtcgtattacaattcactggccgtca

SEQ ID NO: 7707 - DNA, 143 bp, Homo sapiens
  misc_feature 1, 44, 46, 50, 62: n = A,T,C or G
nctgaagtagtgggttttgattgagttgactgtttttaaaaaantntttngattttaattgngatgcagaagttatagtaacaaacatttggttttgtacagacattatttccactctggtggataagttcaataaaggtcat

SEQ ID NO: 7708 - DNA, 347 bp, Homo sapiens
  misc_feature 10, 210, 220, 347: n = A,T,C or G
ccgcacgagntggtgtggggagtcaaaaccacagatgaaaggtaaggacatatttccacaagggatacagagtgtcagagcctcagcagcatgaagaaggcatctatgtggaagaacagcctggcatgggttgttggaacccaggttgagagaagagagcataaagagaagcttcaagatggggtcagatacttgggtacgcaaggtttngatttattancaggggccttaagtggttttctaaaacgcacaggtagctattgcgttatgccaggtcatacactgtgggttcctggggtgagagagagagtggcagggagaataggagaaagggctgggatcggaan

SEQ ID NO: 7709 - DNA, 500 bp, Homo sapiens
  misc_feature 6: n = A,T,C or G
caagtngacactagtggatccaaagatttccgcacgagggaaattacaagatgggtcaatggaaatagacgctgggaacaacttggagacctttaaaatgggaagtggagctgaagaagcaattgcagttaatgatttccagaatggcatcacaggaattcgttttgctggaggagagaagtgctacattaaagcgcaagtgaaggctcgtattcctgaggtgggcgccgtgaccaaacagagcatctcctccaaactggaaggcaagatcatgccagtcaaatatgaagaaaattctcttatctgggtggctgtagatcagcctgtgaaggacaacagcttcttgagttctaaggtgttagaactctgcggtgaccttcctattttctggcttaaaccaacctatccaaaagaaatttttgcagaaatccagagggaaagaagagaagtggtaagaaaaattgttccaactaccacaaaaagaccacacagtggaccac

SEQ ID NO: 7710 - DNA, 453 bp, Homo sapiens
cggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccac

SEQ ID NO: 7711 - DNA, 254 bp, Homo sapiens
caagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacat

SEQ ID NO: 7712 - DNA, 460 bp, Homo sapiens
caaattttaaagaggacatatttaagttcataatcatatttttcagtaaatattgctcagtgaactggaaaactttaatagaaaaatgtctgcagttttgtgattgttaatttggttaaaccgatattttatattatttaagttaggtaacattttatattactttcatatgaataaaagtaatccatgcattgtagagtctataaaatgttgagtttttttagatgatataaactttgattctgggcactagtgctagtagatattactaccctcctgagggaaatcagaaatgatttaaccccagtggaatacattaattcttaaagcggctcttttcagtagttgacttttagaaagtgtctcagtagttaaggaagctaacagtcttagatctacttttaaaacggatggccttcttaagaataaagcaaaaggtgattttctacataatttttgc

SEQ ID NO: 7713 - DNA, 434 bp, Homo sapiens
  misc_feature 423: n = A,T,C or G
ggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttttgccccccangctgttgattg

SEQ ID NO: 7714 - DNA, 461 bp, Homo sapiens
  misc_feature 45: n = A,T,C or G
gacaaagtgaggtgatgaagtgtggggccactaaaccaaaggcanaggagacgtcggccacttcctgtggacgtgggcagagcgttgctgccagttcctggtagccttgaccacgacgctggggggtctttgtgatggtcatgggtctcatttgcacttgggggtgtgggattcaagttagaagtttctagatctggccgggcgcagtggctcacgcctgtaatcccagcactttaggaggctgaggcaggcggatcatgaggtcaggagatcgagaccgtcctggctaacacagtgaaaccccgtctctactaaaaatacaaaaaagtagtcgggtgtggtggcgggcgcctgtggtcccagccactcaggaggctgaggcaggagaatggcatgaacctgggaggcggagcttgcagtgagctgagatcgcgccactgcattccagcctgggcgacaga

SEQ ID NO: 7715 - DNA, 500 bp, Homo sapiens
  misc_feature 25, 26, 356: n = A,T,C or G
caagtcgacactagtggatccaaanntttccgcacgagctcgggcacgctacgagagtacaaggtagtgggtcgctgcctgctccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagngctaccgagacatgggtgcccggcaccgcgcccgagcccactccattcagatcatgaaggtggaggagatcgcggccagcaagtgccgccggccggctgtcaagcagttccacgactccaagatcaagttcccgctgccccacc

SEQ ID NO: 7716 - DNA, 424 bp, Homo sapiens
  misc_feature 2, 50, 321: n = A,T,C or G
gnacgagggtcgttgtggtgcgctgtcttcccgcttgcgtcagggacctntccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagncgtcagacaaccgatcccgtgggtaccgtggtggctctgccgggggccggggcttcttccgtgggggccgaggacggggccgtgggttctctagaggaggagg

SEQ ID NO: 7717 - DNA, 439 bp, Homo sapiens
gttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagta

SEQ ID NO: 7718 - DNA, 500 bp, Homo sapiens
  misc_feature 61: n = A,T,C or G
tcccgcacgaggtaaaatgcagcatctggtgctgtgggtctctctcaggccttgatggacncttccttcctccccactcgcctcctctccactagactttggttcctagagggcgtggggccgggtctgaggttcttgcctgccttccctcccattggtctttggttgctcatccctctaactgcaccccttcttggtccttcctccacagacttcagataatagataagtcattagcaaaccagaccgaatctttagggtgaagagctccccaaagccatctggtgaggtcattgtggggaccagggactgattatttgtcacctggatcacaaagatgggactgtctgctcaggctggtggtgacaggatcctgacccgtggtcctctcccgctccctctgctccaccaggacacatgtataggacactgtgctgtgtgcagtggagaaatctccctgggccaggggaaagttcagacagtgcctctagattgtgttt

SEQ ID NO: 7719 - DNA, 209 bp, Homo sapiens
gtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattcccaggcc

SEQ ID NO: 7720 - DNA, 297 bp, Homo sapiens
ccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctt

SEQ ID NO: 7721 - DNA, 287 bp, Homo sapiens
  misc_feature 6, 8, 48, 51, 53, 54, 108: n = A,T,C or G
gaacgngntgagtttcgcacttgattttcaatattttatagtaagaanttncnncctgctttgggtcatttcataaacaaactctgcatttagataactattaaaggntgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatatt

SEQ ID NO: 7722 - DNA, 380 bp, Homo sapiens
  misc_feature 60: n = A,T,C or G
tccgcacgaggctggccaggttttagatattaacctggctgcagagccaaaagtgaaccnaggaaaagcaggtgtgaaacgatctgcagcggagatgtacggctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctgg

SEQ ID NO: 7723 - DNA, 500 bp, Homo sapiens
  misc_feature 22, 23, 81, 87: n = A,T,C or G
gtcgacactagtggatccaaanntttccgcacgaggtcaaagtgaaagacatttcaaatctgtagcataggctagtgggcnggtccncacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcaga

SEQ ID NO: 7724 - DNA, 188 bp, Homo sapiens
gctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacga

SEQ ID NO: 7725 - DNA, 468 bp, Homo sapiens
  misc_feature 50: n = A,T,C or G
gaacctctgaaatatgctgaacaacttcctgtagctcagataatacaccngaaaccgaagctgaaagactggcatcctcctgggggctttattctgggattatgggcacttattatcatggttttcttcaaaacttatggaattaagcatatgaagttcattttttagacttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgtttttgaaaatagtaatttccccttatccccttttcatttgg

SEQ ID NO: 7726 - DNA, 282 bp, Homo sapiens
  misc_feature 50, 236: n = A,T,C or G
gtaaaatgcagcatctggtgctgtgggtctctctcaggccttgatggacncttccttcctccccactcgcctcctctccactagactttggttcctagagggcgtggggccgggtctgaggttcttgcctgccttccctcccattggtctttggttgctcatccctctaactgcaccccttcttggtccttcctccacagacttcagataatagataagtcattagcaaaccagancgaatctttagggtgaagagctccccaaagccatctggtgaggtca

SEQ ID NO: 7727 - DNA, 404 bp, Homo sapiens
  misc_feature 99, 155, 177: n = A,T,C or G
atttttttggaaacctctgcgccatgagagccaagtggaggaagaagcgaatgcgcaggctgaagcgcaaaagaagaaagatgaggcagaggtccaagnaaaccgctagcttgttgcaccgtggaggccacaggagcagaaacatggaatgccanacgctggggatgctggtacaanttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaatta

SEQ ID NO: 7728 - DNA, 207 bp, Homo sapiens
  misc_feature 22, 23, 36, 51, 82, 101, 112, 118, 151, 156, 189, 194: n = A,T,C or G
gtcgacactagtggatccaaannttcccgcacgagnagaactacaactacnggttcatgtgtcctaaaaatatcaatgactngcacccccaaaagtaattnatttatctgcnaataanaataaaaatgaaggaggattactgagacaccanaagantggctaaaaaaattattttatagctgtcaatancaagngttggtgaggaca

SEQ ID NO: 7729 - DNA, 490 bp, Homo sapiens
  misc_feature 46, 49: n = A,T,C or G
ctggcctaccgcctgacccctggggtgcacgagctgccggtgcatncanccggagcaccgcatcctgaaggtgtccatgaaagagctcaacaagaaaacccctctcctcaccgagggccaggccatctgcttcaccatcctgggcgtgctcaccagcctggtggtgctgggcactgtgggtatcgtcttcctcaacaagtgcgagacctgggtgtccaacctgcgctacaaccacatgctgcggaagaagaagaacctgctgcttcagtacaacagcggggaggacctggccgtcaacatcatcttccccgagaagatcgacatgaccaccttcagcaaggaggccggcgacgaggagatctaagcagcgttcccacagccccctctagattcttggagttccgcagagcttactatacgcggtctgtcctaatctttgtggtgttcgctatctcttgtgtcaaatctggtgaacgctacgcttacatat

SEQ ID NO: 7730 - DNA, 498 bp, Homo sapiens
  misc_feature 11, 262, 265, 266: n = A,T,C or G
caggttcaagngattcccctgcctcagcctcccgagtagctgggattacaggcgcctgccaccacccccgcctaattttttgtatttttagtagagacggggtttcaccgtattagccaggatgatctcaatctcctgacctcgtgatccatccgcctcgccctcccagagtgctgggattacaggcgtcagccaccgtgaccggctcagactgtactcttctagccatctgaaatacgttttctaggtagagatagattgngtnngggtacagttgtgaggataacagaaacatggcagattatttaaaatcatcctgaaagtggtgctttatctgatgaaagtgattgtaatccatagggaaatgtttcaacgtgcgcaagcgttgcggcggcgggcagaggactactacagatgcaaagtaaggagcttcctccccgcagttgcaggatagttcaagtgctgatgcagatgatgccacggcccttagactctctc

SEQ ID NO: 7731 - DNA, 374 bp, Homo sapiens
  misc_feature 44: n = A,T,C or G
tgtaaatttaactgttagtccaaagaggaacagctctttggacnctaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaagg

SEQ ID NO: 7732 - DNA, 347 bp, Homo sapiens
cctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaattt

SEQ ID NO: 7733 - DNA, 414 bp, Homo sapiens
  misc_feature 403, 406: n = A,T,C or G
gaattctgctgctgttattaccccattcaagttgacaactgaggtaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaatttttttttttngcngtcatccc

SEQ ID NO: 7734 - DNA, 499 bp, Homo sapiens
  misc_feature 2, 52: n = A,T,C or G
gnacgagccccattgtatccaggaagtaactaacctgcttttgattttactngctcctaggtggaagggacttgccttgtctcagatgagactttagactgtggacttttgagttaatgctgaaatgagttaagactttgggggactgttagaaaggcatgattggttttgaaatgcgagatcatgagatttgggaggggccaggggcagaatgatatggtttggctgtgtccccatccgaatctcatcttgaatttctgtgtgttgtgggagggacaggtgggaggtcattgaatgatgggggcaagtcttttctgtactgttcttgtgatagtgaataagtctcatgagatctgatggttttaaaaagaggagtttccctgctcaagctctctctctttgcctgctgccatccatgtaagatgtgacttgctcctccttgccatctgccatgatgtgaggcttccccagccacgtggaactgtaagtccaattaaac

SEQ ID NO: 7735 - DNA, 357 bp, Homo sapiens
  misc_feature 4, 8, 53, 58, 59, 64, 66, 319, 325: n = A,T,C or G
aaangagnaacttatatggcttatccttttagcaaatgtatttcataatgttnttccnnaaaantnaaaaattaggcaaagctgccagggtgtggtggctcgcacatgtaatcccaacactttgggagaccaaggcgggtggatcacctcaggtcgggagttcgagaccagcctgatcaacatggagaaaacccgtctctaccaaatatacaaaattacccaggcatggtggtgcatgcctgtaatcctagctactcgggaggcagaggcaggagaatcacttgaacccaggaggtggaggttgctgtgaaccaagatngggccnttgcacaacaagagtgaaactccatccatctc

SEQ ID NO: 7736 - DNA, 157 bp, Homo sapiens
aagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttc

SEQ ID NO: 7737 - DNA, 487 bp, Homo sapiens
  misc_feature 42: n = A,T,C or G
cctgctcatctccaccctgaaggacaagcgcgggacccgctntgacctaagggagaacattgagcaattcttcaccaaatttgtagatgaggggaaagccactgttcggttaaaggagcctcctgtggatatctgtctaagtaaggattccatatggctctcatatcattccattccatctctgccaagatttggataccgcaaaaatttgtgtttgtggaagattctgtctgaactctttcattcaaggaactactaccatgaatctgcattctgttgcccacactgtggtcttagtagataatttgggtggtactgaagcacctattatctcttatttctgttctctaggctgttatgttaattcctctgatatgttaaagtaatgggtgagaccagaaaaagaaatttcaataacagatcagtttggggtgcatgtatgattttgcagcgtcaaattggagtaagggaagatttctgtatactt

SEQ ID NO: 7738 - DNA, 120 bp, Homo sapiens
  misc_feature 45, 52: n = A,T,C or G
gaaagtcagaagtctctaatatatcatttgtcttttttccagtgnggtaacnataaggcataaatgcaggtaattattcccagctgacctaaagtcaataaaacattctgtttaagtgtt

SEQ ID NO: 7739 - DNA, 277 bp, Homo sapiens
  misc_feature 8, 11, 261, 264, 266: n = A,T,C or G
gccgccgntgnggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgnaananatgttctggtt

SEQ ID NO: 7740 - DNA, 218 bp, Homo sapiens
  misc_feature 6, 10, 52, 53, 59: n = A,T,C or G
cgaaanagantttctacttatttcgtttttggaatcagcttacagattccanntccccnttgaatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtagg

SEQ ID NO: 7741 - DNA, 500 bp, Homo sapiens
  misc_feature 2, 4, 48, 50, 55: n = A,T,C or G
gngntaacacatacacacaaacacacacacacacatacacacaccatntntcccnatctatgaagtcaaagaaactcagttctttccacaatgcaataaaaagttgtacaagaggagaaaatggagttttaaactcatgtaaacctttggaatgttgtcttctttatattaccaatgacacctctagagcctacaagaaaaaagaattgcttggaaagtaaatatcttggacaatgtagctaaaagaatattaaatgttctatttttagcttatcatggttgtgaagaaatatccaccttaatctactggaaggtggccttagtttccaacactgaatttcacattttgaaatttattggctctctggctttcccatgaaatttaaaagaagtgagaatgccttaaaaattttgaatgaatttaaagattaaacccttctggcttttcttgtcacatgaaattaaatagaggcaacttgggaagggtagaaaggccactt

SEQ ID NO: 7742 - DNA, 103 bp, Homo sapiens
  misc_feature 1, 48: n = A,T,C or G
ngcccctccacttctctcccaagccaggtcccggcatgggtgggttangctcatgctggcaatacttgaaacgggtttattaatgctgggtattttgcacatt

SEQ ID NO: 7743 - DNA, 358 bp, Homo sapiens
gtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaaga

SEQ ID NO: 7744 - DNA, 500 bp, Homo sapiens
  misc_feature 2, 7, 55: n = A,T,C or G
angaggncagcttgtctaacttcatgtacatgtagaaccacatgtttgttgtccnactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaac

SEQ ID NO: 7745 - DNA, 287 bp, Homo sapiens
  misc_feature 45, 51: n = A,T,C or G
ctttcattcctatccttgatttaataaagcttcagtacacaaaantgtcanatatttgcttacaattcacaaattctgtggtgccaataatttatgaatagggcataactaagcagcatagagaagtcctgggaaaattggacatagtgtgcctggcctgttaaaagatagctatttgagccgggcacggtagctcatgcctataatcccagcactttaggaggccgagatgggaggatcacttgagatcaggagctcaagaccagcctaggtaacatagggagacc

SEQ ID NO: 7746 - DNA, 170 bp, Homo sapiens
  misc_feature 2, 7, 49: n = A,T,C or G
angaggnggaatgcaagtaggcagccagcccgtctgttccctctccgcnccgccccgccccgcccccgtcactgcgcttctgttataccatctttgcctgactctctccggcttctccattgaatggctaatgtgtatgtgaaataaagaaataaagaaaaacaaacgcg

SEQ ID NO: 7747 - DNA, 500 bp, Homo sapiens
  misc_feature 51: n = A,T,C or G
cgaacgagaaaaagtttcttggccctcgtgggccagtgtggaggggctgtnttttccctcatcaggagcgtcacttggtggtttagggggaaataatctattcttaagattgaagagagtgcaggatttggggggttgactctacatccttcagtatcagggcttatctccttgtcttacctcctaggagaccctcctgttcttaactgtgggcgatgagaaaggtggtggactcttcttactggcagggccacctgcgtctgtggagaccctggggcccaggtaattctttgtggactctcttgcacatgtagtagagcctgtatcctacaaatacattcctttactgagtcaaaggaccatcacatctgcgatctcatttaattcacatcatgggcatgtgaggtgggctgagcagagataattattactactgtcatttccagtttgacagttgaaggtcttttggctccacatctcacatgtatgtttttgttttt

SEQ ID NO: 7748 - DNA, 480 bp, Homo sapiens
  misc_feature 2, 4, 48, 52, 54, 200, 228, 314, 320, 321: n = A,T,C or G
angngggcctcctggccccgtcggtccctctggcaaagatggtgctantttnancccctggccccattgggcctcctggtccccgtggacgatcaggcgaaaccggccctgctggtcctcctggaaatcctggaccccctggtcctccaggtccccctggccctggcatcgacatgtccgcctttgctggcttaggcccnagagagaagggccccgaccccctgcagnacatgcgggccgaccaggcagccggtggcctgagacagcatgacgccgaggtggatgccacactcaagtccctcaacaaccagatngagagnntccgcagccccgagggctcccgcaagaaccctgctcgcacctgcagagacctgaaactctgccaccctgagtggaagagtggagactactggattgaccccaaccaaggctgcaccttggacgccatgaaggttttctgcaacatggagactggcgaga

SEQ ID NO: 7749 - DNA, 302 bp, Homo sapiens
  misc_feature 257: n = A,T,C or G
cgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgngttgtgcagcattaaaaaaaatcaaaataaaaattaaatgtgagc

SEQ ID NO: 7750 - DNA, 315 bp, Homo sapiens
  misc_feature 264, 268, 284, 306, 307: n = A,T,C or G
gtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgnattntagctatttaagtagnatttgttcaataaaaacgcaanntgtaaggt

SEQ ID NO: 7751 - DNA, 239 bp, Homo sapiens
gcaaggtgttgtgaatttcccatatgatgatttcattcaatgtgtcatgagtgtttaaatcaagaggaagctgcatgaatgtaatcaacattccaactggagctctcctttgcttgtcctctttgccttcggtaatatgtataaacttacatcacgactttctcttaacagctgttgtaaagtttattactttatgtacaactgaagttttgttttagttttgataataaattctttgg

SEQ ID NO: 7752 - DNA, 417 bp, Homo sapiens
  misc_feature 354: n = A,T,C or G
cggaagtaatgttccaaatatgcacaatggtatgaaccaacaggcatatgcatatcctgctactgcagctgcacctatgattggttatccaatgccaacaggatattcccaataagactttagaagtatatgtaaatgtctgtttttcataattgctctttatattgtgtgttatctgacaagatagttatttaagaaacatgggaattgcagaaatgactgcagtgcagcagtaattatggtgcactttttcgctatttaagttggatatttctctacattcctgaaacaatttttaggttttttttgtactagaaaatgcaggcagtgttttcacaaaagtaaatgtacagngatttgaaatacaataaatgaaggcaatgcatggcccttccaataaaaaatatttgaagactg

SEQ ID NO: 7753 - DNA, 415 bp, Homo sapiens
  misc_feature 185: n = A,T,C or G
acaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctnatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggg

SEQ ID NO: 7754 - DNA, 101 bp, Homo sapiens
cttgaatcagttttgattctatttgtaagtgtttcttgtcgtgaggcacctgccatgtctgttgcgttttcctcggcagcgtgtagggcttcagcttccct

SEQ ID NO: 7755 - DNA, 407 bp, Homo sapiens
gctgctcggggagccgggccagcaccggcttgggggccggaggcgttcactccagactgggaaagccgagaagtttccactgggaccactatcatggccgtgcagtttgacgggggcgtggttctgggggcggactccagaacaaccactgggtcctacatcgccaatcgagtgactgacaagctgacacctattcacgaccgcattttctgctgtcgctcaggctcagctgctgatacccaggcagtagctgatgctgtcacctaccagctcggtttccacagcattgaactgaatgagcctccactggtccacacagcagccagcctctttaaggagatgtgttaccgataccgggaagacctgatggcgggaatcatcatcgcaggctgggaccctcaagaagg

SEQ ID NO: 7756 - DNA, 487 bp, Homo sapiens
  misc_feature 256: n = A,T,C or G
tgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgagntcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcaaaggagctgagttggcagaccgggcccccctga

SEQ ID NO: 7757 - DNA, 207 bp, Homo sapiens
ctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaact

SEQ ID NO: 7758 - DNA, 408 bp, Homo sapiens
  misc_feature 3, 7, 51, 320, 321, 322: n = A,T,C or G
aangagnacagaagagccacagtctccagactcatggcgttccctccaganctccccattcccctctgagcatatttctatgctgctgcttcttgtgacttacatgaggcatctcagcttcttcatgtttgtagggatggttccctaagcctgttcaagtaggctctcactagagttaccattcatatttgagaagaaaagaacatttaataaatgtatgtgtggggctgaggttctaaaggaattgaaaagagacgataaacattgaatgagggtgagggcatccctgctggggagaaacctctgtccctaggaagagnnngttcatgtcatgtggtttgggatgaaccaggggtctggccccatcgggtcacaggtgatggcaaatagaaaagaagcaaatggagg

SEQ ID NO: 7759 - DNA, 457 bp, Homo sapiens
cagcagctgatggacatttaggttgtttccattgaatgatgctgctctgaacactggtgtacatgtttttgtgtaaacatagattttcagttcttttgggtgtatacccaggaatggaattgctagatcatatggtaactttttgaagaacaaccagacagttttccaaagaggctgtaccattttacattcccaccaacgatgtctgagggttccagtttccctatatcctttgcctaaacacttgttattatttgtcttttcaattatagccatcctagtgggtgtgaagcgataagtcactttagtttgatttctgttaccctactgactaatgatgtcgagcattgtttcatgtgcttattagtcatctgtatatcttctttgaggaaatgtctattcacttcctctgcataaaaaaatgggttatttggccttttagtgttgagttttaaga

SEQ ID NO: 7760 - DNA, 206 bp, Homo sapiens
ctcattggccgctgtgttcatccaagggggttctcccagaagtgaggggcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactt

SEQ ID NO: 7761 - DNA, 426 bp, Homo sapiens
ccagcaccatggcggttggtaagaccaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtttgttctgtg

SEQ ID NO: 7762 - DNA, 139 bp, Homo sapiens
atttagggagttacataggtgatgggggaaattgttaactacctttcattttcctgggaagtcaaggttacatcttgcagaggttgttttgagaaaaaagggcccttctgagttaaggagccatagttctatcaatgat

SEQ ID NO: 7763 - DNA, 321 bp, Homo sapiens
ggaaacagggctgattcttgattcccaattctcaactctccttttcctatttgaatttctttggtgctgtagaaaacaaaaaaagaaaaatatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccatctgactctaattttatgagaattgcagaactctgatggcaataaatatatgtattatgaaaaaataaagttgtaatttctgaa

SEQ ID NO: 7764 - DNA, 212 bp, Homo sapiens
caaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgcctt

SEQ ID NO: 7765 - DNA, 498 bp, Homo sapiens
  misc_feature 3, 51, 52: n = A,T,C or G
ggnacgagcacagactcagagagaacccaccatggtgctgtctcctgcctnnaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtagccgttcctcctgcccgctgggc

SEQ ID NO: 7766 - DNA, 303 bp, Homo sapiens
gccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagattgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgcc

SEQ ID NO: 7767 - DNA, 203 bp, Homo sapiens
gccaaatctgtcaagatcaagaaaaataaggacaacgtgaagtttaaagctcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatc

SEQ ID NO: 7768 - DNA, 350 bp, Homo sapiens
  misc_feature 3, 53, 58, 209: n = A,T,C or G
cgnacgagacagcactcaggccaacgccatcctggccatcgagcagttcgaangtctnctgggcacccactgcagccccgatctgctcttcttcctctgtgccatgtacgcgcccatctgcaccattgacttccagcacgagcccatcaagccctgtaagtctgtgtgcgagcgggcccggcagggctgtgagcccatactcatcaagntaccgccactcgtggccggagaacctggcctgcgaggagctgccagtgtacgacaggggcgtgtgcatctctcccgaggccatcgttactgcggacggagctgattttcctatggattctagtaacggaaactgtagaggg

SEQ ID NO: 7769 - DNA, 346 bp, Homo sapiens
cccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctg

SEQ ID NO: 7770 - DNA, 321 bp, Homo sapiens
  misc_feature 56, 61: n = A,T,C or G
cctcctccatgcactttaccagctcaacgcatccactctctgttctcttggcaggncgggngaggggggataggaggtcccctttcccctaggtggtctcataattccatttgtggagagaacaggagggccagatagataggtcctagcagaaggcattgaggtgagggatcattttgggtcagacatcaatgtctctgtcccccctgggtccagccaagctgtgccccatcccccaagcctcctgggaggatccagccaaatcttgcgactcctggcacacacctgtctgtaacctgttttgtgctctgaaagcaaata

SEQ ID NO: 7771 - DNA, 461 bp, Homo sapiens
  misc_feature 49: n = A,T,C or G
acgcctccccatcattgacattgcacccatggacataggagggcccgancaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctatt

SEQ ID NO: 7772 - DNA, 307 bp, Homo sapiens
actgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaactttt

SEQ ID NO: 7773 - DNA, 497 bp, Homo sapiens
  misc_feature 4, 11, 53, 55, 324: n = A,T,C or G
ccgnacgaggncgagacagggcgtgttcgctgttcagtgccggtgttgcaggntntgacggcagctggagtgcgttctgccgaagcttgtggttgcacgcccatcgtcttaggggctaccttccgtgaccatgtccaagtctctgaagaagttggtggaggagagccgggagaagaaccagcccgaggtggacatgagtgaccggggcatctccaacatgctggatgtcaacggcctctttaccttatcccatatcacacaactggtcctcagccataacaagctaacaatggtgccaccgaacatcgcagaactgaagaattnggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcg

SEQ ID NO: 7774 - DNA, 448 bp, Homo sapiens
  misc_feature 32, 35, 37, 40, 49, 299, 301, 302: n = A,T,C or G
aaagcaggtcttgagaaaaatgcttcagctanttntnccngctacaccnggaactcgtgtattcctggacttatcaacaaattaataaattcctttctcactcaagccagtttgagtggtgatcagaaaaggactgatgggcactgggactaacacaggatgtacgtgatttagatagtgacttcctgtgtaaccccgggtaagcccaacaccctcatgaaacattttgtctttgaataaacaggtacccagcataaccccattgaagagctgttccctgggacctggagaggaacacngnnggctgccatgcccactgcaccttcaggtgaggcaaggcagtaaaacagagaggctgtgactatccaggcaaacagttgagagtttgaatttctgctctgctgctcatgggctgtgtaaccctaagacaattatttgacctctctga

SEQ ID NO: 7775 - DNA, 499 bp, Homo sapiens
  misc_feature 2, 52, 61: n = A,T,C or G
gnacgagctgagacagcatgacgccgaggtggatgccacactcaagtccctnaacacccanattgagagcatccgcagccccgagggctcccgcaagaaccctgctcgcacctgcagagacctgaaactctgccaccctgagtggaagagtggagactactggattgaccccaaccaaggctgcaccttggacgccatgaaggttttctgcaacatggagactggcgagacttgcgtctaccccaatccagcaaacattcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctg

SEQ ID NO: 7776 - DNA, 424 bp, Homo sapiens
  misc_feature 2, 3, 52, 54, 151: n = A,T,C or G
annagggtcgccgtggctggagccatctctagcttcattgcttaccagattnanaccctatgcttcaaagaaaatgcagaacaaggggaggtggacatggagagccaccggaatgccaacgcagagccagctgttcagcgtactcttttanagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaagg

SEQ ID NO: 7777 - DNA, 286 bp, Homo sapiens
caaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttcttttt

SEQ ID NO: 7778 - DNA, 388 bp, Homo sapiens
  misc_feature 3, 56: n = A,T,C or G
ccncacgagggcagataaactggactgtcctctacagaaggaagcacaaaaagggncagccggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggctgctgctaaggcacctacaaaggcagcacctaagcaaaagattgtgaagcctgtgaaagtttcagctccccgagttggtggaaaacgctaaactggcagattagatttttaaataaagattggattataactcta

SEQ ID NO: 7779 - DNA, 419 bp, Homo sapiens
  misc_feature 44, 49: n = A,T,C or G
ctcagggtggccggcattcacaagaaggtggcccggaccatcgntattnctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatc

SEQ ID NO: 7780 - DNA, 179 bp, Homo sapiens
  misc_feature 4, 8, 53, 58: n = A,T,C or G
gaangagncacctactcatgcacctaattggaagcgccaccctagcaatattnacccntaaccttccctctacacttatcatcttcacaattctaattctactgactatcctagaaatcgctgtcgccttaatccaagcctacgttttcacacttctagtaagcctctacctgcacgac

SEQ ID NO: 7781 - DNA, 462 bp, Homo sapiens
  misc_feature 158: n = A,T,C or G
gaattattgtgctgattgtaaatctgttatagcaagaccccctatttaattttagaaaaagataactggaaccttcaggtgaaatgtaattggggaaatacaaattggatatttacatgaaatattttcagattgcttaagcggtgtattgtcagaanaagtatcaatggggttcttttttaaattaattttttaaagaattgggcaacaattccataaaatagaataagtgttccctcaatggggttcttttatgtttaattttttttcctaaaaacaaaacaaaaaaagtgaactgagttttccaggctctgaatgtctgagtgtgatttgtgtggccgcaggagcagtgaacatctccaaaaagacaatatgagcaaagatttccttaaaaatttatatatgacattgaaatttaaaaaaattttgaaatttaaaatttaaattttatgtaagaaattt

SEQ ID NO: 7782 - DNA, 462 bp, Homo sapiens
ccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgccc

SEQ ID NO: 7783 - DNA, 439 bp, Homo sapiens
gtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagag

SEQ ID NO: 7784 - DNA, 389 bp, Homo sapiens
  misc_feature 25, 26: n = A,T,C or G
caagtcgacactagtggatccaaanntttccgcacgagcaatagccccatgaaaagaagcatcacccaaggatattgtaaaaaggatgtaacaaggagatagggtagacattgtactcagtgggccttggggcctagcccagctctgagcagaggactgtggcattcactgtccttgagtgtttcaccttcttggataacacacgggccttctcttctggatttcatcagagattacagccagatgggggctgaagaccatcctcttgaccacagaggtgtgactgtgggaattcctcccaatttatggtttcccagaaaatcttagttccttttatttatagaatgcatgtcttttgtgttaagaaaccaaagagaaataaagagaac

SEQ ID NO: 7785 - DNA, 372 bp, Homo sapiens
ctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagttt

SEQ ID NO: 7786 - DNA, 465 bp, Homo sapiens
  misc_feature 45, 50: n = A,T,C or G
gcaagaacagcattgcctatctggacgaagcagctggcaacctcnagaangccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggca

SEQ ID NO: 7787 - DNA, 462 bp, Homo sapiens
ggtcggacattttttaacctagcagaagtacagagtcatatattttgctacgaatattgttgtagtacagaaaacccactttgcccgttagtgtgtggatagtatgtgtgtgtccgcactcatgataacttgaatgttgaaccagacatagggttcatttttgaaaggttaaaccacactgtttcaggaacttgctccaaatactacttggttatcccttcctttaccagttagaactaaagagtgtgatgtatgaacacactgggttgggattttctgttgaggatatgcagggcattttggcatgaggcaaatacagaagcaagatttcattctacttggtgatttgaatcatgacagtcctcattccaatctctctttaattctctctggccctgcccacactctgtatttgaaaatcttgtttttgctctttccggagcttcacccctctacttacat

SEQ ID NO: 7788 - DNA, 250 bp, Homo sapiens
gaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgaga

SEQ ID NO: 7789 - DNA, 137 bp, Homo sapiens
  misc_feature 43: n = A,T,C or G
aatttcaaagccttcgctagtctccgtatggcccgtgccaacncccggctcttcggcatacgggcaaaaagagccaaggaagccgcagaacaggatgttgaaaagaaaaaataaagccctcctggggacttggaatc

SEQ ID NO: 7790 - DNA, 190 bp, Homo sapiens
caggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaatagg

SEQ ID NO: 7791 - DNA, 485 bp, Homo sapiens
gcatcttctacacactacagctattgttaggttgcctgcggacacgctgggcctctgtcctgatgctgctgagctccctggtgtctctcgctggttctgtctacctggcctggatcctgttcttcgtgctctatgatttctgcattgtttgtatcaccacctatgctatcaacgtgagcctgatgtggctcagtttccggaaggtccaagaaccccagggcaaggctaagaggcactgagccctcaacccaagccaggctgacctcatctgctttgctttggcatgtgagccttgcctaagggggcatatctgggtccctagaaggccctagatgtggggcttctagattaccccctcctcctgccatacccacacatgacaatggaccaaatgtgccacacgctcgctcttttttacacccagtgcctctgactctgtccccatgggctggtctccaaagctctttccattgcccaggggaggg

SEQ ID NO: 7792 - DNA, 205 bp, Homo sapiens
  misc_feature 45, 48: n = A,T,C or G
ctagaacttgtttttgttaacatgtgctttgatgtaaagaacttnttncgtatgcaaaacataacttgcattatggttgtacaatacactatattgtttagggattccggaaagcagtttaatgcagaaataactatatctagtatgcagttcatattgtgaatgaagctttgcttttgtaataaataaataagactttctaatg

SEQ ID NO: 7793 - DNA, 492 bp, Homo sapiens
  misc_feature 3, 52, 58: n = A,T,C or G
cgnacgagatgcagagcgccctggacgccgaggtgcggagcaggaatgaatncatccngctcaagaagaagatggagggggacctgaatgaaatcgagatccagctgagccacgccaaccgccaggcggcggagaccctcaaacacctcaggagtgtccagggacagctgaaggatacgcagctccacctggatgatgccctccggggccaggaggacctgaaggagcagctggcgattgtggagcgcagagccaacctgctgcaggccgaggtggaggagctgcgggctactctggagcagacggagagggcccggaaactggcggaacaggagctcctggactccaacgagagggtgcagctgctgcatacccagaacaccagcctcatccacaccaagaagaagctggagacagacctcatgcagctccagagtgaggtagaagatgccagcagggatgcaaggaacgctgaggagaaggccaagaagg

SEQ ID NO: 7794 - DNA, 360 bp, Homo sapiens
  misc_feature 5, 295: n = A,T,C or G
gcacncgggcagccggtctctgtagtaccgcgtggtactcactgcggtaagacaaccccagagacctgggcccgatggctggcagtacccagacagtggctggactcaagctcctcctccaggcttctactgtcccccacggaccccctttctgtgctgcacttccgcctcctcggagccaaatcccacgcgtactggccgtcacgtgatgtaggacagcccaatcacgctcacccccttctcgttggcgccccagctccgccgcttggcctttcgggaaagggtggaggaccanaagacggggactaggagcgctctgccgacgtcagcttttgtctccagtattttcgggggctggtg

SEQ ID NO: 7795 - DNA, 181 bp, Homo sapiens
  misc_feature 46, 47, 51: n = A,T,C or G
gaccaatctatcaccctatagaagaactaatgttagtataagtaanntganaacattctcctccgcataagcctgcgtcagattaaaacactgaactgacaattaacagcccaatatctacaatcaaccaacaagtcattattaccctcactgtcaacccaacacaggcatgctcataagg

SEQ ID NO: 7796 - DNA, 235 bp, Homo sapiens
gttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttccccat

SEQ ID NO: 7797 - DNA, 500 bp, Homo sapiens
  misc_feature 2, 3, 49, 54, 57: n = A,T,C or G
annaggatttagtgggccttacaaatttccattcactccacctttaganttttnccncttatgcttctacacttcccaggtccctgtcccaccaattttgggtttttatcaaatgaaggaggaagaagtacaactaagaataaccattaatttaaaacttcatgaaagtgtgaaaaataattttgaattctgtgaagcccatatacctttttacaatagaggtccaattacacatttggaatacaaaactagttttggccagcttgaagtatttcgagagaaaagcttattgatctggattattggccagaagttcccaaaatcaatggaaattagtctttctggaactgtaacttttggagccaagagccatgagaagcagccatttgacccaatttgtactggagaaacagcatatttaaagcttcattttaggatcttagattacacacttactggatgttatgcagatcagcattcagttcaagtttttgcatcag

SEQ ID NO: 7798 - DNA, 395 bp, Homo sapiens
  misc_feature 45, 50, 313: n = A,T,C or G
gtcgctgcaacctaccctctctctgcctcagccttacacccaagnagtangtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacagggcatatttaagggggcatctttgngtaaaagatgcatggagtcaggagaaaaccaccttcataaactgctctgtgcaaagaggaataaaacattttttccaaactg

SEQ ID NO: 7799 - DNA, 483 bp, Homo sapiens
  misc_feature 50: n = A,T,C or G
gccgggaccgcagccatgagaggaaccgggacagagaccgagatcgggancgggatcgagaccgggatcgagacagagacagagagcgggacaggggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctcc

SEQ ID NO: 7800 - DNA, 418 bp, Homo sapiens
  misc_feature 4, 8, 50, 53, 55, 58: n = A,T,C or G
caanacgngctgacatctgcaggccgaaagagccgtggccttggaaaggnttnanccnccaccacactattggtggctctcgccgggcagcttggagaaggcgcaatactctccagctccaccgttaccgctaatataagtaaagtttgtaaaattcatacttaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaagg

SEQ ID NO: 7801 - DNA, 446 bp, Homo sapiens
  misc_feature 59: n = A,T,C or G
ccgcacgagctctagccttcactcctgggctccaaaagctatcccagttgcctgttttncaaatgaggttcaaggtgctgctttgcatgcctgccaacccatggaagttgtttcttacttcttttctctcttatttattaaccatggtctgagagttgtttttgttctatgtaacagtattgccacaaaactataggcaaatcgtgtttgcagggagatttctgatgcctctgtgggtgtgtgtaagttaaagtggccacatttaagaaggccaagctttgtagtggttgcacagtcacactgatatgctgatttgctctttctcattgtatgtctatgctttgtcatcagtgctatagtaaattacaaagaaataggtagattgtatgaacatacccacaaatgcctatgatttaggttaccaatgtattctttctcatttgggg

SEQ ID NO: 7802 - DNA, 500 bp, Homo sapiens
  misc_feature 3, 20, 77: n = A,T,C or G
ganactagtggatccaaagntttccgcacgaggagcgagggacaagactccgactccagctctgacttttttcgcgnttctcggcttccactgcagccatgtcactcctcttgctggtggtctcagcccttcacatcctcattcttatactgcttttcgtggccactttggacaagtcctggtggactctccctgggaaagagtccctgaatctctggtacgactgcacgtggaacaacgacaccaaaacatgggcctgcagtaatgtcagcgagaatggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagcgtggcggtgtttactggcgccttgatctatgccattcacgccgaggagatcctggagaagcacccgcgagggggcagc

SEQ ID NO: 7803 - DNA, 237 bp, Homo sapiens
gcttcggcagaaaacgatgagacgtgcaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacgacaaacctccttgtcaaagtgtgtaaaaataaaggattgctccatc

SEQ ID NO: 7804 - DNA, 439 bp, Homo sapiens
atatctatccataaaacgttctatgatcaggcagtttggcccttgttccctcagaaagtgacagtgatgttccttgcacctttgctgagcaaggtttgatagggatgttccttcaattgggcctttacccaacggggtttcgtaagaaagttgggcaggaaatttctcacggcctgaacccccgtggaatgtttcactttgaccagtgtctgcgaaatggcggggggcttagaaaatggtgcagtttggcagggcgtggtggctcacgcctgtaatcccagcactttgggaggctgaggcgggtggatcacaaggtcaagagatcgagaccatcctggccaacatggtgaaaccctatctctactaaaaatacaaaaaattagccgggcgtggtagcgggtgcctgtagtcccagctactcaggaggctgaggcaggag

SEQ ID NO: 7805 - DNA, 500 bp, Homo sapiens
  misc_feature 2, 4, 50, 53, 61, 108: n = A,T,C or G
anangagcacaaggccttggacagggtggaggagcacccaggctccaggnttnctgctganaaatttctgaacaggctccccaagtttgtgatccggcaaggcgaggngattgacatccggggccccatcagggacaccttgcagaactgctgcccattgcctgcccggatccaggagattgtggtggagacgcccaccttggccgctgagcgagagaggagccaggagtcacccaacacaccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtcca

SEQ ID NO: 7806 - DNA, 499 bp, Homo sapiens
  misc_feature 59: n = A,T,C or G
ccgcacgagcgtaagggctgaggatttttggtccgcacgctcctgctcctgattcaccnctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttggaggtggaagtcaccattgcagatgcttaagtcaactattttaataaattgatgac

SEQ ID NO: 7807 - DNA, 471 bp, Homo sapiens
  misc_feature 3, 57, 59, 352, 442, 459: n = A,T,C or G
cgnacgagaaatcatgttgtcatttatgctttatgtagcctatttttcaatttcctncntttaaaagcaattttttttgacaccaagattgttgatttttaattaacaccagttggtggcactagaaacctgaaatttttcaaagatgaacaaagaaaaattgaaaaggtaatctaaacatggagaatttttaggaaaataaatgaaaaatataattgtatattagagatgtatttttcttctggaatggaattctttttctaaaatgcaaatcgctatccattttgactgcaatgatgaaacttgtttatcttccagaggacatatatatatgtgtgtgtgtgtgtattgnacagatacctttaatttgattacactgtttcttgtaaatatgtttctgtataaaatgaaacttttcaagaggattctatgtatatattgnacttattaaataggtantgcctatttacc

SEQ ID NO: 7808 - DNA, 217 bp, Homo sapiens
ctcaagctccggggaaaggacattggaaagcccatcgagaaggggcctagggcgaaatgaacacaaagcctcgaaatcagtgcgctccagctgatctcgttccgccggttccccttggccgccagttccgttctcctcacgggccgaacggaacaaggggtccagcttgcgggggaccctccccagcccattcctgctgtcaaacaaacaaaacctt

SEQ ID NO: 7809 - DNA, 485 bp, Homo sapiens
gtttcgacttcagcttcctgccccagccacctcaagagaaggctcacgatggtggccgctactaccgggctgatgatgccaatgtggttcgtgaccgtgacctcgaggtggacaccaccctcaagagcctgagccagcagatcgagaacatccggagcccagagggcagccgcaagaaccccgcccgcacctgccgtgacctcaagatgtgccactctgactggaagagtggagagtactggattgaccccaaccaaggctgcaacctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccagttcgagtatggcggccagggctccgaccctgccgatgtggccatccagctgaccttcctgcgc

SEQ ID NO: 7810 - DNA, 209 bp, Homo sapiens
ctaaccttgtatatacttttattagagtgctgataacaccatattacagcagcatacttacatatctgttttcttaactgtgagctccttgagagcagggactgtgtgtttttgcttttatttcaccagtactcagaactatccacagtatagaaaagcactcaataaatggaataaatgaaaatgaatagataaataaatgatttcac

SEQ ID NO: 7811 - DNA, 340 bp, Homo sapiens
gacacaggtgttctatacattgcaggtaggaagatgcattggtgtatcttctatggagagcaatatgacaagacctttcaaaattatatatacaagtgccttttgacttgggatttttctaggatttctaagatttttttcttttagaaattcttgcacaaaattacaaagatataaatacaagtattttcatgtaacattttgcttatagaaaatgattggaagcaaatccaggtgaggtggcttgtgcctataatcctagctactcaggatggtgaagtggagtgggaggatagcttgagcccagaagttcgagaccagcctgggcaatatagtgaga

SEQ ID NO: 7812 - DNA, 400 bp, Homo sapiens
  misc_feature 71, 214, 222, 226, 269, 381: n = A,T,C or G
gaacatttagctggagctcgcgcgcctgcaggtcgacactagtggatccaaagaattcggcacgagtaggnctacaagacgctacttcccctatcatagaagagcttatcacctttcatgatcacgccctcataatcattttccttatctgcttcctagtcctgtatgcccttttcctaacactcacaacaaaactaactaatactaacatctnagacgctnaggnaatagaaaccgtctgaactatcctgcccgccatcatccctagncctcatcgccctcccatccctacgcatcctttacataacagacgagggtaacgatccctccccttaccatcaaatcaattggccaccaatgggactggaacctacgagtacncccgactacgggggactaa

SEQ ID NO: 7813 - DNA, 221 bp, Homo sapiens
  misc_feature 16, 193: n = A,T,C or G
acaaaatgctgagctngcgcccttgaggtcgacactagtggatccaaagaattcggcacgagcggcacgagcagaggtggaggtgggctgatggcctggctgcctggtggttgatggttttgctccccctaccttttttttttgagtttattctgattgattttttttcttggtttctggataaaccaccctntggggacaggataataaaacatgtaata

SEQ ID NO: 7814 - DNA, 354 bp, Homo sapiens
  misc_feature 18, 22, 30, 33, 260: n = A,T,C or G
gacaataagctggagctncgcncgccctgnggngcgacactagtggatccaaagaattcggcacgaggataatttatataactagaataatttttttcctttcttttatggacctaaatctgccaattgggaattttgtgcatgaaatatgaagttactttttatagataatcagtgcttttaagtccctaaaaggctcctgctgaagtaatgatgatgttaataataaaagcctttgaaaggctgaaaacctacatagnggtaccatagtatttggagcttctataggagtggagaggggcagctcattgttgagagttgcatgctgcaccctaatggtcagcaatgaaataa

SEQ ID NO: 7815 - DNA, 400 bp, Homo sapiens
  misc_feature 3, 133, 225, 378: n = A,T,C or G
ganaaaagctggagctcgcgcgcctgcaggtcgacactagtggatccaaagaattcggcacgaggaaaagggaaaagtataaactggccttaaaattgtccaattatagttttataaccagtctattaaaggngtttgtttaaaatggatatagttttagatttgtggtaatgctttggtattttcttggggaagaccttcacctttgcaaacttccctcatgtnaggaaggtactttaaatgtagcagccactgacatttctttttttaaaaaaaatttgagaagtctacttccttttaacttttttggtcttcagctaaaaaataggataagaaattaaggtctattccattctccatatcctgggtaagaatgtnaataagaggagaaggaagagtc

SEQ ID NO: 7816 - DNA, 400 bp, Homo sapiens
  misc_feature 2, 314: n = A,T,C or G
gnaaaagctggagctcgcgcgcctgcaggtcgacactagtggatccaaagaattcggcacgaggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggntggcatcaactaccagcctcccactgtggtgcctggggggagaccctggccaaggtacagagagctgtgtgcatgctgagcaacac

SEQ ID NO: 7817 - DNA, 400 bp, Homo sapiens
  misc_feature 6, 21, 28, 31, 36, 222, 325, 336, 350, 351, 389: n = A,T,C or G
gacccntatttgtgagtcganttaccanttnctggncgctagtggatccaaagaattcggcacgaggtttgtattcacttgacatttggaaatcaatcatgtactgcttcacatctttgatactgctattcaaattttcttactaatacatacattttctatttgttttataagtgccttctctgtaccaggtacagtgcttttgagttctagtgataaagngaaagtgatggatgaaatatgtttttgcgttaaaggtgctcatgtctagtttcagagtcagacatgtaagcagataataataaataataataataagagctgntatttattgancaccttaaggtggnncctgcgctagacccccttttatataaggaaatgctacnttataagtatc

SEQ ID NO: 7818 - DNA, 391 bp, Homo sapiens
  misc_feature 2, 330, 346: n = A,T,C or G
cnaaaaaagctggagctcgcgcgcctgcaggtcgacactagtggatccaaagaattcggcacgagttacctgatatcactaaagatgaactcttcaaaatgctctgtactaggaaggatccaaggcagattttctttggtcttgctccaggatgggtggtgaatatggccgataagaaaatcctaaaacctacagatgaaaatctccttaagtattatacctcatgaattcccgtccaaggaagcagagttgttaaagagtactggaataggggctgaaggatctatattcccttattgcattttccttatgtataattttccagatggngatgttacttttcagngtactcatatgtctcattttcatctaaaattaaatggcaggaaac

SEQ ID NO: 7819 - DNA, 400 bp, Homo sapiens
  misc_feature 13, 23: n = A,T,C or G
gacattttgctgnagctcgcgcncctgcaggtcgacactagtggatccaaagaattcggcacgagccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagaagcactggcgcgatccccagtcacccaggcctgcctcatgggaggacatc

SEQ ID NO: 7820 - DNA, 399 bp, Homo sapiens
  misc_feature 5, 44, 173: n = A,T,C or G
ctggngctcgcgcgcctgcaggtcgacactagtggatccaaagnaattcggcacgagatgagatgttctccgacatctacaagatccgggagatcgcggacgggttgtgcctggaggtggaggggaagatggtcagtaggacagaaggtaacattgatgactcgctcattggnggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcaca

SEQ ID NO: 7821 - DNA, 112 bp, Homo sapiens
  misc_feature 3, 7, 97: n = A,T,C or G
ganaatntagctggagcttcgcgcgcctgcaggtcgacactagtggatccaaagaattcggcacgaggttttgtacagacattatttccactctggnggataagttcaataa

SEQ ID NO: 7822 - DNA, 169 bp, Homo sapiens
  misc_feature 9: n = A,T,C or G
ttgctggangctcgcgcgccctgcaggtcgacactagtggatccaaagaattcggcacgagtacagtcttagctgacttttttttactctgaactcttatttgaattgttttttgtgcatatatttctgctaccacagagattgtactatacaaataaaaaaattaaaa

SEQ ID NO: 7823 - DNA, 400 bp, Homo sapiens
  misc_feature 16, 27, 28, 36, 40, 93, 275: n = A,T,C or G
gaacaataatactggnaggcctgtgcnncgcactgngggngggacacctagtggatccaaagaattcggcacgagaaaacggctcacattggngtggggatcagtgggcaggaagggatccaggctgtcttggcctccgattactccttctcccagttcaagttcctgcagccgcctcctgctggtgcatgggcgctggtcctacctgcgaatgtgcaagtttctttgctatttcttctacaaaaactttgctttcaccatggtccacttctggnttggcttcttctgtggcttctcagcccagaccgtctatgaccagtatttcatcaccctgtataacatcgtgtacacctccctgccagtcctggctatgggggtctttgatcaggatgtccccgag

SEQ ID NO: 7824 - DNA, 400 bp, Homo sapiens
  misc_feature 223, 224: n = A,T,C or G
gacaataagctggagcctcgcgcgcctgcaggtcgacactagtggatccaaagaattcggcacgagaaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaannattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaat

SEQ ID NO: 7825 - DNA, 400 bp, Homo sapiens
  misc_feature 2, 48, 218, 219, 221, 344, 378: n = A,T,C or G
anctggagctccgcgccgcctgcaggtccgacactagtggatccaaanaattcggcacgagggtgcctcctgcttttatagcagtttatggggagcacttgaaagagcgtgtgtacatgtattttttttctaggcaaacattgaatgcaaacgtgtatttttttaatataaatatataactgtccttttcatcccatgttgcccgctaagtgatattnnanatgtgtggttatactcataataatgggccttgtaagtcttttcaccattcatgaataataataaatatgtactgctggcatgtaatgcttagttttcttgtatttacttctttttttaaatgnaaggaccaaacttctaaactaattgttcttttgntgctttaatttttaaaaattac

SEQ ID NO: 7826 - DNA, 400 bp, Homo sapiens
  misc_feature 149, 223, 226: n = A,T,C or G
gacaatagctggagctcgcgcgccctgcaggtcgacactagtggatccaaagaattcggcacgagtagatatggtataaagtgagactccatagtgtccagaattcttttctttgtatttgtactgatattctctctctcttttccagngtatcaacttttagttatatattttgttcaaaaataacatctgatcatcataaacatcaattatttaaataggntancatgcttcttctgagtgctttaaagtaaacttgagtgtttataagtaagggaattattaagaagaaaccctggtatatccacaagataaatgttaccagtctctaagagtgcgtctcagtggttctcaaacttaaaagtatatcagaatcacctgtaggatttgttataatgca

SEQ ID NO: 7827 - DNA, 184 bp, Homo sapiens
  misc_feature 79, 180: n = A,T,C or G
gacctaagctggagctcgcgcgcctgcaggtcgacactagtggatccaaagaattcggcacgagaattttttttttgcncgtggatacccagttgttccaatatcatttattgaaaagtctatgcttttcctattctgtttttttgttaaccttgtataaaatcaattgactgtaaatgngcag

SEQ ID NO: 7828 - DNA, 399 bp, Homo sapiens
  misc_feature 306, 320, 354, 356, 383, 391: n = A,T,C or G
gacaaaagctggagctcgcgcgcctgcaggtcgacactagtggatccaaagaattcggcacgaggtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggnatgcaaatcttcgngaagaccctgaccgggaagaccatcactctggangnggagcccagtgacaccatcgaaaatgngaaggccnagatccaa

SEQ ID NO: 7829 - DNA, 248 bp, Homo sapiens
  misc_feature 225: n = A,T,C or G
gaaaataagctggagctcgcgcgcctgcaggtcgacactagtggatccaaagaattcggcacgaggacaggcgtgagcccaccgcgcccggcccagcattttatttattaactgtaacaataatcctctttccaaagataacatcactgttagtagtgtctggtatgtttttccagaaaaagaataggcatatactgcatatgaaaatacatatgcttaaatggntttttgcgcaaatcaatttagca

SEQ ID NO: 7830 - DNA, 400 bp, Homo sapiens
  misc_feature 3, 291, 375: n = A,T,C or G
ganaataagctggagctcgcgcgcctgcggtcgacactagtggatccaaagaattcggcacgagagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgnagctcagtaattcctgttactttacagacaggaaagttccagaaactttaagaacaaactctgaaagacctatgagcaaatggngctgaatactttttttttaaagcca

SEQ ID NO: 7831 - DNA, 273 bp, Homo sapiens
  misc_feature 194, 216, 260: n = A,T,C or G
gctggagctcgcgcgccctgcaggtcgacactagtggatccaaagaattcggcacgagctcgtgccgaattcggcacgagtgaaggaggaggcccttgattaggtcagtggtccctgggagccatcggcgagaggcctccagccgggtgacagtctgggctctcgggtactaatctttctaatatggcagtggntggggcacttctgacttgaatngataattctcatatctaataaaaccaagaagtacctcgttgatntcttatagaaaac

SEQ ID NO: 7832 - DNA, 400 bp, Homo sapiens
  misc_feature 5, 222, 223, 224, 225: n = A,T,C or G
gaaantttgctggagctcgcgcgcctgcaggtcgacactagtggatccaaagaattcggcacgagctatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggnnnntggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaa

SEQ ID NO: 7833 - DNA, 385 bp, Homo sapiens
  misc_feature 4, 5, 50, 146, 224, 225: n = A,T,C or G
ttannctggggctccgcgcgcctgcaggtcgacactagtggatccaaagnaattcggcacgaggttcaccacctctatccacccttcattcgcagcgacaccactttccctggaggccagtgaatgttgtttttctctctgtcagnggggtaattcaaccaagcgagagagaagtaggagaagaaaactgtgtgtgtgtgcatgtgtgtgtgtggcgggggggnngggcggtgtttatcaaaacgcaacagtaatttgaactattcagttctggtacaacatagaagcagtgtagtgacctctcgaggctcctttcaggattttggatgtaagaaaggagaattttgatttcaaaaaatggctttgaggtatctattcaaatcta

SEQ ID NO: 7834 - DNA, 362 bp, Homo sapiens
  misc_feature 22, 75, 78, 223, 224: n = A,T,C or G
gacattagctggagctcgcgcncctgcaggtcgacactagtggatccaaagaattcggcacgagctcgtgccganttnggcacgagtcaagatatggaataacagaaactcatatactccttggaaggctaaattgatagaatcatcttggggaaagtttgttattacctatcagcgtatggatccaatactctaagaagacctcataattttacacctaggnnaatattaatattttacaaacttcacatatgtccataaagaaacacaagtaaaaatacttatagcaaaaaactggaaataactaggtccactgataggaaaaataataaaaatggaatgacagtcctgttagaaaataa

SEQ ID NO: 7835 - DNA, 225 bp, Homo sapiens
  misc_feature 26: n = A,T,C or G
gaaaaagctggagctcgcgcgcctgnaggtcgacactagtggatccaaagaattcggcacgagcgcaaagtgggtctcattgctgcccgccggactggacgtctccggggaaccaagactgtgcaggagaaagagaactagtgctgagggcctcaataaagtttgtgtttatgccaaaaaaaaaaaaaaaaaaaaaaaaaaaaaaaaaaaaaaaaaaaaaaaaaa

SEQ ID NO: 7836 - DNA, 400 bp, Homo sapiens
gacaataagctggagctcgcgcgcctgcaggtcgacactagtggatccaaagaattcggcacgaggaaatagacctaattttcctcaagggaattatggagaatcctattgtaaaatcacttgctaaggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtat

SEQ ID NO: 7837 - DNA, 396 bp, Homo sapiens
  misc_feature 194, 199, 297: n = A,T,C or G
tgggacgctagtggatccaaagaattcggcacgagaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccagggngcggnattggtactggtccaggagttatccaggatagattttcacccaccatgggacgtcatcgttcaaatcaactcttcaatggccatgggggacacatcantgcctcccacacaatcgcagtttggagagatgggaggcaagtttatgaaaagccaggggctaagccagctctaccataaccagagtcagggactcttat

SEQ ID NO: 7838 - DNA, 400 bp, Homo sapiens
  misc_feature 3, 28, 223, 224: n = A,T,C or G
ganaataagctggagctcgcgcgcctgnaggtcgacactagtggatccaaagaattcggcacgagattcagcttcagtctttacataccatgaataaaacattaaaacatcatatggagaagtttacatggtgattgttcacctgcagtactgtggagttttaacattttgtcctcttttcagtgaaacagagtaaaaatattcatctaccattactgttatnngctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtgg

SEQ ID NO: 7839 - DNA, 400 bp, Homo sapiens
gacaatttgctggagctcgcgcgcctgcaggtcgacactagtggatccaaagaattcggcacgagtgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctgtaaagaaggaaaattcagccagttgattttgtttttagcttactgctgcctttgtccgaagaaaccgttcctccattatttgaatta

SEQ ID NO: 7840 - DNA, 304 bp, Homo sapiens
  misc_feature 6, 303: n = A,T,C or G
aacaanaagctggagctcgcgcgcctgcaggtcgacactagtggatccaaagaattcggcacgaggcgggtatgggatcctatgtgccccccaggcggctggcagtgcccacggaagtgtccactgaggtccctgagatggatacctctacctgacatggcctgaagatgcagggcagaggaattgcccatggacagtgacgcaaggactaggctgggagggagcgtgccaaccccttttgcctctgggtttggggagcggagggcctcttcttggtgccctgcccccaataaaggaactggnc

SEQ ID NO: 7841 - DNA, 400 bp, Homo sapiens
  misc_feature 2, 4, 195: n = A,T,C or G
gngngacactagtggatccaaagaattcggcacgaggtttgatgtattttgctcatgactgcagtatgcatgtatttttttccttctctgtgttttctaaacttacactaaaggattcatcaaatcatcttgttcagatggctcaggattgtatttattttgcttaccccgtgctcttgggttctatagtatttntataattatgtaacgagaatagtgttgcactgtaatctatcatatagagctatatgtatggaaaattttgatcaattttttaagaaatgtatcctgtttgcaaaggcacagtaaagttgcatcttatagactataggcaataaagctaacaataaaccttatttaacacaaaccacatccatatcctctgttcatttgattttgg

SEQ ID NO: 7842 - DNA, 382 bp, Homo sapiens
  misc_feature 19, 24, 32, 36, 75, 79, 83, 123, 139, 143, 183, 212, 228,247, 268, 360: n = A,T,C or G
gaacaataatgcgtggagnctcgngcgcctgnaggncgacatctagtggatccaaagaattcggcacgagtcttnttcnaggnccggttcatttggcggactgtgacgccacgtgacaagccnatggggcccctgctgntggncactttctggcctgagctcccggaaaagattgatgcggtntacgaggccccacaggaggagaaggctgngttctttgcagggaangaatactggatctactcanccagcaccctggagcgagggnaccccaagccactgaccagcctgggactgccccctgatgtccagcgagtggatgccgcctttaactggagcaaaaacaagaagacatacatntttgctggagacaaattctgga

SEQ ID NO: 7843 - DNA, 357 bp, Homo sapiens
  misc_feature 8, 148, 225, 226, 229, 230, 342: n = A,T,C or G
gaacaatnttgctggagctcgcgcgcctgcaggtcgacactagtggatccaaagaattcggcacgagcaaaaaagcacctggtactaagggtactgctgctgctgctgctgctgctgctgctgctgctgctgctgctgctgctaaagntccagcaaaaaagatcaccgccgcgagtaaaaaggctccagcccagaaggttcctgcccagaaagccacaggccagnnagnngcgcctgctccaaaagctcagaagggtcaaaaagctccagcccagaaagcacctgctccaaaggcatctggcaagaaagcataagtggcaatcataaaaaagtaataaaggnttcttttttgacctg

SEQ ID NO: 7844 - DNA, 400 bp, Homo sapiens
  misc_feature 15, 227, 228: n = A,T,C or G
gaacaataatgctgnagctcgcgcgcctgcaggtcgacactagtggatccaaagaattcggcacgaggcgctgcccactggattggtcccagtggactgaaaggtggtgctctcgagtcaggcgcttagtcccagagagagctgggtgccgcggggcctcgtggtctgtgcctactcagggaaatgacttaggttctcccaggtgctctgttgataaggatggaagnngaactactttgagacacaagcaacaattggaagagtttttttatatgaactgaaatagatctaagagagcctggttaacagtttcctttaataccagttcagattaaatggttactttaggaacctgtgttactgtgtgagcacccacagaaacaagcaaacttatttccta

SEQ ID NO: 7845 - DNA, 400 bp, Homo sapiens
  misc_feature 6, 396: n = A,T,C or G
gaaaantgctggagctcgcgcgcctgcaggtcgacactagtggatccaaagaattcggcacgaggcgatctcctctcccctccaatcctatccgtgatggacgatgcccacgagtcgccctccgacaaaggtggagagacaggggagtcggatgagacggccgctgtgcccggggacccgggggctaccgacaccgatggaatcccagaggaaactgacggagacgcagatgtggactttgaaagcagctgcagcggaggaaggcgagctcgagagtcaggatgtctcagatttaacaacagttgaaagggaagactcatcattacttaatcctgcagccaaaaaactgaaaatagataccaaagaaaaaaaaaagaaaaaactcgagagtacttntaga

SEQ ID NO: 7846 - DNA, 289 bp, Homo sapiens
  misc_feature 78, 154, 158: n = A,T,C or G
gaacaaaagctggagctcgcgcgcctgcaggtcgacactagtggatccaaagaattcggcacgagtctgccacctgcntccttcagacagttatatcctccttttaaaccattgttgttgagtgtaagatgtccttcatgttttcttataaagncagngtttagaaatgttaccctttctaagttatatacagatcaaatgcttttttctttcacgtacatccatcatttgcaactgctgttcgtacacagaaacaggactgctcaaatgatcctatttgtattttctg

SEQ ID NO: 7847 - DNA, 400 bp, Homo sapiens
  misc_feature 8, 223, 225: n = A,T,C or G
gacaatangctggagctcgcgcgcctgcaggtcgacactagtggatccaaagaattcggcacgaggtttgatgtattttgctcatgactgcagtatgcatgtatttttttccttctctgtgttttctaaacttacactaaaggattcatcaaatcatcttgttcagatggctcaggattgtatttattttgcttaccccgtgctcttgggttctatagtattncnataattatgtaacgagaatagtgttgcactgtaatctatcatatagagctatatgtatggaaaattttgatcaattttttaagaaatgtatcctgtttgcaaaggcacagtaaagttgcatcttatagactataggcaataaagctaacaataaaccttatttaacacaaaccac

SEQ ID NO: 7848 - DNA, 397 bp, Homo sapiens
  misc_feature 77, 127, 212, 329, 379: n = A,T,C or G
gaacaataagctggagctcgcgcgccctgcaggtcgacactagtggatccaaagaattcggcacgagcaggggtggnagggaattcctggagtgcctggacccccgggacctcctgggcttcccggnttctgtgagccagcctcctgcaccatgcaggctggtcagcgagcatttaacaaagggcctgacccttgaaaggcttactgctgcntggctgtctgcatgaaccacgcctggtgaaggagccttgggtgagaaacaccatccaaagctggggcaaagatgattaccttcagcatgattacaatgtattaccttcagtatgatnacagaagtcctacttgacaatcacatattagaagaacggggctattcagnaaagttctctttcctttt

SEQ ID NO: 7849 - DNA, 152 bp, Homo sapiens
  misc_feature 7, 22, 27, 29, 30: n = A,T,C or G
gaccttntgctgagctcgtgcncctgngnncgcacttgtggatccaaagaattcggacgaggccgagccagcgcctgggcctggaaccgggccgtagcccccccagtttcgcccaccacctccctaccatgggacccccggcaaaagtgaac

SEQ ID NO: 7850 - DNA, 399 bp, Homo sapiens
  misc_feature 216, 217, 218: n = A,T,C or G
ctggagctcgcgcgcctgcaggtcgacactagtggatccaaagaattcggcacgagaaggacctgtatgccaacaatgtcttatctggaggcaccactatgtaccctggtattgctgatcgtatgcagaaggaaatcactgctctggctcctagcaccatgaagattaagattattgctccccctgagcgtaaatactctgtctggattggggggnnnatcctggcctctctgtccaccttccagcaaatgtggattagcaagcaagagtacgatgaggcaggcccatccattgtccaccgcaaatgcttctaagatgccttctctctccatctaccttccagtcaggatgacggtattatgcttcttggagtcttccaaaccaccttccctcatcttt

SEQ ID NO: 7851 - DNA, 400 bp, Homo sapiens
  misc_feature 6, 7, 120: n = A,T,C or G
gaaaanntgctggagctcgcgcgcctgcaggtcgacactagtggatccaaagaattcggcacgaggaacgcggagagcacgccatgaaggcctcgggcacgctacgagagtacaaggtangtgggtcgctgcctgcccacccccaaatgccacacgccgcccctctaccgcatgcgaatctttgcgcctaatcatgtcgtcgccaagtcccgcttctggtactttgggtctcagttaaagaagatgaagaagtcttcaggggagattgtctactgtgggcaggtgtttgagaagtcccccctgcgggtgaagaactttcgggatctggctgcgctatgactcccgggagcggcaccccacaacatgtaccgggaataccgggacctgaccaccgcaggcg

SEQ ID NO: 7852 - DNA, 141 bp, Homo sapiens
  misc_feature 75, 118: n = A,T,C or G
gaaaaagctggagctcgcgcgcctgcggtcgacactagtggatccaaagaattcggcacgagtgagcgccccgcntcgttcggctgcccccgccccttcccggcccccctcgccgcgngtcctccaaaaaataaaacctta

SEQ ID NO: 7853 - DNA, 400 bp, Homo sapiens
  misc_feature 10: n = A,T,C or G
gaacaatatngctggagctcgcgcgcctgcaggtcgacactagtggatccaaagaattcggcacgagggacaccgggtgtagagggcggtcgcggcgggcagtggccggcagaatgttgactaccagggtatttagcctagttggcaagcgagcaatttccacctctgtgtgtgtaccgagctcatgaaagtgttgtgaagagcgaagacttttcgctcccagcttatgtggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagcttttgctgagatgaacagg

SEQ ID NO: 7854 - DNA, 400 bp, Homo sapiens
  misc_feature 28, 34, 38, 230: n = A,T,C or G
gaacacataatgctggagcctcgtgccnccctgnaggngcgacactagtggatccaaagaattcggcacgaggaaaacttagcacttacctgcccctcccaccccaatgcttccaatctatccccatttctgttaaatcagttttcattgcttacattttcaacactgagcccaatatactgctaggctagtcccatttgctgtctcacgtaagttttttatacttggtnggaattaaaactgactgttccctttgcctcattttctatatagctatcccaaattcatcttgtcccacctaatgggacagcaaaatgcctctcaatgctgttttccacacaaacacatcaggtaatggactggttcgggcagtgtacctcgtgccacctcctactggctg

SEQ ID NO: 7855 - DNA, 220 bp, Homo sapiens
  misc_feature 6, 202: n = A,T,C or G
gaaaangctggagctcgcgcgcctgcaggtcgacactagtggatccaaagaattcggcacgagcatcagacaagagatcattaaaatgtttgatgagagaatggcttactacacctccaggatgcagttccccatggagatggcggcagctccgggacgaccagggcctccagggaaggatggtgctccgggcaggccaggngctccagggtcacctggg

SEQ ID NO: 7856 - DNA, 400 bp, Homo sapiens
  misc_feature 7, 222, 226: n = A,T,C or G
gacaatnagctggagctcgcgcgcctgcaggtcgacactagtggatccaaagaattcggcacgaggctgactctgttagaactctgtccaaaaagtgcatggaatataatttgtaaagcttcccacaattgacaatatatgtgcatgtgtttaaaccaaatccagaaagcttaaacaatagagctgcataatattagtatttattaaagaatcacaattgtnaacntgagaataacttaaggattctagtttagttttttgtaattgcaaattatatttttgctgctgatatattagaataatttttaaatgtcatcttgaaatagaaatatgtattttaagcactcatgcaaaggtaaatgaacactttttaaatgtgtgtgttgcttattttttacat

SEQ ID NO: 7857 - DNA, 193 bp, Homo sapiens
  misc_feature 33, 71, 107, 112, 134, 143: n = A,T,C or G
gaacaatttgctggagctcgcgcgcctgcaggncgacactagtggatccaaagaattcggcacgaggaggnatcaagtgactgatctggaataaatatctcgcagcnctgcngctaacatcacagaacttaagngtgttttgngtgtgtgcccacacgtagacaaatgtgtaccggtgcacacacacagtgca

SEQ ID NO: 7858 - DNA, 104 bp, Homo sapiens
  misc_feature 3, 84, 94: n = A,T,C or G
ganaataagctggagctcgcgcgcctgcaggtcgacactagtggatccaaagaattcggcacgagttttttttttttaattctngggaactatnaagtctttgc

SEQ ID NO: 7859 - DNA, 400 bp, Homo sapiens
  misc_feature 2, 6, 193: n = A,T,C or G
gngacnctagtggatccaaagaattcggcacgaggtttcactgggagaagagtttcccttccttaaggaatatatacttttcagcttgaaaaggggaaataagaggtgattgtgataaatagagtcctccctggaatgctccctcagctcagaatttcacattctgtcctgggataggtcaatctggctttcnggcatctattctcctggctcttgggaggttgggttcattttaaggatgaatctgaaggccaccttgatgggaacttcaggtaaaatcctcagatctctcacaaggtggatccagcacttttaaccagctctagggaaacccagtctcaggtttctatggagggtggaggaaatgacatcttttatagaagtttgctccagattacat

SEQ ID NO: 7860 - DNA, 400 bp, Homo sapiens
  misc_feature 361: n = A,T,C or G
gacaaaagctggagctcgcgcgcctgcaggtcgacactagtggatccaaagaattcggcacgaggcgaaacttgtcattctagatgttctgttgccagtatcaaaaccggcttccaggctgtcacgggcaagcgagcacagctccgtgccaaagctaactaatttgctaatcactgattttgcaaagcttgttgtgggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcanagaaacgtgatatggggtaaagggaggtgcttttttaaa

SEQ ID NO: 7861 - DNA, 400 bp, Homo sapiens
gacaataagctggagctcgcgcgcctgcaggtcgacactagtggatccaaagaattcggcacgagaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtgggggaagaacggtctcagaactgtttgtttcaatt

SEQ ID NO: 7862 - DNA, 378 bp, Homo sapiens
  misc_feature 3, 224: n = A,T,C or G
gancaataagctggagctcgcgcgcctgcaggtcgacactagtggatccaaagaattcggcacgagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgnggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaact

SEQ ID NO: 7863 - DNA, 249 bp, Homo sapiens
  misc_feature 7, 8, 199: n = A,T,C or G
gaaaatnngctggagctcgcgcgcctgcaggtcgacactagtggatccaaagaattcggcacgagtgacacccacaccctcgagctagcagcgtctcctcccttccccgggagagctggctggagacttggagctccgggaagtaggagtcacatttttttctctattctttggggattttttttacatgaataaaagnggatttcagggaaaaaaaaaaaaggggggaaaaaaaaaaaaaaaaaaaaa

SEQ ID NO: 7864 - DNA, 305 bp, Homo sapiens
  misc_feature 2, 3, 164, 173, 176, 219, 221, 222, 225: n = A,T,C or G
annagctggagctcgcgcgcctgcaggtcgacactagtggatccaaagaattcggcacgaggagaatcgcttgaacctgggaggcagatgtttcagtgaactgagatcgtgccactgcactcctgcctggcgacagagcaagactctgtttaaaaaaaaaagcncgggggggnggngcacattctgtaattccagctacttgggaggctgaggcaaggnanntcncttgaacccaggaggcagagtttgcagtaggctgggatcgcaccactgtactccaggttgggtgagcaagactgtcttaa

SEQ ID NO: 7865 - DNA, 351 bp, Homo sapiens
  misc_feature 10, 225, 314, 327: n = A,T,C or G
gaacaatttngctggagctcgcgcgcctgcaggtcgacactagtggatccaaagaattcggcacgaggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccactntgaggcgaggctccaagagtgtggcccgccgggtcctccaagccctggaggggctgaaaatggtggaaaaggaccaagatggcggccgnaaactgacacctnagggacaaaagagatctggacaga

SEQ ID NO: 7866 - DNA, 400 bp, Homo sapiens
  misc_feature 3, 8: n = A,T,C or G
ttnctggncgctagtggatccaaagaattcggcacgagctctctaccaattagcccaggataaatgccatcagaaaaggtatggctttcaagatctagtcattgataaaaagaaatataacttttggaagcccttttgtataaagaaaaagcactcaacttgaagttaaaaggcataggtatgagtcttgactctaccccctgacataggatcaatcatttaacttctctgaggctctgcatctttatctgaaaagccaaggaagaagagggttgttaaaatccaccgaagatcagattctataaacaaaaactctttgttaaattaaccatgacacaaattattctattgtcttccccgaatcccacaaccccctccaacatttaaaattcatctttag

SEQ ID NO: 7867 - DNA, 265 bp, Homo sapiens
  misc_feature 28: n = A,T,C or G
gacaaaaagctggagctcgcgcgcctgnaggtccgacactagtggatccaaagaattcggcacgagctgatgtgtgccttttgttcaacacagtaacccctgcattctgctctgctctaatacactacctggagaaagtcttttccttattttcaataaatgtcagacattattgaaaaaaaaaaaaaaaaaaaaaaaaaaaaaaaaaaaaaaaaaaaaaaaaaaaagaaaaaaaaaaaaaaaaaaaaaaaaaaaaaaaaaaaaa

SEQ ID NO: 7868 - DNA, 400 bp, Homo sapiens
gacaataagctggagctcgcgcgcctgcaggtcgacactagtggatccaaagaattcggcacgaggttgcagacatgggcctactaaactagaaagagcatttgaagagcaaaaggcaaaggttccatcaccatcctgtggaaatacgtgagttgttcatttcagtacacccatagtttctcaacaggtgtagcagatttgtttctaaaggacataggagtgcattttttatatgaaaccagaactggagtggtaatggcacttctgattcaattaacttacttggtgaagctgccagggaaactaaatatgatgaggaagaagaggaatgactggatcaaattaatagaaatagatctttttgcaagcaacataatgattctgatcatcaaccttgaaa

SEQ ID NO: 7869 - DNA, 374 bp, Homo sapiens
  misc_feature 345, 349, 352, 355: n = A,T,C or G
aggacaaaagctggagctcgcgcgcctgcaggtcgacactagtggatccaaagaattcggcacgagatactttcttggttttctaatggagtatatagtttagtcatttcacagactctggcctcctctcctgaaatccttttggatggggaaagggaaggtggggagggtcccgaggggaaggggaccccagcttccctgtgcccgctcaccccactccaccagtccccggtcgccagccggagtctcctctctaccgccactgtcacaccgtagcccacatggatagcacagttgtcagacaagattccttcagattccgagttgcctaccggttgttttcgntggntgntgntggttgtttttctttttct

SEQ ID NO: 7870 - DNA, 400 bp, Homo sapiens
gacaataagctggagctcgcgcgcctgcaggtcgacactagtggatccaaagaattcggcacgagaggtttttcagctacctctgggtcattctgtaatgtaaatgttgttaataagaatggtttttacataaattatgcaaaggttaacaagcagtaacactgcactcctcaaaaagtggcggtatgtaatgaaaggcccttttgatatccttgatttttcattgtgtatctgtttgggcacggtctatgtaacactagttctgcgtattagtattttagagtatctctgcctcccttgtcctgttgtttcttttgcccccttggaacacattggtcagcagttctaagagacactgcccacatgatggccattccctacttcatccttgctgagctaa

SEQ ID NO: 7871 - DNA, 100 bp, Homo sapiens
  misc_feature 7, 68, 71, 76, 80, 81, 86, 94: n = A,T,C or G
gaaaatnagctggagctcgcgcgcctgcaggtcgacactagtggatccaaagaattcggcacgagcgncgntgcanggcnntttcnctatggcntatgca

SEQ ID NO: 7872 - DNA, 400 bp, Homo sapiens
  misc_feature 211: n = A,T,C or G
gacaaaagctggagctcgcgcgcctgcaggtcgacactagtggatccaaagaattcggcacgagaaatgtgactcttctttcatgtagtataattttgtgattcattcatgttgttatctgtattaatacttcgtacatttcccattgtatggatataccacaatttacatatccattcatctgttgatgaacatgtgggctatttccagnggggctgttacagataaaggtgctttgaacattagtgtacaattctttgtatgaacatatgcttcagtttcccttgggtttattctgtttcacctaggagaggagtggctggatcatatggtaggtctatgcttaatattcaagaaactgacaaactgtttccaaagccaatgtgacatttacatttac

SEQ ID NO: 7873 - DNA, 400 bp, Homo sapiens
  misc_feature 226: n = A,T,C or G
gaaaatttgctggagctcgcgcgcctgcaggtcgacactagtggatccaaagaattcggcacgagcagaagcgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataacttggagngccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatg

SEQ ID NO: 7874 - DNA, 400 bp, Homo sapiens
  misc_feature 8, 76, 139, 225, 294, 327, 339, 348, 369: n = A,T,C or G
gaacaatnagctggagctcgcgcgcctgcaggtcgacactagtggatccaaagaattcggcacgagccgccgcggnggcggttgctatcgcttcgcagaacctactcaggcagccagctgagaagagttgagggaaagngctgctgctgggtctgcagacgcgatggataacgtgcagccgaaaataaaacatcgccccttctgcttcagtgtgaaaggccacgngaagatgctgcggctggatattatcaactcactgggaacaacagtattcatgctcatcgtatctgggtnggcactgataccagaaaccacaacattgacagntgggggaggggngtttgcacnttgtgacagcagtatgctgtnttgcccgacgggggccctttatttaccggga

SEQ ID NO: 7875 - DNA, 129 bp, Homo sapiens
  misc_feature 7: n = A,T,C or G
gacaatnagctggagctcgcgcgcctgcaggtcgacactagtggatccaaagaattcggcacgaggatttggcacgtcagggtactaagcatgggtgggaactcctgccttataaaaattgtttttgtg

SEQ ID NO: 7876 - DNA, 228 bp, Homo sapiens
gacaataagctggagctcgcgcgcctgcaggtcgacactagtggatccaaagaattcggcacgagatttaattggcatgattttttcatggatgtgtgcttcatttgatctattgtatgtagctcgtgatcacattttctgttggttaacattgttcctagcttatatgatggaattaaatatattctgtgtgaaaaaaaaaaaaaaaaaaaaaaaaaaggggggggg

SEQ ID NO: 7877 - DNA, 190 bp, Homo sapiens
  misc_feature 6, 27, 34, 131, 164: n = A,T,C or G
gaacantttgtctggagctcgcgcgcntgcaggncgacactagtggatccaaagaattcggcacgagctcgtgccgaattcggcacgagataaatacagattccaagctatttagagccttttctacattngggtataattttataactatacagaaatgggcngttttgtttaaatatgtaggacagac

SEQ ID NO: 7878 - DNA, 400 bp, Homo sapiens
  misc_feature 8, 72, 73, 83, 224, 366: n = A,T,C or G
gaacaatnagctggagctcgcgcgcctgcaggtcgacactagtggatccaaagaattcggcacgagacgagnntcaccggagnctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctncatcccaacctggctccctcccacccaaccaactttccccccaacccggaaacagacaagcaacccaaactgaaccccctcaaaagccaaaaaatgggagacaatttcacatggactttggaaaatatttttttcctttgcnttcatctctcaaacttagtttttatctttgacca

SEQ ID NO: 7879 - DNA, 400 bp, Homo sapiens
  misc_feature 2, 7, 91, 126, 202, 204, 222, 226, 254, 262, 312, 318, 352,359, 387, 397: n = A,T,C or G
cntgagntcgacactagtggatccaaagaattcggcacgagcggcacgaggcggtagctgggaccgccgttcagtcgccaatatgcagctntttgtccgcgcccaggagctacacaccttcgaggngaccggccaggaaacggtcgcccagatcaaggctcatgtagcctcactggagggcattgccccggaagatcaagtngngctccttggcaggcgccncccntggaggatgaggccacttctgggccagngcgggggnggaggcccctgactaccctggaagtagcaaggcccgcatgctttggaggnaaaagnccatggtttccctggccccgggcttggaaaaagngaaaggncaaacctcctaagggggccaaacagganaaaaaaaaanaaa

SEQ ID NO: 7880 - DNA, 158 bp, Homo sapiens
  misc_feature 6, 7: n = A,T,C or G
gacaannagctggagctcgcgcgcctgcaggtcgacactagtggatccaaagaattcggcacgagaaaaacatgtcatgtaggttgtctaaaaataaaatgcctttaaactcaaaaaaaaaaaaaaaaaaaaaaaaaaaaaaaaaaaaaaaaaaaaaa

SEQ ID NO: 7881 - DNA, 165 bp, Homo sapiens
  misc_feature 7: n = A,T,C or G
gacaatnagctggagctcgcgcgcctgcggtcgacactagtggatccaaagaattcggcacgagctcgtgccgcatacgtgttcagtgtgaatagtgtttaagttgaaaatattgtaaaaaaattatattttttcaaaaatatttaaaaaaataaataatagtag

SEQ ID NO: 7882 - DNA, 167 bp, Homo sapiens
gacaataagctggagctcgcgcgcctgcaggtcgacactagtggatccaaagaattcggcacgagggaatgagcaaataggcaagtgtttccaaactacttggaggtttacaaaaaatatgtcccagaaaaaaaaaaaatcttaccaagatacgtaaagaaaaaaaa

SEQ ID NO: 7883 - DNA, 400 bp, Homo sapiens
  misc_feature 100: n = A,T,C or G
gaaaataagctggagctcgcgcgcctgcaggtcgacactagtggatccaaagaattcggcacgagcgcagcccagcctcgaaatgcagaacgacgccggngagttcgtggacctgtacgtgccgcggaaatgctccgttagcaatcgcatcatcggtgccaaggaccacgcatccatccagatgaacgtggccgaggttgacaaggtcacaggcaggtttaatggccagtttaaaacttatgctatctgcggggccattcgtaggatggggtgagtcagatgattccattctccgattggccaaggccgatggcatcgtctcaaagaacttttgactggagagaatcacagatgtggaattatttgtcataaataaataaatgaaaacctaaaaaaaaaa

SEQ ID NO: 7884 - DNA, 400 bp, Homo sapiens
  misc_feature 66, 225, 383: n = A,T,C or G
gacaaaagctggagctcgcgcgcctgcaggtcgacactagtggatccaaagaattcggcacgaggngacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgntgaacttgttgctgagggcaacagcaggttcacttacactgttcttgtagatggctgctctaaaaagacaaatgaatgggggaaagacaatcattgaatacaaaacaaataagccatcacgcctgcccttccttgatattgcacctttggacatcggnggtgctgaccaggaatt

SEQ ID NO: 7885 - DNA, 400 bp, Homo sapiens
gaaaataagctggagctcgcgcgcctgaggtcgacactagtggatccaaagaattcggcacgagagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgagacagcccgctccgtgccagacatggacctatctgggtccttctatgcagcagactgggagcctctgcacagtggctccctgggggatggggcccatggccacagagctggagcccctgtgca

SEQ ID NO: 7886 - DNA, 400 bp, Homo sapiens
  misc_feature 67, 136, 222: n = A,T,C or G
gaaaaagctggagctcgcgcgcctgcaggtcgacactagtggatccaaagaattcggcacgagcggnacgaggaacagctctttggacactaggaaaaaaccttgtagagagagtaaaaaatttaacacccatagnaggcctaaaagcagccaccaattaagaaagcgttcaagctcaacacccactacctaaaaaatcccaaacatataactgaactcctnacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacag

SEQ ID NO: 7887 - DNA, 400 bp, Homo sapiens
gacaaaagctggagctcgcgcgcctgcggtcgacactagtggatccaaagaattcggcacgagaggttacattgttgtcctctttccagtgtcgcatctgtcattggtttttcactatggcaagttcattaaaaagcttgctccattgttatcttcaagtaatgcccataaggagatggaagatatctgagacaattaaggctttagcttctaggcaagagaaataacgttgcattaaatttcaagtttctttctgctagacttgaatgtgtctagccactctaatttatgggggcttttggttttttcctattgtactttgtatgtagaattgttttgaaatatcaagcatatttactttgaatttgaactctttcttaattttgtatttatcctttga

SEQ ID NO: 7888 - DNA, 398 bp, Homo sapiens
  misc_feature 285: n = A,T,C or G
gacaataagctggagctcgcgcgcctgcaggtcgacactagtggatccaaagattcggcacgaggccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgngaaagtgtataactacaatcacctaatgcccacaaggtactctgtggatatccccttggacaaaactgtcgtcaataaggatgtcttcagagatcctgctcttaaacgcaagg

SEQ ID NO: 7889 - DNA, 400 bp, Homo sapiens
  misc_feature 27, 32, 34: n = A,T,C or G
gaaccataatgctgaaggctcgtgccncctgngngcgacactagtggatccaaagaattcggcacgagggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagtt

SEQ ID NO: 7890 - DNA, 397 bp, Homo sapiens
  misc_feature 3, 5, 205, 243, 254, 298, 312, 335, 342: n = A,T,C or G
tgngngcgacactagtggatccaaagaattcggcacgagattctgcaattatttttgagactcccctccgagtggacgttgcagtgctgaaagcgcgagcgaagctgctgcagaaatacctgtgtgacgagcagaaggagctacaggcgctctacgccctccaggccctttgtagtgaccttagaacagcctcccaacctgctgnggatgttctttgacgcacttgtatgacgaggacgtggngaaggaggatnccttctacagttgggagagtaacaaggaccccgctgagcagcangggcaagggtgtgncccttaaatctgtcacagccttnttcaagnggctccgggaagcagaggaggagtctgaccacaactgagggctgggggggccggg

SEQ ID NO: 7891 - DNA, 400 bp, Homo sapiens
  misc_feature 136, 162: n = A,T,C or G
gaaaataagctggagctcgcgcgcctgcaggtcgacactagtggatccaaagaattcggcacgagctcgtgccgaattcggcacgagcatcgatgggcggcggaaaatagcctttgccatcactgccattaagggngtgggccgaagatatgctcatgtggngttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctg

SEQ ID NO: 7892 - DNA, 400 bp, Homo sapiens
gacaataagctggagctcgcgcgcctgcaggtcgacactagtggatccaaagaattcggcacgaggtaaaattaggtatgcatttgtttccattccttctgtatgttttagaaaatctatatgcatctaaaaccttgagcgtacgtaaaatattaccattcatatgttagaacaatcctgtctataatatcttaaataccaaattcttgtcttagatagcaaatttattattccctaaaatactagactattagattcaggcatagtaccattttctagccatggggaaataagataaagagacaatggccatggtacatgcctctctggggtgtcacctcaagacacagagatccagtattccttgcaatagaggagctttgggtatttcactaatctt

SEQ ID NO: 7893 - DNA, 166 bp, Homo sapiens
  misc_feature 3, 20, 90, 91: n = A,T,C or G
tgntgaagctgtgttgcctntagctgggacactagtggatccaaagaattcggcacgagaggaagacccaggaaaggtgtgagctggaannccttgaacctacctcatcctcctggagggtgtggctaccctcgccaccccaaattccatgtcaataaagaacagc

SEQ ID NO: 7894 - DNA, 131 bp, Homo sapiens
  misc_feature 3, 11, 85, 93, 101, 102, 119, 124: n = A,T,C or G
ccntgaaggtngacactagtggatttaaacattcggcacgagcggcacgaggaggagggggaggtgagctgatggcctggttgcntggggggngatggttnngctccccctaccttttnttttngagttta

SEQ ID NO: 7895 - DNA, 349 bp, Homo sapiens
  misc_feature 16, 203, 257, 325: n = A,T,C or G
tgctggagctcgcgcnccctgcagggtccgacactagtggattcaaagaattcggcacgaggataatttatataactagaataatttttttcctttcttttatggacctaaatctgccaattgggaattttgtgcctgaaatatgaagttactttttatagataatcagtgcttttaagtccctaaaaggctcctgctgaagnaatgatgatgttaataataaaagcctttgaaaggctgaaaacctacatagtggnaccatagtatttggagcttctataggagtggagaggggcagctcattgttgagagttgcatgctgcancctaatggtcagcaatgaaataaa

SEQ ID NO: 7896 - DNA, 400 bp, Homo sapiens
  misc_feature 42, 43, 160, 215, 217, 221, 273, 318, 338, 348, 371: n = A,T,C or G
tgctggagctcgcgcgccctgcaggtcgacactagtggattnnaagaattcggcacgaggccacatatgcccctgtcatctctgctgagaaagcctaccatgaacagctttctgtagcagagatcaccaatgcttgctttgagccagccaaccagatggngaaatgtgaccctcgccatggtaaatacatggcttgctgcctgttgtaccgtggngncggnggttcccaaagatgtcaatgctgccattgccaccatcaaaaccaagcgcagnatccagtttgtggattggtgccccactggcttcaaggttggcatnaactaccagcctcccactgnggggcctggnggagacctggccaaggtacaganagctgtgtgcatgcttgagcaacaccaca

SEQ ID NO: 7897 - DNA, 188 bp, Homo sapiens
  misc_feature 3, 28, 34, 69, 76, 78, 79, 80, 130, 185: n = A,T,C or G
cgnacttttgctggagctcgcgcccctncgggtncgacactagtggatttcaaagaattcggcacgagnatgagangnnntccgacatctacaagatccgggagatcgcggacgggttgtgcctggaggnggaggggaagatggtcagtaggacagaaggtaacattgatgactcgctcattggngga

SEQ ID NO: 7898 - DNA, 178 bp, Homo sapiens
  misc_feature 11, 27, 60, 68, 69, 70, 71, 103, 136, 171, 174: n = A,T,C or G
gctggaacctngaagcccctgcacgtngacactagtggtttcaaacaattcggcacgagnaaagagcnnnnaccagctcctaagccctattaagaagaggccnggtcctctaatgccttgtttccatttcagttgntctttgagagacagaatgatgtactaaccattcgngantatt

SEQ ID NO: 7899 - DNA, 191 bp, Homo sapiens
  misc_feature 55, 93, 140, 169, 172, 179, 189: n = A,T,C or G
tgcagggtctgacactagtggatcttaagaattccggcacgaggatgcctcctgntttttatagcagtttatggggagcacttgaaagagcgngtgtacatgtatttcttttttctaggcaaacattgaatgcaaaccgngtattttttttaatataaatatataaacnggnccttttncatcccatgntg

SEQ ID NO: 7900 - DNA, 400 bp, Homo sapiens
  misc_feature 51, 77, 151, 227, 342, 367: n = A,T,C or G
ccgaacaattgctggagctcgcgcccctgcaggtcgacactagtggatccnaagaattcggcacgagtagatatggnataaagtgagactccatagtgtccagaattcttttctttgtatttgtactgatattctctctctcttttccagngtatcaacttttagttatatattttgttcaaaaataacatctgatcatcataaacatcaattatttaaataggatngcatgcttcttctgagtgctttaaagtaaacttgagtgtttataagtaagggaattattaagaagaaaccctggtatatccacaagataaatgttaccagtctctaagagtgcgnctcagtggttctcaaacttaaaagnatatcagaatcacctgtaggatttgttataatg

SEQ ID NO: 7901 - DNA, 400 bp, Homo sapiens
  misc_feature 12, 37, 50, 52, 82, 85, 153, 154, 162, 186, 226, 228, 230,280, 320, 349, 351, 364: n = A,T,C or G
cccgaacattangctggagctcgcgccccctgcaggncgacactagtggntncaaagaattcggcacgagaatttttttttngcncgtggatacccagttgttccaatatcatttattgaaaagtctatgcttttcctattctgtttttttgnnaaccttgnataaaatcaattgactgtaaatgngcaggtttatttttagattatcaattcttagtttatgggngngnttataccaggaccaaatcaaatttaatgagaaaattttttcaatcatggngcctattaccagttatcttatggcataataaaaattaaangtaggagaatatctttaacttcacctttngnatctcaaaggagnctctggccagcttataacttacttactctaagacat

SEQ ID NO: 7902 - DNA, 326 bp, Homo sapiens
  misc_feature 12, 14, 43, 44, 61, 127, 206, 219, 223, 240, 267, 278, 285,312, 320: n = A,T,C or G
tctggagcctcncncgccctgcaggtcgacactagtggatttnnagaattcggcacgaggnctgagaggggggatgcaagatcttcgtgaagaccctgaccggcaagaccatcaccctggaaggggngcccagtgacaccatcgaaaatgtgaaggccaagatccaggataaagaaggcatccctcccgaccagcagaggctcatntttgcaggcaagngggnggaagatggccgcactntttctgactacaacatccagaaggagncgacccctgcncctgggncctgcgtctgagagggtgggattgcanatcttcgntgaaga

SEQ ID NO: 7903 - DNA, 240 bp, Homo sapiens
  misc_feature 16, 40, 214, 218, 220, 222: n = A,T,C or G
agctggagctcgcgcncctgcaggtcgacactagtggatncaaagaattcggcacgaggacaggcgtgagccaccgcgcccggcccagcattttatttattaactgtaacaataatcctctttccaaagataacatcactgttagtagtgtctggtatgtttttccagaaaaagaataggcatatactgcatatgaaaatacatatgcttaaangggntntngcgcaaatcaatttagca

SEQ ID NO: 7904 - DNA, 187 bp, Homo sapiens
  misc_feature 6, 71, 73, 77, 153: n = A,T,C or G
actttngctggagctcgcgccccctgcaggtcgacactagtggattcaaagaattcggcacgagagcgtgngngccngagatgtactgttattagctgggaagaccaattctaacagcaaataacagtctgagactcctcatacctcagtggntagaagcatgtctctcttgagctacagtagaggg

SEQ ID NO: 7905 - DNA, 258 bp, Homo sapiens
  misc_feature 23, 24, 51, 131, 175, 178, 181, 205: n = A,T,C or G
tgcaggtcgacactagtggatcnnaagaattcggcacgagctcgtgccganttcggcacgagtgaaggaggaggcccttgattaggtcagtggtccctgggagccatcgggcgagaggcctccagccgggngacagtctgggctctcgggtactaatctttctaatatggcaggnggntgngggcaccttctgacttgaatgggngaattctcatatctaataaaaccaagaagtacctcgttgatatcttatagaaa

SEQ ID NO: 7906 - DNA, 292 bp, Homo sapiens
  misc_feature 2, 14, 59, 62, 106, 153, 229, 255, 288: n = A,T,C or G
cnggggggcaaggngaatgtggaagatgctggaggagaaaccctgggaaggctcctggntgnctacccatggacccagaggttctttgacagctttggcaacctgncctctgcctctgccatcatgggcaaccccaaagtcaagggggggggnaagaaggtgcttgacttccttgggagatgccataaagcacctggatgatctcaagggcacctttgcccagctgagngaactgcactgggacaagctgcatgnggatcctgagaacttcaagctcctgggaaatgngctg

SEQ ID NO: 7907 - DNA, 124 bp, Homo sapiens
  misc_feature 15, 21, 27, 38, 45, 52, 97, 120: n = A,T,C or G
gaaaaaaaccccaantttaanctgggnccttcgaagcnccctgcnggtgcgnacactcagtggcatccaaagaatcggcacgagggtcaccacctgntatccacccttcattgcgcaagngaca

SEQ ID NO: 7908 - DNA, 377 bp, Homo sapiens
  misc_feature 61, 69, 71, 80, 145, 220, 249, 304, 341, 346, 349: n = A,T,C or G
agctggagctcgcgcccctgcaggtcgacactagtggtttcaaagaattcggcacgagctngggccggntncggcacgantcaagatatggaataacagaaactcatatactccttggaaggctaaattgatagaatcatcttgnggaaagtttgttattacctatcagcgtatggatccaatactctaagaagacctcataattttacacctaggggantattaatattttacaaacttcacatatgnccataaagaaacacaagtaaaaatacttatagcaaaaaactggaaataactaggnccactgataggaaaaataataaaaatggaatgacagncctgntanaaaataacaacagcatgtttataaaaaa

SEQ ID NO: 7909 - DNA, 148 bp, Homo sapiens
  misc_feature 23, 129: n = A,T,C or G
agaattcggcacgagcgcaaagngggtctcattgctgcccgccggactggacgtctccggggaaccaagactgtgcaggagaaagagaactagtgctgagggcctcaataaagtttgtgtttatgcccnaaaaaaaaaataaataaaa

SEQ ID NO: 7910 - DNA, 184 bp, Homo sapiens
  misc_feature 37, 41, 64: n = A,T,C or G
gctggagctcgcgcccctgcaggtcgacactagtggntttnaagaattcggcacgaggaaatanacctaattttcctcaagggaattatggagaatcctattgtaaaatcacttgctaaggctcatgagaggctagaagattccaaactagaagctgtcagtgacaataacttggaattagtca

SEQ ID NO: 7911 - DNA, 400 bp, Homo sapiens
  misc_feature 11, 12, 123, 220, 382: n = A,T,C or G
ctggagctcgnncgcctgcaggtcgacactagtggatcttaagaattcggcacgagattcagctccagtctttacataccatgaataaaacattaaaacatcatatggagaagtttacatggngattgttcacctgcagtactgtggagttttaacattttgtcctcttttcagtgaaacagagtaaaaatattcatctaccattactgttattggctgnttttgttttattttttgatggtaatattctatccttatgacactattgcaaccaaattggctttaccatcttggctttagtaggtatagaagacaatggattaccatctttattgctggaatgtgttaagcattatatgctagtagaatctagtttaattgnttcaggtggaaagtattc

SEQ ID NO: 7912 - DNA, 398 bp, Homo sapiens
  misc_feature 3, 4, 85, 159, 184, 267: n = A,T,C or G
tgnnatgacgatattgatgctgacgtgctgcaaaattaccaagaatacaatctggccaacatcatctactactctctgaaggagnccaccactagtgagcagagtgccaggatgacagccatggacaatgccagcaagaatgcttctgagatgaggggncaaattgacattgacattcaaccgnacccgccaagctgtcatcacaaaagagttgattgaaattatctctggtgctgcagctctgtaaagaaggaaaattcagccagntgattttgtttttagcttactgctgcctttgtccgaagaaaccgttcctccattatttgaattactgaagacagcaagatatttgtaaattatcttaaaataaacaacttaaaataaaaaaaaaaaaaaaa

SEQ ID NO: 7913 - DNA, 313 bp, Homo sapiens
  misc_feature 14, 64, 169, 220, 263, 272, 282: n = A,T,C or G
ctggagctcgcgcnccccgaggtcgacactagtggatccattagtaattcggcacgaggcgggnatgggatcctatgtgccccccaggcggctggcagtgcccacggaagggtccactgaggtccctgagatggatacctctacctgacatggcctgaagatgcagggnagaggaatttgcccatggacagtgacccaaaggactaaggctggggagggngcgggccaaccccctttttgcctctgggtttgggggaagcggnagggcctcnttctttgggngcccctgccccccaataaaaggaactggggc

SEQ ID NO: 7914 - DNA, 123 bp, Homo sapiens
  misc_feature 2, 5: n = A,T,C or G
gngtnttgctcatgactgcagtatgcatgtatttttttccttctctgtgttttctaaacttacactaaaggattcatcaaatcatcttgttcagatggctcaggattgtatttattttgctta

SEQ ID NO: 7915 - DNA, 100 bp, Homo sapiens
  misc_feature 18, 19, 37, 38, 41, 46, 49, 52, 64, 65, 66, 70, 74, 78, 79,81, 89, 93, 94, 97: n = A,T,C or G
tgggacactagtggatcnnttagaattcggcacgagnnttnttcanggnccngttcatttgacnnnctgngacnccanncnacaagccnatgnngcncct

SEQ ID NO: 7916 - DNA, 117 bp, Homo sapiens
  misc_feature 1, 7, 30, 81, 82: n = A,T,C or G
ncctggnttggtcccagtggactgaaaggnggtgctctcgagtcaggcgcttagtcccagagagagctgggtgccgcgggnntcgtggtctgtgcctactcagggaaatgacttagg

SEQ ID NO: 7917 - DNA, 270 bp, Homo sapiens
  misc_feature 17, 40, 41, 43, 68, 76, 148, 154, 219, 220, 235: n = A,T,C or G
ctggagctcgcgcgccngcaggtcgacactagtggatccnnanaattcggcacgagtctgccactgcntccttcanacagttatatcctccttttaaaccattgttgttgagtgtaagatgtccttcatgttttcttataaagtcagngtttanaaatgttaccctttctaagttatatacagatcaaatgcttttttctttcacgtacatccatcatnngcaactgctgttcgnacacagaaacaggactgctcaaatgatcctatttg

SEQ ID NO: 7918 - DNA, 204 bp, Homo sapiens
  misc_feature 44, 45, 68, 69, 73, 74, 94: n = A,T,C or G
ctggagcctccgcgccgccccgcaggtcgacactagtggatccnnagtaattcggcacgagggtgggnngggnnttgctcatgactgcagtatncatgtatttttttccttctctgtgttttctaaacttacactaaaggattcatcaaatcatcttgttcagatggctcaggattgtatttattttgcttaccccgtgctctt

SEQ ID NO: 7919 - DNA, 177 bp, Homo sapiens
  misc_feature 6, 53, 56, 106: n = A,T,C or G
ccctgnaggttcgacactagtggatccattagtaattcggcacgagcaggggnggngggaattcctggagtgcctggacccccgggacctctctgggcttcccggnttctgtgagccagcctcctgcaccatgcagggctggtcagcggagcatttaacaaagggcctgacccttga

SEQ ID NO: 7920 - DNA, 400 bp, Homo sapiens
  misc_feature 16, 17, 37, 42, 45, 47, 48, 118, 195, 201: n = A,T,C or G
cgacactagtggatcnnttttaattcggcacgaggcngagcnagngnntgggcctggaaccgggccgtagcccccccagtttcgcccaccacctccctaccatggacccccgcaaagngaacgagcttcgggcctttgtgaaaatgtgtaagcaggatccgagcgttctgcacaccgaggaaatgcgcttcctgngggagngggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggggtgattgaaccagacactgatgctcctcaaggaaatgg

SEQ ID NO: 7921 - DNA, 400 bp, Homo sapiens
  misc_feature 13, 44, 63, 70, 112, 217, 222, 347: n = A,T,C or G
tctggagctcgcncgccctgcaggtcgacactagtggatccttngaattcggcacgagaaggncctgcgngccaacaatgtcttatctggaggcaccactatgtaccctggnattgctgatcgtatgcagaaggaaatcactgctctggctcctagcaccatgaagattaagattattgctccccctgagcgtaaatactctgtctggattgggggnggggntcctggcctctctgtccaccttccagcaaatgtggattagcaagcaagagtacgatgaggcaggcccatccattgtccaccgcaaatgcttctaagatgccttctctctccatctaccttccagncaggatgacggtattatgcttcttggagtcttccaaaccaccttccctcatct

SEQ ID NO: 7922 - DNA, 147 bp, Homo sapiens
  misc_feature 6: n = A,T,C or G
acgccntgaaggcctcgggcacgctacgagagtacaaggtagtgggtcgctgcctgcccacccccaaatgccgcacgccgcccctctaccgcatgcgaatctttgcgcctaatcatgttttttcctagtcccgcttctggtgctggg

SEQ ID NO: 7923 - DNA, 328 bp, Homo sapiens
  misc_feature 25, 137, 148, 149, 178, 179, 269, 294: n = A,T,C or G
aattcggcacgagggacaccggccnggagagggcggtcgcgccgggcagtggcggcagaatgttgactaccagggtatttagcctagttggcaagcgagcaatttccacctctgtgtgtgtacgagctcatgaaagngttgggaaganntaagacttttcgctcccagcttatggggnncggcgtgaccaccccttgccggagggggccatgtcaagcacctgtctgccagccagaaggcactgaaggagaaggagaaggcctcctggngcagcctctccatggatgagaaagncgaggttgtatcgcatttaagttcaaaggagagc

SEQ ID NO: 7924 - DNA, 400 bp, Homo sapiens
  misc_feature 3, 5, 151, 152, 156, 365, 366: n = A,T,C or G
gtnancacttacctgcccctcccaccccaatgcttccaatctatccccatttctgttaaatcagttttcattgcttacattttcaacactgagcccaatatactgctaggctagtcccatttgctgtctcacgtaagttttttatacttgnngggngggtaaaactgactgttccctttgcctcattttctatatagctatcccaaattcatcttgtcccacctaatgggacagcaaaatgcctctcaatgctgttttccacacaaacacatcaggtaatggactggttcgggcagtgtactcgtgccacctcctactggctgaaagaatctgctgttaaatattcaggaattctataatttagnngctcaacacagcatggggagagccttttacagga

SEQ ID NO: 7925 - DNA, 400 bp, Homo sapiens
  misc_feature 12, 61, 218, 232, 377, 390: n = A,T,C or G
tctggagctcgnacgcctgcaggtcgacactagtggatccttagaattcggcacgaggcgngatgtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggngtgactcacatcgngcgggaagtcgacaggccgggatccaaggtgaacaagaaggaggtggtggaggctgtgaccattgtagagacaccacccatggtggttgtgggcattgtgggctacgtggaaacccctcgaggcctcccggaccttcaagactgncttttgctgagcncatcaggtga

SEQ ID NO: 7926 - DNA, 400 bp, Homo sapiens
  misc_feature 23, 51, 197, 198, 202, 332, 353, 357: n = A,T,C or G
tgcaggtcgacactagtggatcntaagaattcggcacgaggctgactctgntagaactctgtccaaaaagtgcatggaatataatttgtaaagcttcccacaattgacaatatatgtgcatgtgtttaaaccaaatccagaaagcttaaacaatagagctgcataatattagtatttattaaagaatcacaattgtnnacgngagaataacttaaggattctagtttagttttttgtaattgcaaattatatttttgctgctgatatattagaataatttttaaatgtcatcttgaaatagaaatatgtattttaagcactcatgcaaaggnaaatgaacactttttaaatgngggngttgcttattttttacataagaattgaaacattgaactgaaca

SEQ ID NO: 7927 - DNA, 236 bp, Homo sapiens
  misc_feature 2, 103, 141, 161, 233: n = A,T,C or G
gngtattctcctggctcttgggaggttgggttcattttaaggatgaatctgaaggccaccttgatgggaacttcaggtaaaatcctcagatctctcacaaggnggatccagcacttttaaccagctctagggaaacccagnctcaggtttctatggggggnggaggaaatgacatccttttatagaagtttgctccagattacatgagcctgatttattaaaggacagggccngaa

SEQ ID NO: 7928 - DNA, 400 bp, Homo sapiens
  misc_feature 22, 49, 51, 52, 87, 200, 204, 215, 360: n = A,T,C or G
tgcaggtcgacactagtggatnttaagaattcggcacgaggcgaaactngnnattctagatgttctgttgccagtatcaaaaccggnttccaggctgtcacgggcaagcgagcacagctccgtgccaaagctaactaatttgctaatcactgattttgcaaagcttgttgtggagatgtggctggacaggtttgccatgngagnggatataccgntgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaaggngggtgccttttttaaaatcgttcatagacttctgtaaaat

SEQ ID NO: 7929 - DNA, 129 bp, Homo sapiens
  misc_feature 62, 127: n = A,T,C or G
aagaattcggcacgaggagtacttctagagcggccgcgggcccatcgattttccacccgggnggggtaccaaggtaagtgtacccaattcgccctatagtgagtcgtattacaattcactgggccgnga

SEQ ID NO: 7930 - DNA, 357 bp, Homo sapiens
  misc_feature 23, 85, 177, 271, 307: n = A,T,C or G
aagaattcggcacgagaaaaagntcgcctgcaatggtactgtaattgagcatccggaatatggagaagtaattcagctacagggngaccaacgcaagaacatatgccagttcctcgtagagattggactggctaaggacgatcagctgaaggttcatgggttttaagtgcttggggntcactgaagcttaagtgaggatttccttgcaatgagtagaatttcccttctctcccttgtcacaggtttaaaaacctcacagcttgtataatgnaaccatttggggtccgcttttaacttggactagtgnaactccttcatgcaataaactgaaaagagccatgcaaaaaaaaaaaaaaa

SEQ ID NO: 7931 - DNA, 210 bp, Homo sapiens
  misc_feature 95: n = A,T,C or G
aggaattcggcacaagtgacacccacaccctcgagctagcagcgtctcctcccttccccgggagagctggctggagacttggagctccgggaagnaggagtcacatttttttctctattctttggggattttttttacatgaataaaagtggatttcatggggaaaaaaaaaaagggggagaaaaaaaaaaaaaaaaaaaaaaaaaaaaa

SEQ ID NO: 7932 - DNA, 286 bp, Homo sapiens
  misc_feature 100, 145, 151, 237, 244, 267, 273: n = A,T,C or G
ctgcaggtcgacactagtggattcaaagaattcggcacgaggagaatcgcttgaacctgggaggcagatgtttcaagtgaactgagatcgtgccactgcnctcctgcctggcgacagagcaagactctgtttaaaaaaaaaagcncggggnggggggggcacattctgtaattccagctacttgggaggctgaggcaggaaaatcacttgaacccaggaggcaagagtttgcagtangcttggnatcccaccactgtactccagggngggggngcaagactgtctt

SEQ ID NO: 7933 - DNA, 303 bp, Homo sapiens
  misc_feature 10, 21, 27, 44, 56, 148, 181, 183, 200, 259, 302: n = A,T,C or G
tagaattcgncacgagggggngggccnagagcttgctccctacnatgagaactggntctacacgcgagctgcttccacagcgcggcacctgtacctccggggtggcgctggggttggctccatgaccaagatctatgggggacgtcanagaaacggcgtcattgcccagccactggggggngnggctccaagagtgtggnccgccgggtcctccaagccctggaggggctgaaaatggtggaaaaggaccaaggatggnggccgcaaacttgacacctaagggacaaagagatctggacaana

SEQ ID NO: 7934 - DNA, 219 bp, Homo sapiens
  misc_feature 20, 22, 138: n = A,T,C or G
agaattcggcacgagctgangngcgccttttgttcaacacagtaacccctgcattctgctctgctctaatacactacctggagaaagtcttttccttattttcaataaatgtcaggacattattgaaaaaaaaaaaanaaaaaaaaaaaaataaaaaaaaaaaaaaaaaaaaaagggggggggaaaaaaaaaaaaaaaaaaaaaaaaaaaaaaaaaaaa

SEQ ID NO: 7935 - DNA, 400 bp, Homo sapiens
  misc_feature 15, 40, 41, 60, 67, 188, 218, 219, 220, 244, 395: n = A,T,C or G
gctggagctcgagcncctgcaggtcgacactagtggatcnnaagaattcggcacgagggngcgggcntgggcctactaaactagaaagagcatttgaagagcaaaaggcaaaggttccatcaccatcctgtggaaatacgtgagttgttcatttcagtacacccatagtttctcaacaggtgtagcangatttgtttctaaaggacataggagtgcgnnntttatatgaaaccagaactggagnggtaatggcacttctgattcaattaacttacttggggaagctgccagggaaactaaatatgatgagaagaagaggaatgactggatcaaattaatagaaatagatctttttgcaagcaacataatgattctgatcatcaaccttgaaaagnaaatt

SEQ ID NO: 7936 - DNA, 314 bp, Homo sapiens
  misc_feature 61, 65, 66, 69, 155, 220, 267: n = A,T,C or G
gctggagctcgcgccccctgcaggtcgacactagtggatctttaagaattcggcacgaganactnnctngggtttctaatggagtatatagtttagtcatttcacagactctggcctcctctcctgaaatccttttggatggggaaagggaaggnggggagggtcccgaggggaaggggaccccagcttccctgtgcccgctcaccccactccaccaggncccggtcgccagccggagtctcctctctaccgccactgtcacaccgnagcccacatggatagcacagttgtcaagacaagattccttcagattc

SEQ ID NO: 7937 - DNA, 400 bp, Homo sapiens
  misc_feature 2, 4, 27, 52, 105, 161, 204, 206, 397: n = A,T,C or G
gngnccctgaggtgcgacactagtggnttcaaagaattcggcacgagagggntctcagctacctctgggtcattctgtaatgtaaatgttgttaataagaatggnttttacataaattatgcaaaggttaacaagcagtaacactgcactcctcaaaaagnggcggatgtaatgaaaggcccttttgatatccttgatttttcntngggtatctgtttgggcaccggtctatgtaacactagttctgcgtattagtattttagagtatctctgcctcccttgtcctgttgtttcttttgcccccttggaacacattggtcagcagttctaagagacactgcccacatgatggccattccctacttcatccttgctgagctaaattttatatttttgngca

SEQ ID NO: 7938 - DNA, 100 bp, Homo sapiens
  misc_feature 4, 23, 47, 71, 78, 80: n = A,T,C or G
aacnttttgctggagctcgcgcncctgcaggtcgacactagtggatncaaagaattcggcacgagcggcgntgcaggncnctttcactatggcctatcaa

SEQ ID NO: 7939 - DNA, 186 bp, Homo sapiens
  misc_feature 48, 67, 73, 75, 76, 114, 150, 151: n = A,T,C or G
acattttgctggagctcgcgccccctgcaggtcgacactagtggatcnaaagaattcggcacgaganaggggncnnttctttcatgtagtataattttgtgattcattcatgtngttatctgtattaatacttcgtacatttcccattgnntggatataccacaatttacatatccattcatctgt

SEQ ID NO: 7940 - DNA, 400 bp, Homo sapiens
  misc_feature 176: n = A,T,C or G
aaagaattcggcacgagccgccgcgggggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgngaagatgctgcggctggatattatcaactcactggtaacaacagtattcatgctcatcgtatctgtgttggcactgataccagaaaccacaacattgacagttggtggaggggtgtttgcaccttgtgacagcagtatgctgtcttgccgacggggcccttatttaccggaagcttctgttcaatcccagcggtccttaccagaaaaagcctgtgcatgaaaaa

SEQ ID NO: 7941 - DNA, 113 bp, Homo sapiens
  misc_feature 2, 4, 87, 89, 98, 100, 103: n = A,T,C or G
cngncagggtactaagcatgggtgggaactcctgccttataaaaattgtttttgtgttcttaaaaaaaaaaaaaaaaaacctcgggngnccttttagngnggncgggggccct

SEQ ID NO: 7942 - DNA, 146 bp, Homo sapiens
  misc_feature 19, 110: n = A,T,C or G
aagaattcggcacgagctngggccgaattcggcacgagataaatacagattccaagctatttagagccttttctacatttgggtataattttataactatacagaaatgngctgttttgtttaaatatgtaggacagacaaggatt

SEQ ID NO: 7943 - DNA, 400 bp, Homo sapiens
  misc_feature 18, 22, 111, 115, 147, 148, 172, 173, 315: n = A,T,C or G
aagaattcggcacgagangagncccaccggagcctggggcaagacagtgattgaatacaaaaccaccaagacctcccgcctgcccatcatcgatgtggcccccttggacgntggngccccagaccaggaattcggcttcgacgttgnncctgtctgcttcctgtaaactccnngggtcccaacctggctccctcccacccaaccaactttccccccaacccggaaacagacaagcaacccaaactgaaccccctcaaaagccaaaaaatgggagacaatttcacatggactttggaaaatatttttttcctttgnattcatctctcaaacttagtttttatctttgaccaaccgaacatgaccaaaaaccaaaagtgcattcaaccttaccaaaaaaaaa

SEQ ID NO: 7944 - DNA, 255 bp, Homo sapiens
  misc_feature 21, 25, 30, 101, 119, 126, 172, 177: n = A,T,C or G
aagaattcggcacgagcgggncgcnggggnagctgggaccgccgttcagtcgccaatatgcagctctttgtccgcgcccaggagctacacaccttcgaggngaccggccaggaaacggncgcccanatcaaggctcatgtagcctcactggagggcattgccccggaagatnaaggngggctcctggcaggcgcgcccctggaggatgaggccactctgggccagtgcggggtggaggccctgactaccctggaa

SEQ ID NO: 7945 - DNA, 114 bp, Homo sapiens
aagaattcggcacgagctcgtgccgcatacgtgttcagtgtgaatagtgtttaagttgaaaatattgtaaaaaaattatattttttcaaaaatatttaaaaaaataaataatag

SEQ ID NO: 7946 - DNA, 143 bp, Homo sapiens
  misc_feature 21, 38, 61, 62, 65, 68, 97, 100, 137: n = A,T,C or G
tgctggagctcgcgcccctgnaggtcgacactagtggnttcaaagaattcggcacgagggnntgngcnaataggcaagtgtttccaaactacttggnggnttacaaaaaatatgtcccagaaaaaaaaaaaatcttnccaaga

SEQ ID NO: 7947 - DNA, 396 bp, Homo sapiens
  misc_feature 61, 92, 130, 270, 346: n = A,T,C or G
gctggagctcgcgcccctgcaggtcgacactagtggattcaaagaattcggcacgagcgcngcccagcctcgaaatgcagaacgacgccggngagttcgtggacctgtacgtgccgcggaaatgctccgntagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcanatgattccattctccgattggccaaggccgatggcatcgtctcaaagaacttttgactggagagaatcacagatgnggaatatttgtcataaataaataatgaaaacctaaaaaaaaaaaaaaaaa

SEQ ID NO: 7948 - DNA, 399 bp, Homo sapiens
  misc_feature 18, 178, 179, 335, 338, 358: n = A,T,C or G
aagaattcggcacgaggngactcccaaggaaatggctacccaacttgccttcatgcgcctgctggccaactatgcctctcagaacatcacctaccactgcaagaacagcattgcatacatggatgaggagactggcaaccctgaaaaaggctgtcattctacagggctctaatgaggnngaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggnggngctgaccaggaattctttgnggacattggcccagtctgtttcaaataaatgaactcaatct

SEQ ID NO: 7949 - DNA, 158 bp, Homo sapiens
  misc_feature 18, 22, 29: n = A,T,C or G
aagaattcggcacgaganaagncaggggnggggcttcccttgatctgactgggggcctgccagaggttgccaccccggagtctgaggaggccttcaccctgcctctcctcaatgaccctgagcccaagccctcagtggaacctgtcaagagcatcagc

SEQ ID NO: 7950 - DNA, 400 bp, Homo sapiens
  misc_feature 45, 48, 76, 83, 138, 225, 313, 371, 389: n = A,T,C or G
aatttttgctggagctcgcgccccctgcaggtcgacactagtggnttnaaagaattcggcacgagcgggacgaggnacagctntttggacactaggaaaaaaccttgtagagagagtaaaaaatttaacacccatagnaggcctaaaagcagccaccaattaagaaagcgttcaagctcaacacccactacctaaaaaatcccaaacatataactgaactcctgncacccaattggaccaatctatcaccctatagaagaactaatgttagtataagtaacatgaaaacattctcctccgcataagcctgcgncagattaaaacactgaactgacaattaacagcccaatatctacaatcaaccaacaagncattattaccctcactgncaacccaacac

SEQ ID NO: 7951 - DNA, 384 bp, Homo sapiens
  misc_feature 2, 14, 38, 42, 383: n = A,T,C or G
gngacactagtggnttcaaagaattcggcacgagaggntacnttgttgtcctctttccagtgtcgcatctgtcattggtttttcactatggcaagttcattaaaaagcttgctccattgttatcttcaagtaatgcccataaggagatggaagatatctgagacaattaaggctttagcttctaggcaagagaaataacgttgcattaaatttcaagtttctttctgctagacttgaatgtgtctagccactctaatttatgggggcttttggttttttcctattgtactttgtatgtagaattgttttgaaatatcaagcatatttactttgaatttgaactctttcttaattttgtatttatcctttgaataaaatgtaant

SEQ ID NO: 7952 - DNA, 398 bp, Homo sapiens
  misc_feature 1, 5, 64, 121, 145: n = A,T,C or G
ngggnggagcttacatgctaatgtataagggcgctaatcgtactgaaacagtcacgtcttttanaaaacgagaaagtaaagtgcctgctgatctcttaaagcgggccttcgtgaggatgantacaagccctgaggctttcctggngggggggtcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatc

SEQ ID NO: 7953 - DNA, 287 bp, Homo sapiens
  misc_feature 11, 46, 47, 48, 53, 109, 118, 139, 201, 207, 210, 247, 270,281, 287: n = A,T,C or G
gcccctgagtncgacactagtggattcaaagaattcggcacgagannntgcgnttatttttgagactcccctccgagtggacgttgcagtgctgaaagcgcgagcgaanctgctgcanaaatacctgtgtgacgagcanaaggagctacaggcgctctacgccctccaggcccttgtagtgaccttaaaacagcctcccancggtgntgnggatgttcttttgacgcactgtatgacgaggacgtgnagaaggaggatcccttctacagntgggagagtancaaggn

SEQ ID NO: 7954 - DNA, 400 bp, Homo sapiens
  misc_feature 21, 112, 114, 135, 138, 398: n = A,T,C or G
ctgcaggtcgacactagtggnttcaaagaattcggcacgagctcgtgccgaattcggcacgagcatcgatgggcggcggaaaatagcctttgccatcactgccattaagggngngggccgaagatatgctcatgnggngttgaggaaagcagacattgacctcaccaagagggcgggagaactcactgaggatgagggggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcactttctggggccttcgngt

SEQ ID NO: 7955 - DNA, 400 bp, Homo sapiens
  misc_feature 48, 69, 71, 73, 74, 222, 224, 226, 227: n = A,T,C or G
ccgacttttgctggagctcgcgcccctgcaggtcgacactagtggatncaaagaattcggcacgagggngnannagggatgcatttgtttccattccttctgtatgttttagaaaatctatatgcatctaaaaccttgagcgtacgtaaaatattaccattcatatgttagaacaatcctgtctataatatcttaaataccaaattcttgtcttagatagcnantnnattattccctaaaatactagactattagattcaggcatagtaccattttctagccatggggaaataagataaagagacaatggccatggtacatgcctctctggggtgtcactcaagacacagagatccagtattccttgcaatagaggagctttgggtatttcactaatctt

SEQ ID NO: 7956 - DNA, 164 bp, Homo sapiens
  misc_feature 36, 117: n = A,T,C or G
ctggagctcgcgcccctgcaggtcgacactagtggnttcaaagaattcggcacgagaggaagacccaggaaaggtgtgagctggaagcactgaacctacctcatcctcctggagggngtggctaccctcgccaccccaaattccatgtcaataaagaacagcta

SEQ ID NO: 7957 - DNA, 209 bp, Homo sapiens
  misc_feature 30, 71, 80, 150: n = A,T,C or G
gacattttagctggagcctcgcgcgcctgnaggtcgacactagtggatccaaagaattcggcacgagccgncgggcgcgncatcatggacaccagccgtgtgcagcctatcaagctggccagggtcaccaaggtcctgggcaggaccggntctcagggacagtgcacgcaggtgcgcggggaattcatggacgacacgagccgatccat

SEQ ID NO: 7958 - DNA, 116 bp, Homo sapiens
  misc_feature 8, 13, 32, 41, 46, 52, 59, 86, 105: n = A,T,C or G
gccccctncaggntcgacactagtggatcttnaagaattcnccacnaggggnggggggngggcctaatactgacttactcattcantaaacgctgagcacacagngtgcctgtgct

SEQ ID NO: 7959 - DNA, 368 bp, Homo sapiens
  misc_feature 118, 200, 206, 225, 226, 273, 291, 311: n = A,T,C or G
gacaatttgctggagctcgcgcgcctgcaggtcgacactagtggatccaaagaattcggcacgagctcgtgccgaattcggcacgagcttttgtggcccagcctcctacctgtgaagngaagccaaagcccagtgttaaaagaatggacaaacagacggaagagatacttggagatgaagttcaacttttttcacttgangaagantttgattatgacaatgggnngctaacctccaagtttagtcctgcagagatagagaacatcaaagagntatgcaagcagcagaaanagaaaggacaccagcccagnacttagagaaatcctgggactgattcacagaggcatttttgggggggggggcttatt

SEQ ID NO: 7960 - DNA, 310 bp, Homo sapiens
  misc_feature 38, 39, 57, 59, 65, 68, 92, 263, 297: n = A,T,C or G
gctggagctagaccccctgcggtcgacactagtggatnnaaagaattcggcacgagngnggccgngantattgcaaaatacatgaagcttcntgcgcttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcaaaaaaaaaagagtncttctagagcggccggggccccttcgattttccncccgggggggggt

SEQ ID NO: 7961 - DNA, 400 bp, Homo sapiens
  misc_feature 7, 47, 75, 295, 384: n = A,T,C or G
gactttnagctggagctcgcgcgcctgcaggtcgacactagtggatncaaagaattcggcacgagcccctctggntgttaatctgtatccttagtaatattctttatgataaaatggcaagtgtaaataaagtgtttccctgaatcctatgagccactccagctaattaagcaaacctgagggggttctagaaaacaccaatttatagcccatcagtcagaagttctagaggcccatacttgtgattagcatctggagcgaggggcagtcttgcggtgctgagtcctcaccttgngagatctgactccaactccaggtaggtattgtcagaatcgagttaaattgtaggacaccccattagtgtccactggagaactgcttgcngggtaaggggaaaatc

SEQ ID NO: 7962 - DNA, 140 bp, Homo sapiens
  misc_feature 6, 8, 37, 43, 61, 64, 66, 67, 96, 97, 98, 122: n = A,T,C or G
aggggngntcaaagaaggcggcacgaggggggggcgngggccnagggccaccggctccccnccncnnatggggaagaagagcgacacactaacatnnngggaaggggaggcacataactgtncgcaacatgggggaacca

SEQ ID NO: 7963 - DNA, 190 bp, Homo sapiens
  misc_feature 42: n = A,T,C or G
gctggagcctcgcgcccctgcaggtcgacactagtggattcnaagaattcggcacgagaaaaaaccttccagaatcaataatccgtggcaacatatctctgtaaaaacaaacactgtaacttctaaataaatgtttagtcttccctgtaaccttcaaaaaaaaaaaaaaaaaaaaaaaaaaaaaaaaaaa

SEQ ID NO: 7964 - DNA, 135 bp, Homo sapiens
  misc_feature 4, 6, 66, 73, 93, 96, 106, 114: n = A,T,C or G
ttanangggaaccgaaaaaaccctgcactgcgagactagggggtttaaaaaattcggcacgagcgnggggggngggggggacgagggcctggngangcggggaccnaccgcggnctgggcaaaccctatgtgcga

SEQ ID NO: 7965 - DNA, 261 bp, Homo sapiens
  misc_feature 8, 9, 27, 32, 184, 185, 188, 227, 258, 260: n = A,T,C or G
gtggatcnnagaattcggccgagcccnctccnccttactaccaaacaaccttagccaaaccatttacccaaataaagtataggcgatagaaattgaaacctggcgcaatagatatagtaccgcaagggaaagatgaaaaattataaccaagcataatatagcaaggactaacccctataccttnngcntaatgaattaactagaaataactttgcaaggagagccanaaggcctaaggaccccccccccgggaaaaancnc

SEQ ID NO: 7966 - DNA, 137 bp, Homo sapiens
  misc_feature 41, 63, 75: n = A,T,C or G
tgctggagctcgcgccccctgcaggtcgacactagtggatntcaaagaattcggcacgagggngtacttaatagngtatcatgttttccctgttggcatgtagcctggataaatgctcttaattataaaaaaaaaaa

SEQ ID NO: 7967 - DNA, 352 bp, Homo sapiens
  misc_feature 41, 42, 66, 67, 69, 70: n = A,T,C or G
ctggagcctcgccgcgcctgcaggtcgacactagtggatcnnaagaattcggcacgagggctaggnngnnctggaactcttgacctcagacaatccgcccacctcggattcctaaagtgctgggattagagatgtgagctgttgcgcctggccccccaaaatgagtttattttaatcctagtaagtttaaactatgtattcaaaattatttaatagctgggtatggtggcgggcatctgtaatcctagctactcgggatccgggacaatcgcttgaacctgggaggccgaggttgcggtgagccgaaatcacgccactgcactccagcctgggtgacagagcaagactctgt

SEQ ID NO: 7968 - DNA, 380 bp, Homo sapiens
  misc_feature 3, 152, 220, 224: n = A,T,C or G
ganattagctggagctcgcgcgcctgcaggtcgacactagtggatccaaagaattcggcacgagattcatcccaccctctcacagtttggacttttctcccctctctttctaagagacctgaactgggcagactgcaaaataaaatctcggngttctatttatttattgtcttcctgtaagaccttcgggtcaaggcagaggcaggaaactaactggtgngagncaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagat

SEQ ID NO: 7969 - DNA, 400 bp, Homo sapiens
  misc_feature 4, 19, 43, 142, 220, 344, 346, 388: n = A,T,C or G
tttngctggagctcgcgcncctgcaggtcgacactagtggatncaaagaattcggcacgagcgagtttttttttaagccctaaatttgtggtaatttgttacagcagcaataggaaactaacaccctttcaatttcaacagngtcttgtttgtacaatacttataagatgatagacctcagaccaagctctgaccttgaaaagccagcacaccctccaanggaaaagcctccatgtcagtctcttcctgggcttggtttcaggggtctctgaggcccagtcaagctcatttcctgtgctttctgtggatggctatagatttactgctctggattcaataatggngncagggtaataaagaatagaaatacataaacacttctcaaagncttgtaagattt

SEQ ID NO: 7970 - DNA, 400 bp, Homo sapiens
  misc_feature 5, 48, 69, 76, 144, 223, 225, 227, 311, 316, 335, 375: n = A,T,C or G
gaacntttagctggagctcgcgcgcctgcaggtcgacactagtggatncaaagaattcggcacgagctngcttacncccgaatattggtaagatcgatcaatggcttcaggacatgggttctcttctcctgtgatcattcaagngctcactgcatgaagactggcttgtctcagtgtttcaacctcaccagggctgtctcttggtccacacctcgctccctgngngngccgtatgacagcccccatcaaatgaccttggccaagtcacggtttctctgtggtcaaggttggttggctgattggtggaaagnagggnggaccaaaggaggccacgngagcagtcagcaccagttctgcaccagcagccgcctccgncctagggggggttcctgtttctcct

SEQ ID NO: 7971 - DNA, 400 bp, Homo sapiens
  misc_feature 2, 3, 57, 83, 203, 215, 262, 264, 280, 281, 360: n = A,T,C or G
tnnaatatattaagttgtataaactatcaaggccacaaaatactaatgtcatttggncataatgactactgataaggcatcangaatggattttcagggctaccagaaaaatgtttccagatggttttagaatgtaggacttatgggggggttcaccaaaagattaaatgaaaccaccctgtgttttaaaatatatataatgntcaacctaatgnatatgcaacatttattctattctaattatttgacagggaactgcagngntaaattgtaaatgtgnnttctttatgttaccaaaacagcaatttgaaattagaactagtgggtttagagaactcaggtattctttcctgacattgntttcagaataaagaatatttttcataatattttaagatac

SEQ ID NO: 7972 - DNA, 183 bp, Homo sapiens
  misc_feature 22, 47, 48, 67, 80: n = A,T,C or G
cgcaggtcgacactagtggatnttaagaattcggcacgagctagganncgatttatatcatttaggntatccaatttgtnggcatacaattgtgtatagtactctcataatctttttttatttctgtagaatcaataataatgtcctcactttcatttttgattttagtaatttgaatcttcg

SEQ ID NO: 7973 - DNA, 398 bp, Homo sapiens
  misc_feature 31, 48, 50, 53, 55, 133, 205, 206, 225, 351, 393: n = A,T,C or G
cccctgcggtcgacactagtggttttaaagnaattcggcacgaggggnangcngngaaaactcccatcttcaagcctgcctgctaaagcttctttgccttcctgattgtgattatggtaacaatttatatcangacagttgtactttttgataacttagggaaaacagaaatgacttgaacaagggattgcctgcctcactgcgnngcggagatacaatttctgnaaagaacacaaatagcagttgtgaatattaaggtgtgattatctttccctgtccatgtgcttattgaaagaagatagtgaacaaatgattatattgaggatttttttaatttataagatctaatgngaaatccacacttggaactttttagatctggctggtgcttgnttaat

SEQ ID NO: 7974 - DNA, 137 bp, Homo sapiens
  misc_feature 4, 8, 29, 30, 55, 58, 62, 65: n = A,T,C or G
gccncctncggtcgacactagtggatccnnagaattcggcacgagctcgtgccgnttncggnacnagtaattttaggattgactttctctttctgaatgacttcataaagtttggggggaattttgaagacttgggt

SEQ ID NO: 7975 - DNA, 396 bp, Homo sapiens
  misc_feature 2, 5, 107, 157, 236, 260, 276, 300, 314, 316, 330, 366, 392,393: n = A,T,C or G
ancgnaataaagagcttgccttctttgcaaatgctttggaagaagtctctattgagacaattgaggctggcttcatgaccaaggacttggctgcttgcattaaaggnttacccaatgtgcaacgttctgactacttgaatacatttgaggggagggntaaacttggagaaaacttgaagatcaaactagctcaggccaaactttaagttcatacctgagctaagaaggataattgncttttggtaactaggtctacaggnttacatttttctgggntacactcaagggttaaggcaaaancaattttgtaattngnttagaagccagagnttatcttttctataagtttacagcctttttcttatntatacagggtattgccacccttttgnngaa

SEQ ID NO: 7976 - DNA, 216 bp, Homo sapiens
  misc_feature 16, 68, 112, 120: n = A,T,C or G
ctggagctccgcgccnccccgcaggtcgacactagtggatccattagaattcggcacgagaacctgtnagcccagcatttgagagaaggtagggtgtgtatatataaaaggntgtgtacnacctccacgaggggaaaaatattcagtaacttgtttacatagcatttgtgtaaagactatgatctcatcccaataaaatgatatattaaaccttca

SEQ ID NO: 7977 - DNA, 400 bp, Homo sapiens
  misc_feature 14, 15, 42, 43, 64, 65, 70, 72, 225, 343, 391: n = A,T,C or G
ctggagctcagcgnnccctgaaggtcgacactagtggatttnntagtaattcggcacgagggcnnggggnangcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggggagnggttggtctgaagtccttgcaagacgctgatgctcaagctgttgacatactcattgcctactttaacacctgtcagagaaacgtgatatggggtaaggaggtgcttttttaaaatcgntcatagacttctgtaaaatgcaagataaattaaaggtattataacagngaaaaaaaa

SEQ ID NO: 7978 - DNA, 135 bp, Homo sapiens
  misc_feature 3, 5, 60: n = A,T,C or G
gcntnagaaaactgattttcctaaaaaatataaatctgtgaaatcactctggtttgccgngctgacgttagttttgcatttgaaagtcatattattttcttgtgtttcctttcaatggtatatgaaaaaggccca

SEQ ID NO: 7979 - DNA, 398 bp, Homo sapiens
  misc_feature 8, 16, 37, 61, 63, 67, 98, 182, 210, 239: n = A,T,C or G
agctcganagccccgnggtcgacactagtggatcctnagtaattcggcacgagccaggggncncggnctcaaggggccatcctgtcccaccatgcagngccctagcttagagcctccctcaattccccctggccaccaccccccactctgtgcctgaccttgaggagtcttgtgtgcattgntgtgaattagctcacttggggatatgtnctatattggctaaattgaaacctggaatnggggggcaatctattaatagctgccttaaagtcagtaacttacccttaggaggctgggggaaaaggttagattttgtattcaggggttttttgtgtactttttgggttttttaaaaattgtttttggaggggtttatgctcaatccatgttctatttca

SEQ ID NO: 7980 - DNA, 400 bp, Homo sapiens
  misc_feature 2, 39, 42, 44, 49, 51, 55, 199, 202, 288, 309, 373, 387: n = A,T,C or G
gnggtcgacactagtggatccttagaattcggcacgagngcngngttancnctgngtctcagatttcctagtccatgacatttaatagtgagtatagagtaggatattctatacattttagtatttggcccttggaaacaaagttaaataccatgtcactcagaagactctcaaagtttgtgtataaatggccgaaggntgngctatgagagattctaatccattcacatcattcttgagttgtgcaaatacacttggctttgatttcacttggggatctaaatttgnttatttaagctgcaagaaagntacattaatttggaatgtgtcatcacttggacccagtatatcagatttttattgagtaaaatgntaaaaataataagngaactcagattct

SEQ ID NO: 7981 - DNA, 168 bp, Homo sapiens
  misc_feature 2, 4, 152, 154, 160: n = A,T,C or G
angngggactaaatgctcttccttcagaggattatccggggcatctactcaatgaaaaaccatgataattctttgtatataaaataaacatttgaaaaaaaaaaaaaaaaaaaaaaaaaaaaaaaaaaaaaaaaaaaaaaaaaaaaaaaaanangggggnaaaaaaaa

SEQ ID NO: 7982 - DNA, 400 bp, Homo sapiens
  misc_feature 5, 6, 32, 177, 257, 264, 399: n = A,T,C or G
tgccnntgaatggttgtcttgaaatacctggngtatatactgcagaaaaggaatgcagctgttttccacagtgtttgtccccaacttctgtttgtactcaagaatcgttgaacatatgaagattttggtcccataatccttaaactatagcggggggggcacctgattacatagagnttggatggagcaaagaaaaatccaatagcattttgcagagtaatgtatataattatgggctcacttcctactggagatgntgaaagnctaaatcggtttgaccattttgattgatggcacaatctgggttagaaaactttggtaagatcaatgacataaccctgctgcctctgcctgccctttcccctcccttctcccatccccttttcccctatctggggnc

SEQ ID NO: 7983 - DNA, 400 bp, Homo sapiens
  misc_feature 2, 5, 41, 63, 149, 157, 180, 276, 284, 286, 348, 356: n = A,T,C or G
cnggntctccgccctacctcacaagcacccgaagcttgtcntccaatgtctggactttttggntccatctgggccccgaaagggatgtgtatgaaaattgctgccccatcaaccccaccacggaacattcgacccacatggaaaaccangggggcgngtgcaaggaatactacccggggntcaacccgtttcgcgcctatatgaacctggacatatggactaccacagcgaataggaatgcaaatttcccactgtctagagactcgagttacctgngggaatgngngaaaataattgggatttttaaacaatgtgaataaagaggcttggggttttgattactagggnaaactggntatttgagatagattatgacatttggggggatattttggcactt

SEQ ID NO: 7984 - DNA, 244 bp, Homo sapiens
  misc_feature 1, 4, 25, 165, 171: n = A,T,C or G
ncgnaggccccgtgcgccgagggcnacgtgctcacccttttggagtcagagcgagaagccccggaggttgcgcttgagcttggcttgctcgcttgggtctttggatgtcggggttcgaccactttggcccgatgggaatgggcctgtcacagtctgctccttgtnttttgnccgccacacgtaactgagatgctcctttaaataaagcgtttgggttttaaaaaaaaaaaaaaaaaaaaaaaaa

SEQ ID NO: 7985 - DNA, 100 bp, Homo sapiens
  misc_feature 12, 46, 48, 63, 89, 93: n = A,T,C or G
ctgttgtgacanacacggggagctccgcggtgcccaaccctgtggntnccctgctgtgggggncctggggccggcggagccctttaaantctngttctgg

SEQ ID NO: 7986 - DNA, 195 bp, Homo sapiens
  misc_feature 18, 29, 175, 177, 182: n = A,T,C or G
tagaattcggcacgagcnggggagcgganacaaaaagaggagcagaagaaactcgaggagctaaaagcgaagcgccgcggggaaggggcccttggccccagggggaattaagaaatctggcaaaaagtaagctgttccttgggcctgaggagatgggggaccctttatttcatcngnggggnaaacctctctatt

SEQ ID NO: 7987 - DNA, 399 bp, Homo sapiens
  misc_feature 3, 47, 154, 159, 195, 209, 229, 245, 283, 373, 378: n = A,T,C or G
gcnccaaactaaaaccttatctgtctgcattttgaatgcattttggncaaaagtatacgttttaaagatttttaaagataaaaatgtggcacaactggtttttttagcttgctgaaaatgaccatatctctaaattaatctttctctccagagnggggncttcaccagtatttgtaactaggagaagctaacagngaatgtttaattgngaattttaatcattgcttgntaggaataatgactgngatactagaatgggcttttgaaacctgcatgtcccagngtgaaatttcagcacggcattttctgcatcctttcatggccatccaaaggattccgctgcagaaattattgatgggctattttttgctgncttgngatgcaaggctgcttttgggc

SEQ ID NO: 7988 - DNA, 163 bp, Homo sapiens
  misc_feature 10, 25, 48, 51, 53, 54, 90, 119: n = A,T,C or G
ccctgcaggncgacactagtggatnttaagaattcggcacgaggatgngangnnaagaagaagctgtactgtatttatgttgctattggncaaaagagatccactgttgcccagttggngaagagacttacagatgcagatgccatgaagtacaccattgtgg

SEQ ID NO: 7989 - DNA, 400 bp, Homo sapiens
  misc_feature 19, 41, 63, 66, 68, 69, 73, 186, 213, 222, 307: n = A,T,C or G
tctggagctcgaaaacccngcaggtcgacactagtggatcnttagaattcggcacgagctggnaancnngcgnggcaatccctgacgcaccgccgtgatgcccagggaagacagggcgacctggaagtccaactacttccttaagatcatccaactattggatgattatccgaaatgtttcattgngggagcagacaatgtgggctccaagcngaggggggnggatccgcatgtcccttcgcgggaaggctgtggtgctgatgggcaagaacaccatgatgcgcaaggccatccgagggcacctggnaaacaacccagctctggagaaactgctgcctcatatccgggggaatgtgggctttgtgttcaccaaaggaggacctcactgagatcaggggac

SEQ ID NO: 7990 - DNA, 399 bp, Homo sapiens
  misc_feature 6, 77, 228: n = A,T,C or G
cgacanttagctggagctcgcgcgcctgcaggtccgacactagtggatccaaagaattcggcacgaggagagatggncaaaggaaagtggcgatagtgtaagttaaatccttatcttttgtaatggggaattattaaagatgttgtaaagtcagtaagtcaagaaattattgctcaaacatattatttaaagttagaaagttaccagacgatctaaaataaatattgntaaaagcattacctctagggaatgggatttagatttaaaaagggtgggatgggaaactgtgtttttcattttaagtccttctgtactatttaattttttaccttgtgcatgtattactttgaaaaaatttttaataaacccaaataaaaatcttaaaaaaaaaaaaaaaaa

SEQ ID NO: 7991 - DNA, 176 bp, Homo sapiens
  misc_feature 5, 6, 35, 54, 56, 57, 62, 135: n = A,T,C or G
gcgcnncctcgcaggtcgacacctagtggatccanagtaattcggcacgagcantnnacagngaagtagtcatggaatcgatctcgtgaagcccgcaaggcccgaacacccccaccccgatttagacctgcgggngctgccccacgtcccccaccaaagcccatgtaaggagctga

SEQ ID NO: 7992 - DNA, 251 bp, Homo sapiens
  misc_feature 21, 46, 54, 201, 208, 219, 246: n = A,T,C or G
ctgcaggtcgacactagtggnttcaaagtaattcggcacgagccangagccggnggattcaagaggaggactccagctagctgggtaaggggttccttcctctcaacctaagtgtttatgtaagcctgctgggggccaggaactgcgtaaaactcagtaagctcagtacttctcagcacagaatccagtcccaaggaagcncccagcnaaaatttaggntgaattttctttaaaataaaataaagnaaaaa

SEQ ID NO: 7993 - DNA, 141 bp, Homo sapiens
  misc_feature 11, 74, 80, 85: n = A,T,C or G
cgaacaatttntctggagctcgcgcgccctgcaggtcgacactagtggatccaaagaattcggcacgaggcagncggagnaccgnatcctgaaggtgtccatgaaagagctcaacaagaaaacccctctcctcaccgaggg

SEQ ID NO: 7994 - DNA, 397 bp, Homo sapiens
  misc_feature 14, 18, 39, 63, 131, 162, 174, 215, 216, 263, 329, 340, 357,361, 373: n = A,T,C or G
ctggagctcgcgcncctncaggtcgacactagtggatcnaaagaattcggcacgagctcgtgncgagttcggcacgaggatgggtccaagctgcagtccatgagcaataacagactaccccagatactgcngtttacgcagggcttagtaaatgagatttgnggaactaagttnttaagttacctgaggcttcttaagaaagtcttcttttttgnncgggtgatgtgaaagagggagcatgtgacacagccagtatggggggngtgctagggttatcctgtttacaataaatcgcctgaatttcaaaaaaaaaaaaaaaaaaacctggngggtttttttnggggggccgggggcccntttnttttccccccgnggggggggccccggggaaggggcc

SEQ ID NO: 7995 - DNA, 235 bp, Homo sapiens
  misc_feature 40, 64, 69, 72, 177, 180, 181, 184, 233: n = A,T,C or G
gctggagctcgcgcgccctgcaggtcgacactagtggatncaaagaattcggcacgagcgcagnatggnggnaggcagcgggagcccgggagctttccctgcgtccctcccgcagcgggggccccaacagctcgaggaggaaggcccaatggaggaggaggaggcccagccaatggnggnnccngaggggaaacggggccctttgttacggggcccaacggtgggggccaccnag

SEQ ID NO: 7996 - DNA, 400 bp, Homo sapiens
  misc_feature 17, 20, 68, 69, 71, 76, 221, 224, 226, 265, 335, 365: n = A,T,C or G
tttgctggagcctcgcngcncctgcaggtcgacactagtggatccaaagaattcggcacgaggggggnntntatgntatctaccattcaaaaacttttttaaaaagtttaaagtttctagcaataaatacaattgggacagacattttgtgtatcatttttttgtttcttaatccaatattcctttacaaattaaatgccttgaaaaatataatggagggnggngngattttgatgctttggtctaacttctacattcctactgntaaaaaggccagtatatcttaaacaaatgaataggcatgaggcatattcagttgacttacaatgaaaagntatacagacaacagtaataactaaaagggngaatctgctaaatccttttgaaatgctgcagattt

SEQ ID NO: 7997 - DNA, 370 bp, Homo sapiens
  misc_feature 40, 62, 63, 66, 218, 220, 246, 262, 315: n = A,T,C or G
ctggagctcgcgcgccctgcaggtcgacactagtggatcntaagaattcggcacgaggacgnncgntgggagaacatcaggtgcactgtggacgtgggtctgggggtctcacccgcccagcgagagcagaaccaatccagtcaggatgtcactgactctaaatcagggtgattcaagatgcccaaaaatgatggatagagaaacagaaatctctgagngncaggaaccctgtcttttaaaaaggcngtcactgccttcaggngatgctgccccagaaacttaaaatttagtcgaggcagtttcaattgttactgnggaccgaattaggatcacaataaacgataatgcaggttcttcaaaaaaaaaaaaa

SEQ ID NO: 7998 - DNA, 182 bp, Homo sapiens
  misc_feature 12, 39, 69, 96, 125, 165: n = A,T,C or G
tggagctccgcncgccccgaggtgcgacactagtggatnttaagaattcggcacgagattgaactgggnacagaatgccggaaaatactacagagngtgcacacctggctatcattgatccaggngactctgacatcattagaagcatgccaagaacagactggngaaaagtaaaccttttc

SEQ ID NO: 7999 - DNA, 399 bp, Homo sapiens
  misc_feature 3, 55, 124, 200, 204, 205, 339: n = A,T,C or G
ccnccccgcggtcgacactagtggatccaaagaattcggcacgaggaaaataagncactaaatgtaatgtgatatcctggattatattctggaagataaaaagctcattagtggaaaagttggngaaatctgaataaagtttgaaatttacttaatagcaatataccagtgttaatgtctagcttagacaaatgtaacgngggnnatgtaagatttacttagtctagttttccaacattatatgggaactttgtatttttttataactgtctataaatttaaaattattaaaaggtaaagattttaaaaatgaaaataggaaaattagccgggtatggnggcgtgtaccctgtaatctcagctactcggggctgaggtaggagaattggttgaaaccgg

SEQ ID NO: 8000 - DNA, 190 bp, Homo sapiens
  misc_feature 25, 34, 50, 75, 77, 149, 155: n = A,T,C or G
acccaactttgctggagctcgcgcncctgcaggncgacactagtggatcntaagaattcggcacgagagcggggnanacaaacaaaaagcacagtgttacgcttgcaagtttccatttgttttaataccacgcaatctttcacactcgngcgtgngcgcgcacacagagcttacctgacttgctctgctt

SEQ ID NO: 8001 - DNA, 312 bp, Homo sapiens
  misc_feature 7, 22, 46, 66, 221, 222, 224: n = A,T,C or G
aacattngctggagctcgcgcncctgcaggtcgacactagtggatncaaagaattcggcacgaggngcactcctgaggatgagactctgggggccctagccggggtccacgggagggctgtccttggggactctaggatggcttcgttctggcccggctcacttctggagctgtgagacccaagacaaaaggggctgagggatttctcattgacaagagtnngngcgggaaaaccacctgatccctagggatttgtcatcttaagactcaaaaggcttaataccaggaaccaccttggcaagatatttaccc

SEQ ID NO: 8002 - DNA, 400 bp, Homo sapiens
  misc_feature 7: n = A,T,C or G
gacaatnagctggagctcgcgcgcctgcaggtcgacactagtggatccaaagaattcggcacgaggtttgcctagcagccaggtggttataaaagattcatatgctttggtacactgataaatgttagccattattcctgaaagcttcttaaattgcatcagttgttttgaaattttttcaagaataaactagttgaaaagtctttgtattaaaaatacacatagatttttgtgaacatttccagtgtgtagtgtcgtttgctttctatttctgacctcaaaagtgcctcacttgtatattatttccattaaaagcttgactgcattctttctaatgaacaatgaaaaactgtttaactcatgtcataatgtgtctcctcagatatagttaactagcttg

SEQ ID NO: 8003 - DNA, 400 bp, Homo sapiens
  misc_feature 2, 9, 28, 29, 32, 33, 43, 111, 180, 184, 241, 270, 302, 357,394: n = A,T,C or G
tngtgatcnaagaattcggacaagattnnaanngggggaggangctggactacccacgttctcacacccaccgtccgccctgctcctccctggctgccctggccctgaggngtgggggctgagatgttgctgaggagtgaggaatagttgagccccaagtcctgaagaggcgggccagcngggngggctcaaggaaagggggtccaagtgggaggggcaggctgacatctgtgtttcaagnggggctcgccatgccgggggttcataggncactggctctccaagggccagagggggcaggnggtggcactgagcccccccaacactgtgccctgggggagaaagcactgacctgtnatgccccccctcaaaaccttctcttcttgacgggccnttttgc

SEQ ID NO: 8004 - DNA, 185 bp, Homo sapiens
  misc_feature 3, 16, 30, 57, 72, 75, 77, 84, 149, 179: n = A,T,C or G
ttnagaattcggcacnataggcaggaagangagcagaagaagaagcggaccttccgnaagttcacctaccgnggngnggacctngaccagctgctggacatgtcctacgagcagctgatgaagctgtacagtgcgcgccaggggggggntttaaaccgggccttggggaaaaaaaaatngggggt

SEQ ID NO: 8005 - DNA, 169 bp, Homo sapiens
  misc_feature 9, 15, 47, 165: n = A,T,C or G
aggggatgncggggnctggtctcctcagcctcctcatctgggggagnggaatagtatcctccaggtttttcaattaaacggattattttttcaggacaaaaaaaaaaaaaaaaaaaaaaaaaaaaaaaaaaaaaaaaaaaaaaaaaaaaaaaaaaaaaaaaaaangggg

SEQ ID NO: 8006 - DNA, 169 bp, Homo sapiens
  misc_feature 2, 17: n = A,T,C or G
tngctggagcttcgcgngccctgcaggtcgacactagtggatccaaagaattcggcacgaggctcccccaaaaatttgaatttttttttcaacactcttacacctgttatggaaaatgtcaacctttgtaagaaaaccaaaataaaaattgaaaaataaaaaccataaa

SEQ ID NO: 8007 - DNA, 265 bp, Homo sapiens
gacaatagctggagctcgcgcgcctgcaggtcgacactagtggatccaaagaattcggcacgaggttcagtcttgcagtatacaagcttttgtgtataaatgttttatgatatgattccctgtattttgcaggggtttttttctcttttgctttttagataaatatgtatatcaatattttaaattcatctttgctttttttagaggagtttgtaatcaccttataacatgaaaataaacatttcctttttaacatccaaaaaaa

SEQ ID NO: 8008 - DNA, 400 bp, Homo sapiens
  misc_feature 9, 167, 226, 227, 230, 366: n = A,T,C or G
cgacatttngctggagctcgcgcgcctgcaggtcgacactagtggatccaaagaattcggcacgagcttccatttgcactaggaaatgaaggtagtgatgggattggcaatgttcctggcagatgtttcagcccaaaagctcttctacagaccggtttagagctggngccctatgagaatattagggagcttttattttaaattgaactttacccttgtccatgcnnggnattcctcctgaatgcatccatgaatttgtttacttttgcgtcaaacatatgagccattgtcatgctcagcctgtgccaccattgctctgtctgatgtatgtaatcatacaagacctgattttggttctaacacagnggtctttgactatcaacattgatgtttttagaga

SEQ ID NO: 8009 - DNA, 142 bp, Homo sapiens
  misc_feature 70, 71: n = A,T,C or G
gaacaattagctggagctcgcgcgcctgcaggtcgacactagtggatccaaagaattcacgagcgggccnnaaagggaccagactccagcacacctgtctcctcctgcctggggtggccatggggatggaagggggtggaat

SEQ ID NO: 8010 - DNA, 311 bp, Homo sapiens
  misc_feature 5, 8: n = A,T,C or G
gacanttngctggagctcgcgcgcctgcaggtcgacactagtggatccaaagaattcggcacgagaatacgtggggggctgagtattaaactactggcttacatcctctgatgtcattactttcttgttcgtttgtgacttgaggttggattttaagcaaatgtatttgtggctttttaccaaggtcatatggccagataacttttcaaaagcattagttaaagaattctgattagtttgaattagaaacaaaactcaaagaacatgacctaatttaacaggttaatttgaagtgcatctgccaagtagaa

SEQ ID NO: 8011 - DNA, 400 bp, Homo sapiens
  misc_feature 5, 7, 125: n = A,T,C or G
gacantnagctggagctcgcgcgcctgcggtcgacactagtggatccaaagaattcggcacgaggttaatatttagttgcctatattatgtaaccttttaactatatataaagtacttttttggnttctttctcaccacttttattcaaaagtacttttaacataccaatacatagtctgtctgatgggagtataaattggacagtaaggttttgtcttaataaaatgaaatttgtttctcatgatatgaatcttgcaggtaagatgtagggtttattgaaaatgtgtgggttaaatgctttcaggtacaccaattctttctactaaattgagctctatttgaagttctttggaatctgtggtgaaaaataattttctgatttccaaatacattaagagc

SEQ ID NO: 8012 - DNA, 134 bp, Homo sapiens
  misc_feature 6, 9, 32, 37: n = A,T,C or G
tgtggntcnaagaattcggcacgagaatctgngatgnccgctgtattttttattaaaatcctgtcaagaaaaaaaaaaaaaaaaaaaaaaaaaaaaaaaaaaaaaaaaaaaaaaaaaaaaaaaaaaaaaaaaaa

SEQ ID NO: 8013 - DNA, 400 bp, Homo sapiens
  misc_feature 6, 9, 47, 67, 70, 77, 133, 136: n = A,T,C or G
ccgacnttngctggagctcgcgcccctgcggtcgacactagtggatncaaagaattcggcacgaggncgnactttgnctgactacaatattcaaaaggagtctactcttcatcttgtgttgagacttcgtggnggngctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagac

SEQ ID NO: 8014 - DNA, 400 bp, Homo sapiens
  misc_feature 10, 18, 47, 72, 222, 223: n = A,T,C or G
aacttttggntggagctngagcccctgcggtcgacactagtggattnaaagaattcggcacgagcggcacgnggtttggagacattggtttccccaaaactgccttccctggaagccccaacctctgcctctaacgtaatgactgcttttgccaccacaccacccatttcgtccataccccctttgcaggaacctcccagaacaccttcaccaccactgagnnctcacccagacatcgacacagacattgattcagtggcttctcagccaatggaacttccagagaatttgtcactggagcctaaagaccaggattcagtcttgctagaaaaggacaaagtaaataattcatcaagatccaagaaacccaaagggttagaactggcacccacccttgtga

SEQ ID NO: 8015 - DNA, 400 bp, Homo sapiens
  misc_feature 4, 16, 29, 44, 63, 65, 66, 67, 68, 70, 71, 72, 131, 177,179, 218, 222, 223, 368, 388: n = A,T,C or G
tggntggagcctgagngcccttgaggtgngacactagtggtttnaaagaattcggcacgaggngnnnngnnngaacccaggaggtggaggttgagtgagccgagatcacgccactgcactccagcctgggngacagagtaagactgtctcaaaaataaaaataaaaataaaagtgtntnaatttaaaatttttattttccatgtccactgaatatgangggnnaaactttttgatattactagatgctttcagaatctgataaaagcctcagacactttctccccaaaatataaacacccaccaaatgtagcctacaatatctattggctactttatccctcagaagtctttctataaaccccctagntttccatgggtcctgactgnaaaactaaaaat

SEQ ID NO: 8016 - DNA, 203 bp, Homo sapiens
  misc_feature 3, 18, 64, 68, 72, 132: n = A,T,C or G
ttngctggagctcgcgcncctgcaggtcgacactagtggatccaaagaattcggcacgagcccngggnagangactgcttcctggaaagcagttctattccttctccaaagcaaggaacagaactggctggngagtgctgggcctcatgaccccagctgcctgagcttctttctatcttgaagtcatttgaaaagagacagag

SEQ ID NO: 8017 - DNA, 400 bp, Homo sapiens
  misc_feature 5, 24, 33, 48, 73, 223: n = A,T,C or G
gaacnttttgctggagctcgcgcncctgcaggncgacactagtggatncaaagaattcggcacgagccgaggnctcccagaacatcacctaccactgcaagaacagcgtggcctacatggaccagcagactggcaacctcaagaaggccctgctcctccagggctccaacgagatcgagatccgcgccgagggcaacagccgcttcacctacagcgtcactgnggatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaac

SEQ ID NO: 8018 - DNA, 168 bp, Homo sapiens
  misc_feature 6, 33, 140: n = A,T,C or G
gaacantaagctggagctcgcgcccctgcaggncgacactagtggatccaaagaattcggcacgaggggggttcaccttgttagccaggatggtttccatctcctgacctcgtgatctgcccgtctcggcctcccaaagngctgggattacaggcatgagccactgcg

SEQ ID NO: 8019 - DNA, 398 bp, Homo sapiens
  misc_feature 3, 10, 208, 312: n = A,T,C or G
ccnttgaagntgggacactagtggatccaaagaattcggcacgagctcccaccctgagcagagccgccgaggatgataaacacccaggacagtagtattttgcctttgagtaactgtccccagctccagtgctgcaaggcacattgttccagggcctctgtggtgctccttgatgcccctcacccactgtcgaagatccccggggggngagggggcggcaagggatccttctctctcagctctaatatataaggacgagaagctcactgtgacccaggacctccctgtgaatgatggaaaacctcacatcgnccacttcctcagacctttctcgcttctgagcttgggggcctgttccctccatctctccgaacctggcttcgcctgtccctttcact

SEQ ID NO: 8020 - DNA, 400 bp, Homo sapiens
  misc_feature 68, 71, 74, 75, 223, 224, 269, 387: n = A,T,C or G
gacaataagctggagctcgcgcgcctgcaggtcgacactagtggatccaaagaattcggcacgagggnggnganncagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaactttnnctccctgaacctgagggaaactaatctggattcactccctctggntgatacccactcaaaaaggacacttctgattaagacggttgaaactagagatggacaggttatcaacgaaacttctcagcatcacgatgaccttgaataaaaattgcacacactcagngcagcaatatatt

SEQ ID NO: 8021 - DNA, 399 bp, Homo sapiens
  misc_feature 3, 39, 45: n = A,T,C or G
tgngacactagtggatccaaagaattcggcacgagggtngcgccntttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgcttggggaactggcgccatcgccgggactccagaaccgcagaagcctccccagctcacccctggaggacggccggctctctatagcaccagggctcacgtgggaacccccctcccacccaccgccacaataaagatcgcccccacctccaccctcaaaaaaaaa

SEQ ID NO: 8022 - DNA, 400 bp, Homo sapiens
  misc_feature 9, 23, 33, 36, 223, 334: n = A,T,C or G
ccttaatantgagtcttattccncttcactggnacnctagtggatccaaagaattcggcacgagccaggaggggaacgcggtcccccaggtgagagtggtgctgccggtcctactggtcctattggaagccgaggtccttctggacccccagggcctgatggaaacaagggtgaacctggtgtggttggtgctgtgggcactgctggtccatctggtcctagnggactcccaggagagaggggtgctgctggcatacctggaggcaagggagaaaagggtgaacctggtctcagaggtgaaattggtaaccctggcagagatggtgctcgtggngctcctggtgcttgtaggtgccccttggttcctgctggagccacaggtgaccggggccaaagctgg

SEQ ID NO: 8023 - DNA, 400 bp, Homo sapiens
  misc_feature 76, 77, 225, 226, 227, 360: n = A,T,C or G
gaacaataatgctggagctcgcgcgcctgcaggtcgacactagtggatccaaagaattcggcacgagcactcaagnncctcaacaaccagattgagagcatccgcagccccgagggctcccgcaagaaccctgctcgcacctgcagagacctgaaactctgccaccctgagtggaagagtggagactactggattgaccccaaccaaggctgcaccttggacgcnnngaaggttttctgcaacatggagactggcgagacttgcgtctaccccaatccagcaaacgttcccaagaagaactggtggagcagcaagagcaaggagaagaaacacatctggtttggagaaaccatcaatggnggcttccatttcagctatggagatgacaatctggctccca

SEQ ID NO: 8024 - DNA, 120 bp, Homo sapiens
  misc_feature 69: n = A,T,C or G
aaggacaaaagctggagctcgcgcgcctgcaggtcgacactagtggatccaaagaattcggcacgaggnggaagtcaccattgcagatgcttaagtcaactattttaataaattgatgac

SEQ ID NO: 8025 - DNA, 398 bp, Homo sapiens
aaaataagctggagcctcgcgcgcctgcaggtcgacactagtggatccaaagaattcggcacgagatttaccagtaacttattttaaatatgcctagtaacacatatgtagtataatttctagaaacaaacatctaataagtatataatcctgtgaaaatatgaggcttgataatattaggttgtcacgatgaagcatgctagaagctgtaacagaatacatagagaataatgaggagtttatgatggaaccttaaatatataatgttgccagcgattttagttcaatatttgttactgttatctatctgctgtatatggaattcttttaattcaaacgctgaaaagaatcagcatttagtcttgccaggcacacccaataatcagtcatgtgtaata

SEQ ID NO: 8026 - DNA, 400 bp, Homo sapiens
  misc_feature 3, 221, 311: n = A,T,C or G
ganaaaagctggagctcgcgcgcctgcaggtcgacactagtggatccaaagaattcggcacgaggttgtatagaatgtaggcggagctacacccactgccagaagatctgtgaacccctggggggctattacccatggccttataattatcaaggctgccgttcggcctgcagagtcatcatgccatgtagctggtgggtggcccgtatcttgggcatggngtgaaatcacttcatatatcatgtgctgtaaaataagaactagctgaagagacaaccaaagaagcattaaggcaggttgatgctgatggnaccataaaatatttttacactcaacctgagcggttattcttgacactcttaacagaattttttcaattgttttccagaactttagtata

SEQ ID NO: 8027 - DNA, 380 bp, Homo sapiens
  misc_feature 215, 220, 221, 287, 303, 322, 358, 359: n = A,T,C or G
agctggagctcgcgcgcctgcaggtcgacactagtggatccaaagaattcggcacgagcgaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacanggggnngtacctggctttcctccgcaagcggatgaacaccaacccttcccgaggcccctaccactttccggnccccccagccgcattnttctggcggaccgtgcgangttatgcttcccccacaaacccaagcgaaggcccanncccgcttttggaaccgtctaa

SEQ ID NO: 8028 - DNA, 400 bp, Homo sapiens
gacaataagctggagctcgcgcgcctgcaggtcgacactagtggatccaaagaattcggcacgaggtttgtgagtattttgttgaggatttttgtgtctatgttcatcagggatattggcctgtagttttctttttttgttgttgtatttttgcgagattttggtaccaggatgatattggactcatagaatgatgaggagcccctccccctcaactttttgaaatagtttcaataggattgtatgtctggtagagttcagctgtgaatctatgtggcctgtggctttttctggttggtaggtattttattactgattcaatttgattactcattggtctgttcaggatttctgtttattcctggtttcataaagcaaatctcaataaattaaaatcatg

SEQ ID NO: 8029 - DNA, 222 bp, Homo sapiens
  misc_feature 6: n = A,T,C or G
ctgggnctcgcgcgcctgcaggtcgacactagtggatccaaagaaattcggcacgagcttaagtataagaagtgttatcactgacaagaacattagccattttcccataactagatagagctatgattttttaggttgcctggcttctgcctagcagatatttctggagtagaaatgtatctgtctacaaactattatcctttttctccgttactaaaatgc

SEQ ID NO: 8030 - DNA, 400 bp, Homo sapiens
  misc_feature 3, 10: n = A,T,C or G
aangaacaanaagctggagctcgcgcgcctgcaggtcgacactagtggatccaaagaattcggcacgaggtactttccaatctcagtcactctaggactctgcactgaatggctgacctgacctgatgtccattcatcccaccctctcacagtttggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaac

SEQ ID NO: 8031 - DNA, 399 bp, Homo sapiens
  misc_feature 15, 227, 246, 282, 352, 376: n = A,T,C or G
cctcgcgcgcctgcnggtcgacactagtggatccaaagaaattcggcacgagctcgtgccgaattcggcacgagatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagngcaggaaagcagcactganaaacttttgattgttttcaatttcttcttttatgtncacaccaccacattcccattcactttgattttctacatgtaattaccttcttttgtttatcattagattngatggggccaaagttgagatagantaggagggtgatgacgggtaaga

SEQ ID NO: 8032 - DNA, 400 bp, Homo sapiens
  misc_feature 34, 37: n = A,T,C or G
accgaacaatttgtctggagcctcgcgcgcctgnggncgacactagtggatccaaagaattcggcacgaggcagcacctaccccctcctcctttcccacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgcca

SEQ ID NO: 8033 - DNA, 215 bp, Homo sapiens
  misc_feature 2, 8, 46, 108: n = A,T,C or G
anctgggnctcgcgcgcctgcaggtcgacactagtggatccaaagnaattcggcacgagcggcacgagcgggaacctctcctgccggaagccggacggcagggatggnccccaacttcgccctgcccacttgacttcaccaaatcccttcctggagactaaacctggtgctcaggagcgaaggactgtgaacttgtggcctgaagagccagagct

SEQ ID NO: 8034 - DNA, 400 bp, Homo sapiens
  misc_feature 8, 9: n = A,T,C or G
gaacaatnngctggagctcgcgcgcctgcaggtcgacactagtggatccaaagaattcggcacgagcggaagtacggaccgtgaactggagtggaatcgcgactatgggagctccggggggaaagatcaaccggccccgaacggtgactgtgagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccagg

SEQ ID NO: 8035 - DNA, 400 bp, Homo sapiens
  misc_feature 7, 8, 28, 342: n = A,T,C or G
tgcagtnngacactagtggatccaaagnattcggcacgagcaggagcccagggtttgcgaggcatcaccggcatagttggggacaaaggggaaaaaggtgctcggggcttagatggtgaacctgggcctcagggtcttcctggtgcacctggtgatcaaggacagcgaggacctccaggagaagcaggtcccaaaggagatagaggggctgaaggtgctagaggaattcctggtctccctgggcccaaaggagacacgggtttgccaggtgtggatggccgtgatgggatccctggaatgcctggaacaaagggtgaaccaggaaaacctgggcctcctggngatgcaggattgcagggggttaccaggtgtaccttggaattcctggggcaaagggtgt

SEQ ID NO: 8036 - DNA, 167 bp, Homo sapiens
  misc_feature 3, 8: n = A,T,C or G
gancaatnagctggagctcgcgcgccctgcaggtcgacactagtggatccaaagaattcggcacgagttctgacttaaaacattccttgtacctttatttacacgatccaagttgcagtgtgcctagattttcctccaaggacaaaaatgtgaataaagcaatattt

SEQ ID NO: 8037 - DNA, 169 bp, Homo sapiens
  misc_feature 4, 35, 50, 56, 78, 84, 103, 136: n = A,T,C or G
aagnaaaataatctggggctcgcgcgcctgaaggntcgtaactagtgganccaaanaatcggcacgagaccttccagnagatgnggatcagcaagcaggagtntgaccgagtccggcccctccatcgtccaccgcnaaatgcttgtaggcggactatgacttagcccgc

SEQ ID NO: 8038 - DNA, 400 bp, Homo sapiens
  misc_feature 5, 7, 111, 166: n = A,T,C or G
gacantnagctggagctcgcgcgcctgcaggtcgacactagtggatccaaagaattcggcacgaggtcgaatatcaaaaaatatttgttattgtttttattgttatttggngatttttcataaacaaactgacaactggggttggcctgattcatgagatattggnggagttctttgaaatgccccagttctcttaccttcagaagtccaaagctttccacagaatttctgccagttcccatggaggtttgcattttcacagtcccttctggcataatcatttgctgctgaattagttcacgttgcagatcgactcaccatccgtttatgtgtcattgtcttgtggcacagctcttccttaattacctagctcttccttaattactctcccctcctccaa

SEQ ID NO: 8039 - DNA, 400 bp, Homo sapiens
  misc_feature 3, 5: n = A,T,C or G
ganantaagctggagctcgcgcgccctgcaggtcgacactagtggatccaaagaattcggcacgaggttgatgtgaaaattgtataacagacaattgttgaacacggttcatgtcaactatttcacgttcaaacagtgttaagtaacttgcactttttccctctcttcttcccattatagccatattaaatgtggcttttttttctggaagtaaaagtgttggaaatcactaatcggcttgttaattgttaattcacggctagaggctccattgttcttagtgcctgcacttgaaaagaaagtcagatgtggcaaagttggatttttttttctaatacgatgcaatgtgctcccaaattcttcaggatgtgctaattttctgcctagaacaagcctcaga

SEQ ID NO: 8040 - DNA, 400 bp, Homo sapiens
  misc_feature 226, 266, 286, 304, 309, 381, 383: n = A,T,C or G
gacaataagctggagctcgcgcgcctgcaggtcgacactagtggatccaaagaattcggcacgaggctgccgctgctagccgcgacaactccggaccacggccgccaccgaaggctgcttctgctgccgctactgctgttcctgctgccggctggagctgtgcagggcttgggagacagaggagaggccccggactcgcgaagaggagtgccacttctacgcgggnggacaagtgtaccccggggagaggcatcccgggtatcggncggccgaccacttccttgcnccttaagcaaagcgaaanatttnccaagcccagcgccctactggggaaggaacagcttgggattcgatgggagaattttaagggagcctgaaagntnacctgattatttcgggg

SEQ ID NO: 8041 - DNA, 394 bp, Homo sapiens
gaacaataagcctggagcctcgcgcgcctgcaggtcgacactagtggatccaaagaattcggcacgaggtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgactta

SEQ ID NO: 8042 - DNA, 246 bp, Homo sapiens
  misc_feature 71, 72: n = A,T,C or G
gaacaataagctggagctcgcgcgcctgcaggtcgacactagtggatccaaagaattcggcacgagctcanngccgagcgactccagagaacctcttgggagacagaagaggcatctgtgcacagctcgatcttctacttgcctgtggggaggggagtgacaggtccacacaccacactgggtcaccctgtcctggatgcctctgaagagagggacagaccgtcagaaactggagagtttctatta

SEQ ID NO: 8043 - DNA, 117 bp, Homo sapiens
gaaaaaagctggagctcgcgcgcctgcaggtcgacactagtggatccaaagaattcggcacgagcttccctctgagctgtattgttctttaatggctgtcttgcccttccaaaaaaa

SEQ ID NO: 8044 - DNA, 400 bp, Homo sapiens
gaacaataagctggagcctcgcgcgcctgcaggtcgacactagtggatccaaagaattcggcacgagcccccgagcgccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgccttggaggtggaggggaaagatggtcagtaggacagaaggtaacattgatgactcgctcattggtggaaatgcctccgctgaaggccccgagggcgaaggtaccgaaagcacagtaatcactggggtcgatattgtcatgaaccatcacctgcagga

SEQ ID NO: 8045 - DNA, 302 bp, Homo sapiens
  misc_feature 22, 24, 27: n = A,T,C or G
gacaaaagctggagctcgcgcncntgnaggtccgacactagtggatccaaagaattcggcacgagtacacaaagtaagcctctttatgaaacaattgaggataatgatgtgaaaggttttaatgatgatgttctacttcagatagttcactttctactgaatagaccaaaagaagaaaaatcacagctgttggaaaactgaaaaagcatatttgattgagaactgtgggaatatttaaattttactgaaggaacaataatgatgagatttgtaactgtcaactattaaatacattgattttt

SEQ ID NO: 8046 - DNA, 309 bp, Homo sapiens
  misc_feature 76, 242, 266, 285: n = A,T,C or G
gaacaaaagctggagcctcgcgcgcctgcaggtcgacactagtggatccaaagaattcggcacgaggcagccaggngaggctctctagtttaataaaaatgatggaaagactcttaatgcagactcttcttaagtgttatagggattttttcagcttattttgggtgcagtttccaatttttaaaaatgttgaggtaatctttcccaccttcccaaacctaattcttgtagatgcattatgngttgaaccaatgctttctcatgtntcaattctttgtatatgcnttcttttcagatgtattaaacaaa

SEQ ID NO: 8047 - DNA, 400 bp, Homo sapiens
  misc_feature 24, 29, 92: n = A,T,C or G
gacaataagctggagctccgcgcncctgnggtcgacactagtggatccaaagaattcggcacgagctcttttggggccctgggcaacacttnagcctccagggtaaattgagtaagaaaaaattagggttgctttcctgtttatttgtttttgcttctagaaggcttttatttggttttgtggatagttattttgtttcctgtgcatttctagcaagtcatcatttgttccatttaactggaattcctaggctaccctttgtcagacccacaggagttaatggaacacatcagctttttaaccttaaactaactttttggagtttaggcttattgatattttaagtatgttgagtataccttttgtaaacagaatttaagtcatatttctctctctgcct

SEQ ID NO: 8048 - DNA, 400 bp, Homo sapiens
  misc_feature 10, 17: n = A,T,C or G
aaaaaccganctttatntctggagctccgcgcgccctgcaggtcgacactagtggatccaaagtaattcggcacgaggaagctctggccagggatggggtgggggccaaaaggacagagcctggtatgtcttcatagtcattgagaatgtggagataccagtttgggtggggggtgatcaccaggggacctagggagatccccttcccaccctctctgttggcctcagagtcactcctgccccctctccctgacttggtgctcacatgcacctcactagggtttgtgaccagggtctggatgagcttgaatttgaatgaattgagtttgtatttctagaaccctgggtttttacatgtttggtctttttttgttttggtttgtcaccctcgataaaggaa

SEQ ID NO: 8049 - DNA, 400 bp, Homo sapiens
  misc_feature 24, 352: n = A,T,C or G
gaacaataagctggagctcgcgcncctgaggtcgacactagtggatccaaagaattcggcacgagcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgcttcttcggcagtctagccggcctgggtgcttaccagctgtatcaggatccaaggaacgtttggggtttcctagccgctacatctgttacttttgttggngtatgggaatgagatcctactactatggaaaattcatgcctgtaggtt

SEQ ID NO: 8050 - DNA, 400 bp, Homo sapiens
  misc_feature 15, 16, 43, 64: n = A,T,C or G
aaagcgcaacatttnnctggagcctgcgccgcgccctgcaggncgacactagtggatccaaagnaattcggcacgaggtcttgtgggaggaaaaaagatttattctaagagatttattcaaaggtcttttacctacaaggagtttacacttctgcaggttataaacatgtcaacaattctttggcacttaatttttattcttcagcctagattaaggtttttttacatacttatcaactactacacaaaaatcaaaacccctccattcttaacttttaaatacgtcctcagtaaaggagacaagaccagaaattatttcacagaagatatttacaaaaattatagccaagacataggagacaatttagatatgctacactataaaaatggctaccatggg

SEQ ID NO: 8051 - DNA, 389 bp, Homo sapiens
gacaaaagctggagctcgcgcgcctgcggtcgacactagtggatccaaagaattcggcacgagctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctcttttttttgctgttccaccaaatacaattcaaatgctttttgttttatttttttttaccaattccaatttcaaaatgtctcaatggtgctataataaataaacttcaacactctttat

SEQ ID NO: 8052 - DNA, 400 bp, Homo sapiens
  misc_feature 357: n = A,T,C or G
gacaataagctggagctcgcgcgcctgcaggtcgacactagtggatccaaagaattcggcacgagctgtgcctcagcgctccacattgccttactaaatgacataaagtgaacagcacacacacaaaagacctattgcaccagttaggataagccaacttcaaacatctgtcacccggagacagagcagttctggagctggctaattcagcagctcaaagtaatttttatagcgatactgtctgccattcttaacatgtaaacaatgacactatcctagtctcaggtgatggcagcagtttgaggagacaccagtggattttctatatctctttttatcttataaaagagggggagntccttccctacccccacacaggcacctctgtagatcccattgg

SEQ ID NO: 8053 - DNA, 400 bp, Homo sapiens
gaaaaagctggagctcgcgcgcctgcaggtcgacactagtggatccaaagaattcggcacgagcttcactgtcctcacagaggcagaccctgcagccagtaggagagcttcgggagtgggtgcccagggttaggtgtgggaggcatggggcaggaccatcagtaaagacagggccaggtgcagtggctcctgcctgtaaccccagtgctgtgggaggccaaggtggtaggatcgcttgaacccaggagttcaagtccagcctggacaacgtagggagacccttgtctctacaaaaaataaaaaaattagccaggtgttgtggcacgtacctgtagtcctagctactcaggaggctgaggtggggaggatcacttgagccttgggaggtgggagggttgca

SEQ ID NO: 8054 - DNA, 400 bp, Homo sapiens
  misc_feature 214, 298, 317, 327, 338, 378: n = A,T,C or G
gaaaaaagctggagctcgcgcgcctgcaggtcgacactagtggatccaaagaattcggcacgagctcgtgccgaattcggcacgagccccgctcccccaaaaatttgaatttttttttcaacactcttacacctgttatggaaaatgtcaacctttgtaagaaaaccaaaataaaaattgaaaaataaaaaccataaacatttgcaccacttgnggcttttgaatatcttccacagagggaagtttaaaacccaaacttccaaaggtttaaactacctcaaaacactttcccatgagngtgatccacattgttaggngctgacctanacagagatgancctgaggtccttgttttggttttgttcataatacaaaggngctaattaataagtatttttca

SEQ ID NO: 8055 - DNA, 393 bp, Homo sapiens
gaaaaagctggagctcgcgcgcctgcaggtcgacactagtggatccaagaattcggcacgagttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaaccctcattcacacgagaaaacaccctcatgttcatacacctatcccccattctcctcctatccctcaaccccgacatcattaccgggttttc

SEQ ID NO: 8056 - DNA, 397 bp, Homo sapiens
  misc_feature 6: n = A,T,C or G
gaaaangctggagctcgcgcgcctgcaggtcgacactagtggatccaagaattcggcacgagctgcaacgtccgacagaacgaggggacgtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggt

SEQ ID NO: 8057 - DNA, 312 bp, Homo sapiens
  misc_feature 106: n = A,T,C or G
gaaaataagctggagctcgcgcgcctgcaggtcgacactagtggatcaaagaattcggcacgagctcgtgccgaattcggcacgagaaactttgtgcctttgaccntctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccact

SEQ ID NO: 8058 - DNA, 113 bp, Homo sapiens
  misc_feature 2, 79: n = A,T,C or G
gnaaaagctggagctcgcgcgcctgcaggtcgacactagtggatccaagaattcggcacgagctcgtgccgaattcggnacgaggaagagagaagatagtctcgagttttttt

SEQ ID NO: 8059 - DNA, 400 bp, Homo sapiens
  misc_feature 276: n = A,T,C or G
gaaaaagctggagctcgcgcgcctgcaggtcgacactagtggatccaaagaattcggcacgagcccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggntggaagtaccaggcagtgacagccaccctggagggagaagaggaaagagaaagccaagatccacctaccggaagaagaaacagctcatgaggctacggaaacaggccgagaagaacgtggagaa

SEQ ID NO: 8060 - DNA, 400 bp, Homo sapiens
  misc_feature 254: n = A,T,C or G
gacaaaagctggagctcgcgcgcctgcggtcgacactagtggatccaaagaattcggcacgagctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagngtgggatattgaattatgggaggctctgactgtctcgggtgtcagcttaacattccacagatggggggttaagtttttatatcctataatacaaagcatattaaatggcaatatgggagtcagtcctgcatttaatgtcttgaaca

SEQ ID NO: 8061 - DNA, 400 bp, Homo sapiens
  misc_feature 7, 28, 31: n = A,T,C or G
gaccaantgctggagctcgtgcgcctgnggncgacactagtggatccaaagaattcggcacgagacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagt

SEQ ID NO: 8062 - DNA, 400 bp, Homo sapiens
  misc_feature 2, 3, 371: n = A,T,C or G
gnncgacactagtggatccaaagaattcggcacgagcgttcgttgggcggtgctggtttttcgctcgtcgactgcggctcttcctcgggcagcggaagcggcgcggcggtcggagaagtggcctaaaacttcggcgttgggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccggggaccgtggcgctttcgagagattcgtcggttatcagaagtcgaccgagctgctcatccggaagctgcccttccagaggttggtgangggagatccgcgcaggatttcaaaaaccg

SEQ ID NO: 8063 - DNA, 185 bp, Homo sapiens
gctggagctcgcgcgcctgcaggtcgacactagtggatccaaagaattcggcacgagctatctcatgtgcaaagacacacataggctcaaagcgatggaggaaaatttaccaagcaaatggaaagcagaaaaaagcaggggttgcaatcttagtttctgacaaaacagactttgaatcaacaaag

SEQ ID NO: 8064 - DNA, 400 bp, Homo sapiens
  misc_feature 9: n = A,T,C or G
gaacaatangctggagctcgcgcgcctgcaggtcgacactagtggatccaaagaatcggcacgagcggcacgagcaaatacaaagttaacaagaaaaaggaacattaacagaaatctctaaaagttagaaatgtacaggtaaagactaaaaattgataggaggtttagttgtgtttcctacccggaaatcaaaatttgaaaagcagtaaaggcatttgccctgctctgcctccttcacataggtgcatttcctgtccatttcagaagctaattatgaaatggccacacaactggatgtttctgtttataaaatagtgttccttggaggggcttgcaacatctaaatatcttatgtcagaataaaagccactgagatccaaagaagtggactaaacttgac

SEQ ID NO: 8065 - DNA, 241 bp, Homo sapiens
  misc_feature 185, 221: n = A,T,C or G
gaacaataagctggagcctcgcgcgcctgcaggtcgacactagtggatccaaagaattcggcacgaggcaaggcggcggcaggagaggttgtggtgctagtttctctaagccatccagtgccatcctcgtcgctgcagcgacacacgctctcgccgccgccatgactgagcagatgacccttcgnggcaccctcaagggccacaacggctgggtaacccanatcgctactaccccgcagtt

SEQ ID NO: 8066 - DNA, 341 bp, Homo sapiens
gacaaaagctggagctcgcgcgcctgcaggtcgacactagtggatccaaagaattcggcacgagctaatttcaggcttggtagcttgtaggaactgaaattgcaattaaaacctttataaactcaaactaaatcatgaattacagaaaaagtccattcttccaaaacttgatgttaccacacttacaagtttaaaatatgaagtcgactgtttaaaggattctgcatatattctagtgtgcacattcagaaacatttttcttggaaaaagtacccaacattttttataactgcacatattaatttattgccagaataaattgcattgcatgctaaataaag

SEQ ID NO: 8067 - DNA, 358 bp, Homo sapiens
  misc_feature 337: n = A,T,C or G
gaaaaagctggagctcgcgcgcctgcaggtcgacactagtggatcaaagaattcggcacgagtcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaanaaagggagaatggaaaaaaga

SEQ ID NO: 8068 - DNA, 312 bp, Homo sapiens
  misc_feature 14, 24, 224, 284: n = A,T,C or G
gaacaatttgctgnagctcgtgcncctgagttcgacactagtggatccaaagaattcggcacgagggggaaggtgggagagccaggcaggggcggccttgggaatcctgccacagacaggggcgagggccctgtggagctggcccatctggccgggcccgggagcccagaggctgaggagtggggcagccccccatggaggccctgaaggaagtgggagccacntgtaagggtcctgtccccaagtgggtcttgtgccaggtcttccccgccgggggaaacctntttggcctttccaatggcaagcagggaa

SEQ ID NO: 8069 - DNA, 400 bp, Homo sapiens
  misc_feature 9: n = A,T,C or G
gaacaatangctggagctcgcgcgccctgcaggtcgacactagtggatccaaagaattcggcacgaggttttgaggcttgttccttcgtggaaacatctggatgcagaagttaggctgtacaactatccaggggagctttaagtgagccaagtggaccctcagcaccacctcagagtgttctaagctaccgtctggtgtttgggactcagggaagtccttttggtatgatcagactagccctttatgtgactatccttgtgtgttactctcattaaaatattgatttttgccatgtaagggaagattggaatagcacaggcagccgaataaggattttaatgaaacattggagaatggcttcaagttaatctgtgaatgctttgtcattgtcccatccct

SEQ ID NO: 8070 - DNA, 400 bp, Homo sapiens
  misc_feature 8, 358: n = A,T,C or G
gaacaatnagctggagctcgcgcgcctgaggtcgacactagtggatccaaagaattcggcacgagcggaagtaacgtgttgtgctcctacagactgcaaccctgctaggggtccttctcctgggttatggctacttttggctcctggtacccaaccctgaggcccggcttcagcagttgggcctcttctgcagtgtcttcaccatcagcatgtacctctcaccactggctgacttggctaaggtgattcaaactaaatcaacccaatgtctctcctacccactcaccattgctacccttctcacctctgcctcctggtgcctctatgggtttcgactcagagatccctatatcatggngtccaactttccaggaatcgtcaccagctttatccgcttctg

SEQ ID NO: 8071 - DNA, 400 bp, Homo sapiens
gaacaataagctggagctcgcgcgcctgcaggtcgacactagtggatccaaagaattcggcacgaggtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggcccgtt

SEQ ID NO: 8072 - DNA, 399 bp, Homo sapiens
  misc_feature 264: n = A,T,C or G
gacaaaagctggagctcgcgcgcctgcaggtcgacactagtggatccaaagaattcggcacgagctcgtgccgaattcggcacgagagcaagtgagaatttggtataacatctgtgtttctgaagtttgtatttttaagccgtatatgaaaactcagttgcctttccatatgatgcgttactttgcacacattttgaagaggaattcttagaaacaattaataagagcatatatggtaattgagactacagaatttaaaatggnctgtgtaagtctttattttctcgtaacatgacttgggtaccaattcaggctaatgactggtaaagaaaagaacagacactaatttgcaagtagctcctgaagttgattgctttaagaaaaaccttagcctttatt

SEQ ID NO: 8073 - DNA, 104 bp, Homo sapiens
gacaataagctggagctccgcgcgcttgcggtcgacactagtggatccaaagaattcggcacgagctcagaaattggctttaaaaaaaacaaccaccaaaaaaa

SEQ ID NO: 8074 - DNA, 400 bp, Homo sapiens
  misc_feature 175: n = A,T,C or G
gaaaaagctggagctcgcgcgcctgcaggtcgacactagtggatccaagaattcggcacgaggctcgggatgccttccgagttttctgcaacttcacagcagggggtgagacctgtgtgacgcctagggatgacgtcacgcagttctcttacgtggactcagagggctccccagngggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgcttggaggtgccaacgccctgtgctggag

SEQ ID NO: 8075 - DNA, 400 bp, Homo sapiens
gaacaaaagctggagctcgcgcgcctgcaggtcgacactagtggatccaaagaattcggcacgagccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaattttgaagaattgggggcctgaaaaagcggctcatcccagatggctgggggggtc

SEQ ID NO: 8076 - DNA, 400 bp, Homo sapiens
gacaaaagctggagctcgcgcgcctgcaggtcgacactagtggatccaaagaattcggcacgagccagttaagtgcataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatataccttgctttaattcttaagcataagtaaacatgatataaaaatatatgctgaattactt

SEQ ID NO: 8077 - DNA, 298 bp, Homo sapiens
  misc_feature 291: n = A,T,C or G
gacaataagctggagctcgcgcgcctgcaggtcgacactagtggatccaaagaattcggcacgagcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatcctttttttctttgcacaaataaacagtgaattctcgttnaaaaaaa

SEQ ID NO: 8078 - DNA, 347 bp, Homo sapiens
acaaaagctggagctcgcgcgcctgcaggtcgacactagtggatccaaagaattcggcacgagtcccagtccccgttgtaggacatcacatttataaatccaggctttagtcttctgggctccaccagtctctgccccaccatattcctttgtcactacctctaagtttttttccccacttgaggatttggagttaaacgaactcaaaatgtcttgtcattgtatgtattcttgcccctgctttgaaaacagggccatgggaactctgtttatgccctgttttaatggtttctgttttatgttttactgttaatatgaaaataaaagaatttgctatgtaaaaaaaa

SEQ ID NO: 8079 - DNA, 399 bp, Homo sapiens
gacaaaagctggagctcgcgcgcctgcaggtcgacactagtggatccaaagaattcggcacgagggctcttgcctaatgggatatattttctctttgaatgatttggcaagatatcagatgagagaagttgaataaatgttagaagaacatagaaaaaataggttatacacattgggtttctgaagaaatgatgtcattggagaaacaaaacttttattgatttctggaaacatttagggccaattttttgtgtaagtaatttgaatttatgatgatatctctgaccactttttgatattttttctggttcaggtgagtggtgtcattgagcaaacacaaagtcgggctcatccaaggatgagattttgccagagaaaggatgagcagcaagtcaggga

SEQ ID NO: 8080 - DNA, 399 bp, Homo sapiens
gacaaaagctggagctcgcgcgcctgcaggtcgacactagtggatccaaagaattcggcacgagagagaatggtttcccaggccagatgggaattcgtggccttccgggcattaaggggccccctggtgctcttggtttgaggggacctaaaggtgacttgggagaaaagggggagcgtggccctccaggaagaggtcccaacggtttgcctggagctataggtctcccaggtgacccaggccctgccagctatggcagaaaatggccgagacggtgagcgaggccccccaggggtggcaggaattcctggagtgcctggacccccgggacctcctgggcttcccggtttttgtgaacccaccctcctgccccatgcagggttggtcagcgaagcattt

SEQ ID NO: 8081 - DNA, 374 bp, Homo sapiens
  misc_feature 2: n = A,T,C or G
angaacaaaagctggagctcgcgcgcctgcaggtcgacactagtggatccaaagaattcggcacgaggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagctttccatgctgactgatggttaaataatgtgattg

SEQ ID NO: 8082 - DNA, 400 bp, Homo sapiens
gacaataagctggagctcgcgcgcctgcaggtcgacactagtggatccaaagaattcggcacgagtgacatcccatttggagagcaccagagggcatgctgcggaacgaatgaatcagttaaaaatggttttaaagaaaatgcaagaggctccagagtcagctacagttatatttgcaggagatacaaatctaagggatcgagaggttaccagatgtggtggtttacccaacaacattgtggatgtctgggagtttttgggcaaacctaaacattgccagtatacatgggatacacaaatgaactctaatcttggaataactgctgcttgtaaacttcgttttgatcgaatatttttcagagcagcagcagaagagggacacattattccccgaagtttg

SEQ ID NO: 8083 - DNA, 400 bp, Homo sapiens
gacaaaagctggagctcgcgcgcctgcaggtcgacactagtggatccaaagaattcggcacgagggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgat

SEQ ID NO: 8084 - DNA, 400 bp, Homo sapiens
  misc_feature 3, 12: n = A,T,C or G
ttnagtgggacnctagtggatccaaagaattcggcacgagagacgctgtagctttgtgagcattccagcttggccgctgcttcccttgcagaaaagaacattgagagagaattccagggaccacccaagaggtcttcagttctttcactttctttacagcttcaatgttgttaccacccttccctgtcctgtactccagtccctgtacgtaacagcaacaaaccctgatatgtacaaagtccttgaaaattattgaaattaaaatttttttctcctaagtctaggctttaaatacctaaacaatagggctatgttttataaaatttattttgtaggagtatttagatccttctagattttaacaaatatagaattgaaataatgggttttaaaaatttat

SEQ ID NO: 8085 - DNA, 181 bp, Homo sapiens
  misc_feature 113: n = A,T,C or G
aaggacaaaagctggagctcgcgcgcctgcaggtcgacactagtggatccaaagaattcggcacgaggagtacttctagagcggccgcgggcccatcgattttccacccgggnggggtaccaggtaagtgtacccaattcgccctatagtgagtcgtattacaattactggggcccgggaa

SEQ ID NO: 8086 - DNA, 192 bp, Homo sapiens
gaacaataagctggagctcgcgcgcctgcaggtcgacactagtggatccaaagaattcggcacgaggcctgtaatcccagctacttgggaggctgagacacaggaatcgcttgaaccagggaggcagaggttgcagtgagccaagaccgcaccactgcactccagcttggatgacagagtgagactccatat

SEQ ID NO: 8087 - DNA, 399 bp, Homo sapiens
  misc_feature 303: n = A,T,C or G
gacaaaagctggagctcgcgcgcctgcggtcgacactagtggatccaaagaattcggcacgagcatgggcccgcgttcgcacccaaaaccgtgaagaaggcggcccgggtcatcatagaaaagtactacacgcgcctgggcaacgacttccacacgaaacaagcgcgtgtgcggaggagatcgccattatccccagcaaaaagctccgcaacaagatagcaggttatgtcacgcatctgatgaagcgaattcagagaggcccagtaagaggtatctccatcaagctgcaggaggaggagaganaaaaggagagacaatttatgttccttgaggtctcagccttggatcaggagatttttggaagtagatcctgacacttaagggaaatgctgaagcttt

SEQ ID NO: 8088 - DNA, 352 bp, Homo sapiens
  misc_feature 51: n = A,T,C or G
gacaaaagctggagctcgcgcgcctgcaggtcgacacctagtggatccaangtcttcggcacgagtggaggtggtggcggtggaggacagcagcgagctggtgactggaagtgtcctaatcccacctgtgagaatatgaacttctcttggaggaatgaaatgcaaccagtgtaaggcccctaaaccagatggcccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaaaaaaa

SEQ ID NO: 8089 - DNA, 399 bp, Homo sapiens
  misc_feature 10, 136: n = A,T,C or G
cttgaggtgngacactagtggatccaaagaattcggcacgagactccatttcccacttccacccccgttagcttcctgcaggactctatccctggcttccccttcagaccttgcaatcacaaaaggttcttctggngagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagc

SEQ ID NO: 8090 - DNA, 348 bp, Homo sapiens
gacaaaagctggagctcgcgcgcctgcaggtcgacactagtggatccaaagaattcggcacgagaattcaaggtgaattaaaagtttgaatgttagacctaaaaccataaaaaccctagatgaaaacctaggcaataccattcaggacataggcacgggcaaggattttatgactaaaataccaaaagcaaaggcaacaaaagccaaaatagacaaatgggatctaattaaactaaagagcttctgcacagcaaaagaaactacaatcagagtgaataggcaacctacagaataagagaaaatttttgcaatctacccatctgaatctacaaagaactcaaaccaatt

SEQ ID NO: 8091 - DNA, 400 bp, Homo sapiens
  misc_feature 3: n = A,T,C or G
ganaataagctggagctcgcgcgcctgcaggtcgacactagtggatccaaagaattcggcacgagcagtaatgcatgaagagtgccgggcatggtgctgagccctgttcctgctctccctccagggctgctgagctagaattcccacctatgtctttccaagggactgttcacggcttgggacttggtctctgtcctgccccatcctcgtcacttgggaccacgagccctggttcagtcacccagggaagcctcccagcggctcatgaagcatcgagctccaagcccagatgccaagctccctggctgagctgaatgatgtcactcatggtggacgcgttctgctcacgggcccagagccctgtgaaatgcatcaaggtcctctccgctggccagcagca

SEQ ID NO: 8092 - DNA, 400 bp, Homo sapiens
  misc_feature 2: n = A,T,C or G
gnaaaagctggagctcgcgcgcctgcaggtcgacactagtggatccaagaattcggcacgagggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctca

SEQ ID NO: 8093 - DNA, 142 bp, Homo sapiens
gacaataagctggagctcgcgcgcctgcaggtcgacactagtggatccaaagaattcggcacgagagagagtgtgtgtttgtgtgtttcaaggtcagaacaggtttttttgtttttgttttttgttctttgttttttttttt

SEQ ID NO: 8094 - DNA, 306 bp, Homo sapiens
  misc_feature 26, 54, 151: n = A,T,C or G
gaacaataagctggagctcgcgcgcntgcggtcgacactagtggatccaaaganttcggcacgagcatcctaaaatccaaataatcttgtaacctctttctctagtgattcctctccgattctgttgaaaaagcataacataaatgttggngagtctagactctaatggatatgtttatataattccaaacactcaggtgtgtgaatgcatttaaaaacattaatggaaaataatgctgataatattttaaattgatcatgcaattccttcaattatgatggaaagacttgaactttctgaaataa

SEQ ID NO: 8095 - DNA, 310 bp, Homo sapiens
  misc_feature 5, 172, 262, 269, 280, 298: n = A,T,C or G
gacantaagctggagctcgcgcgcctgcaggtcgacactagtggatccaaagaattcggcacgaggagctattgatgtgcaatcttagaaaggagacatgaaaaaaggagaaaaggaaagacagaagtgtatatatatattatttaaacaaacaaaaagaaggtgcgttacntatttttttttcacccgggaaagaggtgagaggatgggaaggagcagcccaggcgtgggaagcggcgagatcctcggggctggggggggncccccgntttgctacctncccctgggaaaaacgccnggggccccccaa

SEQ ID NO: 8096 - DNA, 298 bp, Homo sapiens
  misc_feature 1, 6, 45, 240, 292: n = A,T,C or G
ntgganctcgcgcgcctgcaggtcgacactagtggtatccaaagnaattcggcacgagcggcacgaggctaagtaatctttcatttcttacagaagacgatcaccttctccttattatagtcgatatagatcacgatcaagatctcgttcctacagcccaagtatgtgaactttacttttgtagcataaaaaacctcatttctaattaatggcttactttagaatattagagtataaggnggaagggggcagttaatagttggaaaaatatgaggcaaattaaactataatnggtaac

SEQ ID NO: 8097 - DNA, 396 bp, Homo sapiens
acaataagctggagctcgcgcgcctgcaggtcgacactagtggatccaaagaattcggcacgaggtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaa

SEQ ID NO: 8098 - DNA, 400 bp, Homo sapiens
  misc_feature 2, 21: n = A,T,C or G
anaagctggagctcgcgcgcntgcggtcgacactagtggatccaaagaattcggcacgaggaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcaccgatgccatccttgaggacttggtcttcccaagcgaaattgtgggcaagagaatccgcgtcaaactagatggcagccggctcataaaggttcatttggacaaagcacagcagaacaatgtggacacaaggttgaaactttttctggtgtctataagaagctcacgggcaaaggatgttaa

SEQ ID NO: 8099 - DNA, 400 bp, Homo sapiens
  misc_feature 6, 26, 157: n = A,T,C or G
gaacantaagctggagctcgcgcgcntgcaggtcgacactagtggatccaaagaattcggcacgaggctgcttgaggctctggactgcatcctaccaccaactcgtccaactgacaagcccttgcgcctgcctctccaggatgtctacaaaattggnggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgcttggtgacagcaaaaaatgacccaccaatggaagcag

SEQ ID NO: 8100 - DNA, 281 bp, Homo sapiens
acaaaagctggagctcgcgcgcctgcaggtcgacactagtggatccaaagaattcggcacgagaaaaaagcatgttttaaactctaggctaacaactaaaaattctttttaaatgtaacttaatagaaggaaaatggaatcatgtagaaacatttgattaatccaaaggaagtcaagggaagataaaggtacataaaagtagagcacaaatagtacaatggcgaatatagacccaagcacatcagtagttacatggaggaagactgtgtaacttaagaatt

SEQ ID NO: 8101 - DNA, 265 bp, Homo sapiens
  misc_feature 5, 77, 132, 201, 218, 221, 229: n = A,T,C or G
gacanttatgctggagctcgcgcgcttgaggttcgacactagtggatccaaagaattcggcacgagctcgtgccganttcggcacgagcggcctccgagttcttcaggtctgggaagtatgacctggacttnaagtctcccgatgaccccagcaggtacatctcgcctgaccagctggctgacctgtacaagtccttcatnaaggactacccaggggngtntatcgaanatccctttgaccaggatgactggggagcttggaaaa

SEQ ID NO: 8102 - DNA, 111 bp, Homo sapiens
  misc_feature 23, 52: n = A,T,C or G
acaaaagctggagctcgcgcgcntgcaggtcgacactagtggatccaaaganttcggcacgagctcgtgccgaattcggcacgagagagagagagagagagagagaagaga

SEQ ID NO: 8103 - DNA, 268 bp, Homo sapiens
  misc_feature 251, 255: n = A,T,C or G
gacataagctggagctcgcgcgcttgcggtcgacactagtggatccaaagaattcggcacgagcggcacgaggaaaaagaaacatagttgtagtacttagcctacctagaccagcaagcattcatttttagctcgctcattttttaccatgttttccagtctgtttaacttctgcagtgccttcactacactgccttacataaaccaaatcacaataaagttcatattcagtaaaaaaaaaaaaaaaaaancctngggccgaattcgg

SEQ ID NO: 8104 - DNA, 398 bp, Homo sapiens
  misc_feature 231: n = A,T,C or G
aaaaccgaacattaagctggagctcgcgcgcctgcaggtcgacactagtggatccaaagaattcggcacgagccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtagtttacagactgagngacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgtttt

SEQ ID NO: 8105 - DNA, 400 bp, Homo sapiens
  misc_feature 6, 8: n = A,T,C or G
gaacantnagctggagctcgcgcgcctgcaggtcgacactagtggatccaaagaattcggcacgagccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctacttcagctgcttaagctggcccacaagtacagaccagagacaaagcaagagaagaagcag

SEQ ID NO: 8106 - DNA, 400 bp, Homo sapiens
  misc_feature 2, 7, 100, 181, 208, 212, 237, 261, 274, 296, 304, 305, 348,350: n = A,T,C or G
cncctgnggtcgacactagtggatccaaagaattcggcacgagtgagaaccactggagtggctggggctggccagaggtcaccgtttctccttcctgtgngctccagtggcttttgaagacactgggttgggacctttttcctgaagagagctggtttgtagccaggagctactggcaccntaccccgagcatctctctctggaagcngctncagggggcatgtccggtttctctgngcttctgaaacccccttctcacgnttcaggccccagnttttaactcaaggccctggggncaggggcnntttaatttgatgattgacaggaggacacagggtttttggccancnaaaaagggaaaaaccaaggcttgggggggaaggggaaagggtggtggtgg

SEQ ID NO: 8107 - DNA, 193 bp, Homo sapiens
  misc_feature 3: n = A,T,C or G
tcngacactagtggatccaaagaattcggcacgaggttgggagctatcctgaaggttaagtttattaaaatttagggtaaagtagtaagtagttccaagttcaggagatacacctgaataattctgaccacagtataaattttgcaatatgtcgaaaatgaaatcccaagcataagcgtaacataatggagta

SEQ ID NO: 8108 - DNA, 399 bp, Homo sapiens
  misc_feature 5, 24, 90, 390: n = A,T,C or G
gacantaagctggagctcgcgccncctgaggtcgacactagtggatccaaagaattcggcacgagccccgtttccagtttcttatagtgnatgcttgggaaacaagatttaaggagcctctgttttggaagggctgtctgtgattgaacgtgaaatgtgtagtgccattgggaccacgaagggaattcttgcacatgctcgtgcttggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgngtgtgattg

SEQ ID NO: 8109 - DNA, 112 bp, Homo sapiens
  misc_feature 2, 3, 67: n = A,T,C or G
gnnggagctcgcgcgcctgcggtcgacactagtggatccaaagaattcggcacgagcggaggtgcanggtcctggtgcttgatggtcgaggccatctcctgggccgcctggc

SEQ ID NO: 8110 - DNA, 200 bp, Homo sapiens
  misc_feature 172: n = A,T,C or G
gaaaataagctggagctcgcgcgcctgcaggtcgacactagtggatcaaaagaattcggcacgagcagctctgacagcccctcctccaggaaggccttccaggacttcctcctctgggtcctctagctctgaccctacagggactccagatctcaacctgttccctggaagnagggcctgctctccatcccagtgaaata

SEQ ID NO: 8111 - DNA, 237 bp, Homo sapiens
  misc_feature 24, 113, 125, 127, 173, 176, 180: n = A,T,C or G
gaacaataagctggagctcgcgcncttcgcgggtcgacactagtggatccaaagaattcggcacgagcccgtcccacggaggcccgcggggtgggggctggggggggggcccncgaccgttccgntnttccggccaggtgcttttctgtcaatttctatggaatgcaaaaggnggntttngttttattttgtttttttggaaagcttaagaaaaaaatctacatcttatacttgagc

SEQ ID NO: 8112 - DNA, 154 bp, Homo sapiens
  misc_feature 7, 29, 30: n = A,T,C or G
gaaatangctggagcttcgcgcgccctgnnggtcgacactagtggatccaaagaattcggcacgagccccaggggcctccacaggccgctgatgacagcgatacagtacttaagtgtctgtgtagacaaccaaagaataaatgattcatggttt

SEQ ID NO: 8113 - DNA, 400 bp, Homo sapiens
  misc_feature 128, 370, 375: n = A,T,C or G
gaacaataagctggagctcgcgcgcctgcaggtcgacactagtggatccaaagaattcggcacgagctcgtgccgaattcggcacgaggtcaagagcaggggtgggccggggaggggtcctttgcggngagctatgtttacatgacacagtgtgccaaagtgacttactgcggttgcgttagtttctagtcatcaggactatctcaccctcccactcctgtttttaaaactcagaattctttcctaagagcccttcgagcaaagcgtgccgaagttagttgtcttctctgtgctggtcctttcttatgtcctcataaaagctcagatgatggtatctgtgagtattgttttgcaaattcaaaatataggnttggnaattttttttttccaggggattttt

SEQ ID NO: 8114 - DNA, 328 bp, Homo sapiens
  misc_feature 9: n = A,T,C or G
gctggagcntcgcgcgccctgcaggtcgacacctagtggatccaaagaattcggcacgaggaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggttttttttt

SEQ ID NO: 8115 - DNA, 400 bp, Homo sapiens
  misc_feature 8, 236, 343, 345, 374, 390, 395: n = A,T,C or G
gaaaattnagctggagctcgcgcgcctgcaggtcgacactagtggatccaaagaattcggcacgagccatcccccaccaggtgagcctgggaactgtttgtagcggctgagggagggaggagggctggtgggtctgtgggaagaggtgcccaaagccctgtgccctggggctctgtgaacaggaagacatgagcctcagggctgagggtgggaagcccccgcccagcccaggcctncgcctacccccctggctgccccctcaccataccgcaacgggcacaagccacagcccccttggagtaactgaggctctcgtctgtgcagaaaaagacagcttgcaggngntccaggcaggggtggatcaggagcccatncttagggtctcagagnggggngacag

SEQ ID NO: 8116 - DNA, 400 bp, Homo sapiens
  misc_feature 18, 124: n = A,T,C or G
gacaataagctggagctngcgcgcctgcaggtcgacactagtggatccaaagaattcggcacgagttatactcctgttcccaggatcttgagctttagtgtgctatacctatgtgtcttatcgngggccactgtgccaataaacaaaaacaactgtttggtttacctcagttgcagtagttattttcatttagaagttgttctcagattattgtttcagttatatagaggattactagactagttatgaagaaaccccactacattcaatggaattggtgcttaaaatctcatcgatgtgctgtctctggagtgataagaaagggctacatctcccgaaatgatttctttacgtcatgtattggtttccttcttcaccttgaacttttgttgaactgtat

SEQ ID NO: 8117 - DNA, 236 bp, Homo sapiens
  misc_feature 5, 19, 37, 43, 60, 213: n = A,T,C or G
ctggnactcgcgcgcctgnggtcgacactagtggatncaaagnaattcggcacgagccgnttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctntgggcttctggaggcaaggatgg

SEQ ID NO: 8118 - DNA, 160 bp, Homo sapiens
  misc_feature 51: n = A,T,C or G
gaaaataagctggagctcgcgcgcctgcaggtcgacactagtggatccacnagaattcggcacgagatcaagtcggtgaactgcccctggcctgtgtcccccagagcagcccagggtcctgccagagtctgcaggggacagccctcgttttttaagtctt

SEQ ID NO: 8119 - DNA, 400 bp, Homo sapiens
gaacaataagctggagctcgcgcgcctgcaggtcgacactagtggatccaaagaattcggcacgagggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaaggatttgatgcttttctctcagcataggtatgcttactatgaccttccaagttt

SEQ ID NO: 8120 - DNA, 400 bp, Homo sapiens
  misc_feature 105: n = A,T,C or G
gacaaaagctggagctcgcgcgcctgcaggtcgacactagtggatccaaagaattcggcacgagctcgtgccgaattcggcacgagcaaacctaccgagcctggngatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagt

SEQ ID NO: 8121 - DNA, 342 bp, Homo sapiens
  misc_feature 29, 223: n = A,T,C or G
gaacaataagctggagctcgcgcgcctgnagggtcgacactagtggatccaaagaattcggcacgagacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggngtcattgctcaagaaaaactggcagaatgtccgggccttatatatcaagagcaccatgggcaagccccagcgcctatattaaggcacatttgaataaattctattaccagttcaaaaaa

SEQ ID NO: 8122 - DNA, 400 bp, Homo sapiens
  misc_feature 107: n = A,T,C or G
gacaataagctggagctcgcgcgcctgcaggtcgacactagtggatccaaagaattcggcacgaggtttcattaaagggaacggttatcatcattgcaaatcatggngacagaattgatatcccacctggagcagtattagagaacaagattgtgtctggaaaccttcgcatcttggaccactgaaatgaaaaatactgtggacacttaaataatgggctagtttcttacaatgaaatgttctctaggattctaaaataggcaggtactttactatgttactgtaccctgcagtgttgatttttaaaataggagttttctgcagtatgcttttagtctaagaaaagcacagatggagcaatactttccttctttgaagagaatcccaaaagttagttcat

SEQ ID NO: 8123 - DNA, 400 bp, Homo sapiens
  misc_feature 6, 317, 323, 360, 385, 386: n = A,T,C or G
aacaanaagctggagctcgcgcgcctgcaggtcgacactagtggatccaaagaattcggcacgagtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaagnggtctnctctgacttcaacagcgacacccactcctccaccttngacgctgggggctggcattgccctnnaacgaccacctttg

SEQ ID NO: 8124 - DNA, 400 bp, Homo sapiens
  misc_feature 3: n = A,T,C or G
ganaataagctggagctcgcgcgcctgcaggtcgacactagtggatccaaagaattcggcacgagggggagcactggtaaaacacagtatttatttttttacctcctttaagaggacttggaggtaagttgcattcattcactcaagtttccctcttgctgtctaatagaagcttactttttgctatatcagcatttgttacagccaatatttaaggacaaaatttagaaaatatatcatttcctggcccatcatcaaactaatacagcttaaccttgcagctaccaacttttgtgtcaagctagatatctttatttgatatctaaggtgcaagaccaacaatatattaagagatctgtagacatgaaggcaaagctcttgtattttttttcatccaaac

SEQ ID NO: 8125 - DNA, 400 bp, Homo sapiens
  misc_feature 3, 369: n = A,T,C or G
ganaataagctggagctcgcgcgcctgcaggtcgacactagtggatccaaagaattcggcacgagcaattttggaagattcatggaaataatgcataggaactacttagcactctgcatggtacatagaaactgctcaaatatccttaactctcattatcattaccagctgtcctattgttttaggaggataaaatacatatcttaagttaaaatgtttttttatttggttgtgtcgttttgcacggaatagtagggagaagcctcctgatttgtttctctcgtggaaatttgatctgtatctgctaaaaaatgtttatcccttcttctgtaaaagggactctttcccctacggtgagtagtatatagngaatatcaatgctgatacatttaaactgtgg

SEQ ID NO: 8126 - DNA, 375 bp, Homo sapiens
gacaaaagctggagctcgcgcgcctgcaggtcgacactagtggatccaaagaattcggcacgagctcgtgccgaattcggcacgaggctgtttgaatcttgaatttaccattcacaatctgtgtggcctggttgagcttcttaccaccctgagcctcggttttctcatctgtaaaatggagctaataagatctttcttgtatgactttggtgaattaaataagaaaatgaatgtgaagtgcctggtacattttggttgttcaatatgtcctgataaatttcctcattctgtcctgataaatacttgattctgacttagtcatttttgaaaatgttcaggtctgattgggagataaactggattaagggtgccatt

SEQ ID NO: 8127 - DNA, 400 bp, Homo sapiens
  misc_feature 3, 119: n = A,T,C or G
ganaataagctggagctcgcgcgcctgcaggtcgacactagtggatccaaagaattcggcacgagctcgtgccgaattcggcacgagataaattccaaagtttttatttgctccatggngtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttggggattcatcattaagaactgaggctcactgt

SEQ ID NO: 8128 - DNA, 313 bp, Homo sapiens
  misc_feature 6, 118, 166, 271, 285, 299: n = A,T,C or G
gaacanttagctggagctcgcgcgcctgcaggtcgacactagtggatccaaagaattcggcacgagccgcggcgcgcccctcgccaaggtggtcttccgggatccgtatcggtttaanaagcggacggagctgttcattgccgccgagggcattcacacgggccantttgtgtattgcggcaagaaggcccagctcaacattggcaatgtgctccctgtgggcaccatgcctgagggtacaatcgtgtgctgcctggagaaaaacctgganaccgggcaagctgncccggcattagggnaactttgcccccgt

SEQ ID NO: 8129 - DNA, 400 bp, Homo sapiens
  misc_feature 3: n = A,T,C or G
ganaataagctggagctcgcgcgcctgcaggtcgacactagtggatccaaagaattcggcacgagtctcgctctagggagattcttcaagcaatcactatgtcaacagacacaggtgtttcccttccttcatatgaggaagatcagggatcaaaactcattcgaaaagctaaagaggcaccattcgtacccgttgtttttggagacagtcccgctctgtcgcccaggctggagtgcagtggcaggatctcggctcactgcagcctctgcctcctgggttcaagtgattctcctacctcagcttcctgagtagctgggactactcccgccaccacaccaggctgatttttgtgtttttagtagagacggggtttcaccattttggccaggctagtctcgaa

SEQ ID NO: 8130 - DNA, 399 bp, Homo sapiens
  misc_feature 2: n = A,T,C or G
tngctggagctccgcgcgcctgcaggtcgacactagtggatccaaagaattcggcacgagctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactct

SEQ ID NO: 8131 - DNA, 377 bp, Homo sapiens
  misc_feature 24, 29, 31, 32, 323, 339, 376: n = A,T,C or G
gaacaataagctggagctcgcgcncctgngnncgacactagtggatccaaagaattcggcacgaggtagaatgccgagacattaatggacagcctgcttccgagtgtgcaaaggaagtgaagccagccagcaccagaccttgtgcagaccatccctgcccccagtggcagctgggggagtggtcatcatgttctaagacctgtgggaagggttacaaaaaaagaagcttgaagtgtctgtcccatgatggagggggttgttatctcatgagagctgtgatccttttaaaagaaaacctaaacatttcataagactttttggcnccaattgggcagaatngcagtttaaggggggttttaaaggggggggttaaccnt

SEQ ID NO: 8132 - DNA, 240 bp, Homo sapiens
  misc_feature 12, 15, 227: n = A,T,C or G
gctggagctccnccnccttcgcggtccgacacctagtggatccaaagtaattcggcacgaggtaaagtctccctcagccctttcaaaaaataataaatttcctgtgaagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanggaaaaaaaaaaa

SEQ ID NO: 8133 - DNA, 400 bp, Homo sapiens
gacaataagctggagctcgcgcgcctgcaggtcgacactagtggatccaaagaattcggcacgagggcatttctagagtgtcattgctaaaacctcactgaacagacgcagccaaggtctgtgttcagcacttggtctctgttgttacgtaaaataataagcatttaaaatagtttacagatatttttgaccagttccttttagagattctttcagagaagaaaccagatctgacctgtttattgttggcgcttgttgaaaacgagctttctttcccatgatagtgcttcgtttttgaagtgttgaagctgtgctccccttaaatcgtggcaggagagattaaggtaattacaacactcagttctatgtcttacaagcactttgtcttgtctctgcaaga

SEQ ID NO: 8134 - DNA, 400 bp, Homo sapiens
  misc_feature 26, 59, 60, 63, 64, 74, 84, 92, 93, 98, 106, 132, 391: n = A,T,C or G
agtgagtcgtattacaattaactggncgctagtggatccaaagaattcggcacgagggnnttnntagagatgtnattgcttaanccttactnnacagncgcagccnaagggctgcgggcagcacttggtctntgttgttacgtaaaataataagcatttaaaatagtttacagatatttttgaccagttccttttagagattctttcagagaagaaaccagatctgacctgtttattgttggcgcttgttgaaaacgagctttctttcccatgatagtgcttcgtttttgaagtgttgaagctgtgctcccccttaaatcgtggcaggagagattaaggtaattacaacactcagttctatgtcttacaagcactttgtcttgtctctgcnagaaaattc

SEQ ID NO: 8135 - DNA, 400 bp, Homo sapiens
  misc_feature 10: n = A,T,C or G
cgaacaatantgtctggagctcgcgccgcctgcaggtccgacactagtggatccaaagaattcggcacgagaagaaattaaagcacatgtgatcaatataacaatataatcctaaaccttgacagttggagaagccaatgcagaactgatgggaaaggaccaattatttatagtttcccaacaaaagttctaagattttttacctctgcatcagtgcatttctatttatatcaaaaggtgctaaaatgattcaatttgcattttctgatcctgtagtgcctctatagaagtacccacagaaagtaaagtatcacatttataaataccaaagatgtaacaattttaaaattttctagattactccaataaagtgttttaagttttcctatgaaaaaaaaaa

SEQ ID NO: 8136 - DNA, 400 bp, Homo sapiens
accacaattttctggagctcgcgcgcctgaaggtcgacactagtggatccaaagaattcggcacgaggaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaa

SEQ ID NO: 8137 - DNA, 400 bp, Homo sapiens
  misc_feature 319: n = A,T,C or G
gaaaaagctggagctcgcgcgcctgcaggtcgacactagtggatccaaagaattcggcacgaggtgaggttgtctagtccacgctcggagccatgccgtccaagggcccgctgcagtctgtgcaggtcttcggacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaaggggggggngggtcacgtggcccaagatttatgctatccgtcagtccatctccaaagcccctggggggcctattaccagaaatatggggg

SEQ ID NO: 8138 - DNA, 400 bp, Homo sapiens
  misc_feature 2, 24, 323, 389: n = A,T,C or G
cnacaattttctggagctcgcgcncctgcaggtccgacactagtggatccaaagaattcggcacgagaaagacttgttgattgggttcagtggacaaagagacggaagcagtttcaaatactcactttccctaaaatctccttggtcattcagaaagtcaagtagtttttcttagaatgaatgtggctctggatagtggctgtgtgtgatggtaagtgataccttttgaaaatgacttggctatgttgggaccttttcatggatatttttaaaaagagtagtggtagaaaaagctggaaggacaagttagattaaatcctggngggagagtttttcacggacacccacatggagcgagtaggatctcattgtatcgcttaaacagtggngagggaaaaaa

SEQ ID NO: 8139 - DNA, 325 bp, Homo sapiens
  misc_feature 3, 67, 226: n = A,T,C or G
ganaataagctggagctcgcgcgcctgcaggtcgacactagtggatccaaagaattcggcacgaggnggctttttgtgtctggcttttttcatttagcataatgttttcaaggtttatccatgttgtaacatgtattcttttaaaaaaattttaatgtgtaaaatatacatatcataacatttaccttttaatcattcataagtacacaaatcagtggcatgaggnggtcccttcccaatgttgtgctgtcatcaccactgtctgttttcagaactttgtcatcatcatccccaacagaaaccctgtacccattaaacagtaact

SEQ ID NO: 8140 - DNA, 330 bp, Homo sapiens
  misc_feature 265: n = A,T,C or G
gacaatattgctggagcctcgcgccgcctgcaggtccgacactagtggatccaaagaattcggcacgagcttacaaactgcaacgcagaagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctcttcctgtgtctcacgcaagntttatactctaatatttatatggcttttttttcttcgacaaaaaaataataaaacgtttcttctg

SEQ ID NO: 8141 - DNA, 307 bp, Homo sapiens
  misc_feature 11: n = A,T,C or G
gaacaatattnctggagcctcgcgcgccctgcaggtcgacactagtggatccaaagaattcggcacgaggtgccctgcctgagttgtgtgcatccaggggcctggtgagcccccaggctggtggcatggcccccctgccccgtgctgaatgaatgtacagagccagacaaagctgtgaatggcctaggggctgagtcccacaccagctgtgaattctcctgcagacaggagggccctggctgtgcacctggggaagtggttgccctggggccagggtgcttgttctgttcaaataaaggtacctctt

SEQ ID NO: 8142 - DNA, 400 bp, Homo sapiens
  misc_feature 8, 69, 226, 313, 380: n = A,T,C or G
gacaatangctggagctcgcgcgcctgcaggtccgacactagtggatccaaagaattcggcacgagagnggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcnaaggagtctcagcgtagtgggaatgtagctgaactggctctgaaagctactctggtggagagttctacttcaggtttcactcctggnggaggaggctcttcagtctccatgattgccagtagaaagccaacagacggtgcttcctcatcaaatngtgtgacttgatatttccca

SEQ ID NO: 8143 - DNA, 400 bp, Homo sapiens
  misc_feature 8, 9: n = A,T,C or G
gacaatannctggagctcgcgcgcctgcaggtcgacactagtggatccaaagaattcggcacgaggagctgtcttgtcatcttttagagtaaactattctataaacatatgcaaacagccctaaataaatctaaagtctaaagttttattgatgtgaaattaaattcttattggccaaatgcctgttttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtccaaattctttattcttccttgagctaagcagaataatggaatata

SEQ ID NO: 8144 - DNA, 399 bp, Homo sapiens
  misc_feature 2: n = A,T,C or G
tnctggagctcgcgcgcctgaggtcgacactagtggatccaaagaattcggcacgagtgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcttccatcccagcttctccggaatggaaacgtgaatcagaatcaactgctgcagcccccgccaggtcctgtgcagaggagccctgtggagctgggacctgcaaggagacagagggacacgtcatatgcctgtgcccccctggctacactggcgagcactgtaacatagaccaggaggtatgtgaggagg

SEQ ID NO: 8145 - DNA, 400 bp, Homo sapiens
  misc_feature 304: n = A,T,C or G
gaacaaaagctggagctcgcgcgcctgcaggtcgacactagtggatccaaagaattcggcacgagagccggagccgctgccttgccccccggagactgaagacatggcacccaagagggccaagagaaggacagtagagggcggaagctccagcgtcttctccatgttcgaccagactcagatccaggagttcaaagaggccttcactgtgatcgaccagaaccgtgatggtattatagacaaggaggaccttcgggacaccttcgcagccatgggccgcctcaatgtgaagaatgagggagtnggatgccatgatgaaggaagccaagcggtcccatcaacttcaccgtcttcctgaccatgttcggggagaagctcaaggggtgccgacccttgagga

SEQ ID NO: 8146 - DNA, 400 bp, Homo sapiens
  misc_feature 8, 23, 87, 174, 192, 313, 315, 346, 355, 372: n = A,T,C or G
gacaatangctggagctcgcgcncttgcaggtcgacactagtggatccaaagaattcggcacgagagaaccccgtgctgcaagcagnactttcaggaacctggaggccttggccttggatttgatggagccggaacaagcagtggacctgacattgcccaaggttgaagcaatnaataaaagactggcctcnttgggggatgagtttaaggagcttgtttacccaccagattacaatcctgaagggaaagttaccaagagaaaacacgataatgaaaggttctggaagcaaaaaggcccaaggtggagtattnanaaagagggagcttgaagacccacatcagcangggtacccntggcaaagttcacttgngcccatgctgaaagaggcctgcccgggc

SEQ ID NO: 8147 - DNA, 400 bp, Homo sapiens
  misc_feature 396: n = A,T,C or G
gacaatatgctggagctcgcgcgcctgaggtcgacactagtggatccaaagaattcggcacgagcggaagtattgacggaaagcttgaattacctacatgattgatgatggtctccagctgtcaaagaagattgtggttgccaagagaaaggtaaccatttctcatccccttgagtggaattggatgcctctaggagcccacattggctggcagtagacatggccgaatttacaagctacaaggagacggcctccagccgccacttgcggtttaagctacagagtctaagccgccgccttgatgagttggaggaagccacaaaaaacctccagaaagcagaggatgaacctcctggatctccaggacaaggtgattcaaggcagaaggtagcaacntcca

SEQ ID NO: 8148 - DNA, 287 bp, Homo sapiens
  misc_feature 2, 11: n = A,T,C or G
tntgcccctgngtgcgcactagtggatccaaagaattcggcacgagctcagaactgtttgtttcaattggccatttaagtttagtagtaaaagactggttaatgataacaatgcatcgtaaaaccttcagaaggaaaggagaatgttttgtggaccactttggttttcttttttgcgtgtggcaagttttaagttattagtttttaaaatcagtactttttaatggaaacaacttgaccaaaaatttgtcacagaattttgagacccattaaaaaagttaaatgaga

SEQ ID NO: 8149 - DNA, 338 bp, Homo sapiens
gaacaataagctggagctcgcgcgccctgcaggtcgacactagtggatccaaagaattcggcacgagtgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcagctcctttaacgctaatatttccggcaaaatcccatgcttgggttttgtctttaaccttgtaacgcttgcaatcccaataaagcatt

SEQ ID NO: 8150 - DNA, 345 bp, Homo sapiens
  misc_feature 3, 8, 184, 210, 231, 233, 236, 294, 306, 310, 326, 337: n = A,T,C or G
ganaatangctggagctcgcgcgcctgcaggtcgacactagtggatccaaagaattcggcacgagggcagatgggaaacgcatcatattctgattcctacctggaaggaattttgttgaaaggggttttcacctgtgagccttggtctgtctcggtagggtggtcaacttcagtggactgtggntggtttcagagcgcctggctgagganttccactgaggggagcactgnancanccctttggcataggctgaggagggagatggaccagcccacgcctggcacctggctccntggcctaagganaggnacatgctggcctgtgncctcctggtgncttttcct

SEQ ID NO: 8151 - DNA, 100 bp, Homo sapiens
  misc_feature 65, 68, 73, 76, 86, 94, 96, 99: n = A,T,C or G
aaaaaagctggagctcgcgcgcctgcaggtcgacactagtggatcaaagaattcggcacgagctngcnccganttnagcacgaggnctccctgntnggnc

SEQ ID NO: 8152 - DNA, 398 bp, Homo sapiens
  misc_feature 29, 298, 323, 336, 345, 384: n = A,T,C or G
gaacaataagctggagctcgcgcgcctgnggtcgacactagtggatccaaagaattcggcacgaggcaggatttctctgcctcttccaaacttttcctccctgaacctgagggaaactaatctggattcactccctctgggtgatacccactcaaaaaggacacttctgattaagacgggtgaaactagagatggacaggttatcaacgaaacttctcagcatcacgatgaccttgaataaaaattgcacacactcagtgcagcaatatattaccagcaagaataaaaaagaaatccntatcttaaagaaacagctttcaagngcctttctgcagnttttcaggngcgcaagatagatttggaatagggaataagctctagttnttaacaacccgaca

SEQ ID NO: 8153 - DNA, 258 bp, Homo sapiens
gacaataagctggagctcgcgcgcctgcaggtcgacactagtggatccaaagaattcggcacgaggaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccag

SEQ ID NO: 8154 - DNA, 400 bp, Homo sapiens
gaaaataagctggagctcgcgcgcctgcaggtcgacactagtggatccaaagaattcggcacgagggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaccaaaataccaagtctcccctcttcatgggaaaag

SEQ ID NO: 8155 - DNA, 400 bp, Homo sapiens
  misc_feature 9, 10: n = A,T,C or G
gaacaatanngctggagctcgcgcgccctgcaggtcgacactagtggatccaaagaattcggcacgagtctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaac

SEQ ID NO: 8156 - DNA, 348 bp, Homo sapiens
gaaaataagctggagctcgcgcgcctgcaggtcgacactagtggatccaaagaattcggcacgagcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaat

SEQ ID NO: 8157 - DNA, 308 bp, Homo sapiens
gacaataagctggagctcgcgcgcctgcaggtcgacactagtggatccaaagaattcggcacgagcaagaaataccttaagaagaacaatcttcgtgattggcttcgagtggttgcatctgacaaggagacctacgaacttcgttacttccagattagtcaagatgaagatgaatcagagtcggaggactaggcaaaggctccccttacagggctttgcttattaataaaataaatgaagtatacatgagaaataccaagaaattggcttttagtttatcagtgaataaaaaatattatactcttgaa

SEQ ID NO: 8158 - DNA, 400 bp, Homo sapiens
  misc_feature 3: n = A,T,C or G
ganaataagctggagctcgcgcgcctgcaggtcgacactagtggatccaaagaattcggcacgagctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatg

SEQ ID NO: 8159 - DNA, 400 bp, Homo sapiens
  misc_feature 105: n = A,T,C or G
gacaataagctggagctcgcgcgcctgcggtcgacactagtggatccaaagattcggcacgaggtaatctaatctagtttaagatttttgtttaatcctcatggnggtcctacctggataatttaactataaagacaaagtaattctattaaatgaactaactgaaaataataattataggaagtgattattccattttaagtattagagctcaaattggctttatttgcatttagggagatcatgttttcttaatcatgctggaatttaaaaattgttttacttgtatcgaaattaaccttgatttataactatttttgtaataaaacaatgacagctgtagtaactatgatgggtgtaacaacatttttttaaagaagggaatctgtttatcgctttt

SEQ ID NO: 8160 - DNA, 234 bp, Homo sapiens
  misc_feature 3, 214: n = A,T,C or G
gancaaaagctggagctcgcgcgcctgcaggtcgacactagtggatccaaagaattcggcacgagctctacaaaaaaattaaaaattagctgggagtggtagtgcatgcctgcaatcccagctaactcaggaggttgagtctggaggatcccttgagcccatgagtttgaggctgcagtgggctgtgatcgcaccactgcactccagcctcggngagtgagtgagatcctgtct

SEQ ID NO: 8161 - DNA, 100 bp, Homo sapiens
  misc_feature 68, 91, 93: n = A,T,C or G
gctggagctcgcgcgcctgcaggtcgacactagtggatccaaagaattcggcacgagagagaaggtantgtttttaagtggaaatgagaanantaaatgg

SEQ ID NO: 8162 - DNA, 336 bp, Homo sapiens
  misc_feature 7: n = A,T,C or G
gaacaantagctggagctcgcgcgcctgcaggtcgacactagtggatccaaagaattcggcacgagggcacaacaaagattattagcagatttctcagcagaacccgtacaagctgggagaacatggaatgatatagtaaaagtgctacaagaagaaaaaaagaaaactgctggccaaaaatactatactcagcagagtgatccttcagaagtgaaggagaaataaagtccttcccatacaagcacaagctgagggaattcatcaccactagactggcgaagatcttaagtaaccaataacattgcaccacaaggaactaagaaaaaagggcaaac

SEQ ID NO: 8163 - DNA, 399 bp, Homo sapiens
  misc_feature 7: n = A,T,C or G
tgggacnctagtggatccaaagaattcggcacgaggaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggcttgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaaatgctaccaaagaaaaaaatggacaagagcaatgaggagc

SEQ ID NO: 8164 - DNA, 400 bp, Homo sapiens
  misc_feature 3: n = A,T,C or G
ganaataagctggagctcgcgcgcctgcaggtcgacactagtggatccaaagaattcggcacgaggcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcaca

SEQ ID NO: 8165 - DNA, 389 bp, Homo sapiens
gaacaataagctggagctcgcgcgcctgcaggtcgacactagtggatccaaagaattcggcacgaggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcgggggttggtccgcattggggtgcttggatgagggcaagatgaagctggatta

SEQ ID NO: 8166 - DNA, 400 bp, Homo sapiens
gacaaaagctggagctcgcgcgcctgcaggtcgacactagtggatccaaagaattcggcacgagatttgcagcgtggaaaagaaatgcagatgatcatgtctacctgatgcgccgtgggttttttgataattagaatttcgcacattcagttttcagggttcagctcctttctctaaagtaaacagcccattgtcagggatcttctggtcagacaacctgtgattcatctagattttttaccgagctccacttcattgagaagtcaatgatgccagtctggttctttgtcaactctccctcggctttgtcacataattgaattatgtcataaccttattaatttgcacatagatcatctgaatgtcgtggtttaagacttaaggaggaacatctgtttga

SEQ ID NO: 8167 - DNA, 400 bp, Homo sapiens
  misc_feature 355: n = A,T,C or G
gaacaataagctggagctcgcgcgcctgcaggtcgacactagtggatccaaagaattcggcacgaggagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaaggatacntcatcaacagggcccgggtgggagtgccaaaaccaccggctgact

SEQ ID NO: 8168 - DNA, 388 bp, Homo sapiens
  misc_feature 6, 22, 30, 341, 377, 380: n = A,T,C or G
gacaanaagctggagctccgcncgcttcgnggtcgacactagtggatccaaagaattcggcacgagcctgaatgacaaccagccattgaaagaaagcagccctcacaccatagcatctacaccaagagctacaaccaaaatgaggggctcgggggcctggggttttaatctgttggtttaatacttaactcatgtattattttattttgattcaagtattaaaacccaccaaaagtaaagtgagtggtgcctatgaaatataataaaacccatttctgaaaatgttaaaaaaaaagagtacttctagagcggccgcggccccttcgattttccacccgggnggggtaccaggtaagtgtacccaattcgcctatagnggncgatacaa

SEQ ID NO: 8169 - DNA, 400 bp, Homo sapiens
gacaaaagctggagctcgcgcgcttgaggtcgcactagtggatccaaagaattcggcacgagccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccaagagcaaggccgggtttggcaccaagggcttggctatcacatttgtgtccgatgagaatgatgccaagatcctcaatgatgtgcaggatcgcttttgaggtcaatattagtgagctgcctgatgagatagacatctcctcctacattgaacagacacgg

SEQ ID NO: 8170 - DNA, 400 bp, Homo sapiens
  misc_feature 18, 22, 395: n = A,T,C or G
gacaataagctggagctngcgngcttgaggtcgacactagtggatccaaagaattcggcacgagggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcaagggcagtatctctctgcctatttattggggtgctatttattggggatctgcattccccgctgcccaatcatttgcaatgccctaattagggcatcctgccccttcgccttttaggctcaggacggaaggtcaggttgccattggttacccgaggacccttggntactc

SEQ ID NO: 8171 - DNA, 109 bp, Homo sapiens
  misc_feature 1, 2, 12, 29, 34: n = A,T,C or G
nncgaacaatangtctggagctcgtgcgncctgnaggtgcgacactagtggatccaaagaattcggcacgagggattacagtcgtgagccactgcacctggctgcaatt

SEQ ID NO: 8172 - DNA, 400 bp, Homo sapiens
  misc_feature 397: n = A,T,C or G
gaaaaagctggagctcgccgcctgcggtcgacactagtggatccaaagaattcggcacgagatctggaagcccctgagacacgatgcagctgagattactgtgatgcattattggtttggtcaagcattcttctattttcagggcaactccaacaacattgccaccgtggacatctccgcaggcttcgtgggcttagacacctacgtggaaatcccagccgtgctcctgacagcgtttgggacgtacgcagggcctgtgctgtgggccagccacttagtgcacttcctgagctcagaaacacgcaggggttcagcactgagtcatgcttgcttctgctacgacttgattttgttctattccagtttcacgtacatcgttttggggacatctctgcgntat

SEQ ID NO: 8173 - DNA, 185 bp, Homo sapiens
  misc_feature 3, 25, 79: n = A,T,C or G
ganaataagctggagctcgcgcgcntgcaggtcgacactagtggatccaaagaattcggcacgaggtcaacttcttggngtcattgctcaagaaaaactggcagaatgtccgggccttatatatcaagagcaccatgggcaagccccagcgcctatattaaggcacatttgaataaattctatta

SEQ ID NO: 8174 - DNA, 400 bp, Homo sapiens
  misc_feature 13, 20, 360: n = A,T,C or G
taagctggagctngcgcgcntgcggtcgacactagtggatccaaagaattcggcacgagcctatacaaaaaagaatagcagcatttttatcttcaatgacaaagaattgagtccaagaaaatactgtataaaccttgttaaaaatcactcttgtcttttggtcctactcacataattcagcacactttcacagttaactattttttgttcaatttagtgcactggtgagtgactcaaactgctttatcccaaatttgatttacagcctttataagattgcctattaaaaaagcttaaagcttatccttagcccattttgtcagaaaaataatttgcatctaatcatttttataaactggngaatttacggtgttttactatatcatgactaaaattctaa

SEQ ID NO: 8175 - DNA, 223 bp, Homo sapiens
gacaaaagctggagctcgcgcgcctgcaggtcgacactagtggatccaaagaattcggcacgagctggtttctggagataacccatcaataaaagctgcttcctctggtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttttttt

SEQ ID NO: 8176 - DNA, 400 bp, Homo sapiens
  misc_feature 148, 150, 235, 245, 253, 311: n = A,T,C or G
gacaataagctggagctcgcgcgcctgcaggtcgacactagtggatccaaagaattcggcacgagctgggttacagagcacaccctatctcaaaaaagaaagaaaaaaaaatgaagttttcccctaaaatttcatcattcaataaccngngttattggcttgctatatattttctctagattttataaagtcatagcctacatatgtatacatgttagtatatattaataggttngcacttctgngtacttgngtgaaagaataatcttctgttcctagctaaaaataaattgctatatataatatatagngcttgcagtttttttctctaaatttacaatatttatcatggacatctttttatgtcagtacacaaggatctatcttgctgttattaaca

SEQ ID NO: 8177 - DNA, 96 bp, Homo sapiens
gacaataagctggagctcgcgcgcctgcaggtcgacactagtggatccaaagaattcggcacgagctttaataaagctggatacagtttggcttgg

SEQ ID NO: 8178 - DNA, 281 bp, Homo sapiens
gaacaataagctggagctcgcgcgcctgcaggtcgacactagtggatccaaagaattcggcacgagaaatattgcttcgatcatggtcttcaaagatgtaaatacaagagaaccaaagttattccgggcagttccagattcagaacgtgttattcctcccagaacgacaacgccatatttcctttgaggccttcgcccatcctgctgacccatttttctgccctcttcttaccccaattttcttgtattaccctctacaatatactttttattgagcactt

SEQ ID NO: 8179 - DNA, 400 bp, Homo sapiens
  misc_feature 2, 5: n = A,T,C or G
gnaanagctggagctcgcgcgcctgcaggtcgacactagtggatccaaagaattcggcacgagccaaagtctcgcttctgccgaggtgtccctgatgccaagattcgcatttttgacctggggcggaaaaaggcaaaagtggatgagtttccgctttgtggccacatggtgtcaagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggcttgacaggctccaaacaggcatgcgaggtgcctttggaaagccccagggcactgtggccagggt

SEQ ID NO: 8180 - DNA, 232 bp, Homo sapiens
gacaataagctggagctcgcgcgcctgcaggtcgacactagtggatccaaagaattcggcacgagtctgtgtcaaacacctctgtattttttaaaacatcaattgatattaaaaatgaaaagattattggaaagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 8181 - DNA, 400 bp, Homo sapiens
  misc_feature 25: n = A,T,C or G
gaaaataagctggagctcgcgcgcntgcaggtcgacactagtggatccaaagaattcggcacgagggaaagtccacgtttgtgaagttactcacgaaaacttacccagaatggcacgtagcctacagaacctgtagcaacatggcagaatatccaggctgctggcacccaaaaagcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacaggtgacaggctccactttgaggctctgatgaacattccagtgctg

SEQ ID NO: 8182 - DNA, 400 bp, Homo sapiens
  misc_feature 8, 28: n = A,T,C or G
gacaattngctggagctcgcgcgcttgnaggtcgacactagtggatccaaagaattcggcacgagtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgt

SEQ ID NO: 8183 - DNA, 188 bp, Homo sapiens
  misc_feature 8, 14: n = A,T,C or G
tccaaagnaattcngcacgagctttaatggaaagcaaaaacaactttctgttctcatttactaatgaatttcaataaactttcttactgatgcaaactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 8184 - DNA, 263 bp, Homo sapiens
  misc_feature 138: n = A,T,C or G
gacaataagctggagctcgcgcgcctgcaggtcgacactagtggatccaaagaattcggcacgagctttaatggaaagaaaaacaactttctgttctcatttactaatgaatttcaataaactttcttactgatgcgnactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 8185 - DNA, 400 bp, Homo sapiens
agaaaaagctggagctcgcgcgcctgcaggtcgacactagtggatccaagaattcggcacgagctcgtgccgaattcggcacgagcgagcggcccaagctgctgctttgctctcacttcactctggatttggcttgaagtcttcctgtgtgaggtccaagcaccctctcttggagtctggattgggacccctttccagtaatatactcctggtgaaccatgaaaggacgatattgaggagacccctgaactaaaggaaatagaccgcaacaccaattggctgactttgggtgggaagtccaagaatccgagtggaggctcaccgaggcgaaggggccaaccatgggaaaggagagtggatgggactcaggggcagctggactctctgtgacatctaaagt

SEQ ID NO: 8186 - DNA, 381 bp, Homo sapiens
gaaaataagctggagctcgcgcgcctgcaggtcgacactagtggatccaaagaattcggcacgaggacccttcccagccctcatcccacttcctttcctactgtcctggaacctgtctccattgtgtgatccagccctggttctggctgtggtcagcagatgccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatc

SEQ ID NO: 8187 - DNA, 214 bp, Homo sapiens
gacaaaagctggagctcgcgcgcctgcaggtcgacactagtggatccaaagaattcggcacgaggtttcattaagttggactaaatgctcttccttcagaggattatccggggcatctactcaatgaaaaaccatgataattctttgtatataaaataaacatttgaaaaaaaaaaaaaaaaaaaaaaaaaaaaaaaaaaaaaaaaaaaaaaaa

SEQ ID NO: 8188 - DNA, 355 bp, Homo sapiens
  misc_feature 24: n = A,T,C or G
gacaaaagctggagctcgcgcgcntgcaggtcgacactagtggatccaaagaattcggcacgagtggaattggtgcttaaaatctcatcgatgtgctgtctctggagtgataagaaagggctacatctcccgaaatgatttctttacgtcatgtattggtttccttcttcaccttgaacttttgttgaactgtatgtactttaccccaaacctgttaatattttgagcgcttctatgtgaaagcaaagaaataattttaatactctggcattcataaattttattgatgagattatttattttaaaggtttgaggtaacatctctggttgtaccaaagaagaaataaatatggtt

SEQ ID NO: 8189 - DNA, 126 bp, Homo sapiens
  misc_feature 6, 7, 14, 17, 44, 59, 63, 116: n = A,T,C or G
atggannctcgtgnccntgcagtgcgacactagtggatccaaanaatcggcacgagggnaagnggggcaagactgttatcgagtaccggtcacagaagacctcacgcctccccatnattgacattg

SEQ ID NO: 8190 - DNA, 131 bp, Homo sapiens
gaacaataagctggagctcgcgcgcctgcaggtcgacactagtggatccaaagaattcggcacgagcatgtttgaaaaatagaaactggatttaccctccaaccttaagcaactagaaaaccaaacaaact

SEQ ID NO: 8191 - DNA, 347 bp, Homo sapiens
  misc_feature 301, 326, 337, 345: n = A,T,C or G
gaaaaaagctggagctcgcgcgcctgcaggtcgacactagtggatccaaagaattcggcacgaggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtncctattttgtatatgtgagatgttnaaataaattgngaaaaaantg

SEQ ID NO: 8192 - DNA, 400 bp, Homo sapiens
  misc_feature 3, 55, 73, 335, 345, 346, 347, 389: n = A,T,C or G
ganaaaagctggagctcgcgcgcctgaggtcgacactagtggatcaaagaattcngcacgaggtcactgagcnggactggacccaggaccctcgcgtcctggtccacccacctcgtctactagtgtcccacagtgctgcgctagtcccttctgccacccttcccagtcccaggacgggccctggagggagaaaggagcctgtgccccctgatggctctggctgtcctgatcctgtcttccctcccctgaaggaaagtttgcactggattttattggagccccatctccccagcgggcaggcgggcggagcctgtatatatgtatatactcagtgnctcagttcannnttcctccacctggcttccactgcacagggcccaggaaggtanaaagggccaag

SEQ ID NO: 8193 - DNA, 345 bp, Homo sapiens
  misc_feature 16, 20, 30, 150, 192, 200, 307, 310, 312: n = A,T,C or G
gctgaagtcttgtgcncctncagtgggacnctagtggatccaaagaattcggcacgagagacaagcaggtgcaggcagcagcagtccagaggcccccctgagatctgaggatagcacctgcctccctcccagccctggcctcatcactgngcggctcaaattcctcaatgataccgaggagctggctgtggntaggccangaggataccgtgggtgccctgaagagcaaatacttccctggacaagaaagccagatgaaactgatctaccagggccggctgctacaagacccagcccgacactgcgnttntnttgaacattacccgacaactgtctgattcactg

SEQ ID NO: 8194 - DNA, 314 bp, Homo sapiens
  misc_feature 241, 275, 305: n = A,T,C or G
gaacaataatgctggagctcgcgcgcctgcaggtcgacatctagtggatccaaagaattcggcacgagagaaggagtaggagctgctgctggcgcccgagagggaaggagccggcctgctgggcagcgtggccacaaggggcggcactcctcaggccgggggagccactgccccgtccaaggccgccagcttgtgatgcatcctcccggcctgccttgagccctgatgctgcttgtcaganaaaggacactgcgtcccccacgggcctgcgtggngctgcccggcccccccacgtgtactgtagnagttttttt

SEQ ID NO: 8195 - DNA, 104 bp, Homo sapiens
  misc_feature 8, 17, 102: n = A,T,C or G
tccaaggnaattcggcncgagccagcagtctcccaaactttcttaactccaacattcacccaaaattccaagtccaaagtctcatctgagaaaagacaagtnct

SEQ ID NO: 8196 - DNA, 400 bp, Homo sapiens
  misc_feature 2: n = A,T,C or G
gnaaaagctggagctcgcgcgcctgcaggtcgacactagtggatccaaagaattcggcacgagctcgtgccgaattcggcacgagagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacagg

SEQ ID NO: 8197 - DNA, 288 bp, Homo sapiens
  misc_feature 3, 109, 236, 242: n = A,T,C or G
ganaataagctggagctcgcgcgcctgcaggtcgacactagtggatccaaagaattcggcacgagaataacttaaagaaaaaaaaacctgggaaatcttcaacatgttnttggaacatatatgtatgtattaatgtatatacatggcttaacttatacgttatggcagctctgtatacagtttgatctcatgtactgaaaaaaaattcttaattttattggagtttataccactgngaaacngcaatatgactgtaagagagtaaaaagattgttacatctaaaaaaa

SEQ ID NO: 8198 - DNA, 396 bp, Homo sapiens
  misc_feature 20, 355, 361, 369: n = A,T,C or G
aaaaagctggagctcgcgcncctgcaggtccgacactagtggatccaaagaattcggcacgagtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaacttcaaagacctggaaaaatggcagaataatctgcttccatcccgccagntttggnttcattgnactgacaacctcagctggcatcatgga

SEQ ID NO: 8199 - DNA, 156 bp, Homo sapiens
  misc_feature 3: n = A,T,C or G
ganaataagctggagctcgcgcgcctgcaggtcgacactagtggatccaaagaattcggcacgagcttggaagaaatatatttgcatattgaaaagcacagaggatttctttagtgtcattgccgattttggctataacagtgtctttctagccat

SEQ ID NO: 8200 - DNA, 367 bp, Homo sapiens
  misc_feature 3, 8, 281, 286, 305, 350: n = A,T,C or G
ganaattngctggagctcgcgcgcctgcaggtcgacactagtggatccaaagaattcggcacgaggttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcngcgtntgcacacgaactgccaaantatggcgtgaaggttggcctgacaaattatgctgcagcatattgnactggcctgctgctggc

SEQ ID NO: 8201 - DNA, 278 bp, Homo sapiens
  misc_feature 4, 112: n = A,T,C or G
agancaataagctggagcctcgcgcgcctgcaggtcgacacctagtggatccaaagaattcggcacgaggcagcctcgagtgcccctgtcccacctggctccccctgctggngtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaat

SEQ ID NO: 8202 - DNA, 400 bp, Homo sapiens
  misc_feature 9, 34: n = A,T,C or G
gaacaatantgctggagctcgcgcgcctgcaggncagacactagtggatccaaagaattcggcacgagcagaaaagcaccatttttgctgaacttttcagtggaaagactggataacagattgggattttttcagaaagaacttgaacttagtgtgaagaagactagagatctggtagttcgtctcccaaggctgctaactggaagtctggaacccgtgaaagaaaatatgaaggtttatcgtcttgaacttggttttaaacataacgaaattcaacatatgatcaccagaatcccaaagatgttaactgcaaataaaatgaaacttaccgagacgtttgattttgtgcacaatgtgatgagcattccccaccacatcattgtcaagttcccacaggtat

SEQ ID NO: 8203 - DNA, 279 bp, Homo sapiens
  misc_feature 6, 22, 27, 226, 245, 279: n = A,T,C or G
gacaanagctggagctcgcgcncctgnggtcgacacctagtggatccaaagaattcggcacgaggtggtatgtagcaaatattcaaacgagaactttgaaggccgaagtggagaagggttccatgtgaacagcagttgaacatgggtcatgtcggtcctgagagatgggcgagcgcccgttccgaagggacgggcgatggccctcccgttgccctcggccgatcgnaagggagtcggggttccgngatccccgaatccgggagtggcggaaattggccn

SEQ ID NO: 8204 - DNA, 367 bp, Homo sapiens
  misc_feature 3, 6, 326: n = A,T,C or G
gtnacnttactgggcgctagtggatccaaagaattcggcacgaggttttatacagtctatcattgatggacatttgggttggttccaagtctttgctattgtgagtagtgccacagtaaacataggtgtgcatgtgtcttcatagtagaatgatttataatcctttgggtatatctccaataatggaatagctgggtcaaatggtatttctagttctagatccttgaggaatcgccacactgtcttccataaagattggactaatttacacttcaaccaacagtgtaaaagcattcctatttcttcacatcctctccagcatctgntgtttcctgactttttaatgatccacctgcctcagcctccc

SEQ ID NO: 8205 - DNA, 328 bp, Homo sapiens
  misc_feature 3, 19, 275, 304: n = A,T,C or G
ganaataagctggagcctngcgcgccctgcgggtcgacactagtggatccaaagaattcggcacgagccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacggcccggntcttcggatacgggcaaaaaagagcccanggaagccgcagaacagggatgttg

SEQ ID NO: 8206 - DNA, 296 bp, Homo sapiens
  misc_feature 118: n = A,T,C or G
gacaataagctggagctcgcgcgcctgcaggtcgacactagtggatccaagaattcggcacgaggcagggccaagttcaagtttcctggccgccagaagatccacatctcaaagaagnggggcttcaccaagttcaatgctgatgaatttgaagacatgggggctgaaaagcggctcatcccagatggctgtggggtcaagtacatccccagtcgtggccctctggacaagtggcgggccctgcactcatgagggcttccaatgtgctgcccccctcttaatactcaccaataaat

SEQ ID NO: 8207 - DNA, 166 bp, Homo sapiens
  misc_feature 6, 103: n = A,T,C or G
gaacantaagctggagctcgcgcgcctgcagggtcgacactagtggatccaaagaattcggcacgagctcgtgccgcaaagaggaaacacttgttgaagcatnagtcgctgggggctgccgcgtcaacagccaacctcctggatgatgtggagggccacgcgtgtg

SEQ ID NO: 8208 - DNA, 305 bp, Homo sapiens
  misc_feature 245, 274, 293: n = A,T,C or G
gaaaaagctggagctcgcgcgcctgcaggtcgacactagtggatccaaagaattcggcacgaggaaagtcctcaagtttgcctgcaaggtacaaaagaaggatcccaaggaatgggcagctcagtaccgagaggcgatggaagcggatttgaaggctgcagctgaggctgcagcttgaagccaaggctagggccgagattagagctcgaatgggcattgggctcggctcggagaatgctgccggnccctgcaactgggacgaagctgatatcgnaccctgggccaaagcccgnatccaggcggga

SEQ ID NO: 8209 - DNA, 398 bp, Homo sapiens
gacaataagctggagctcgcgcgcctgcaggtcgacactagtggatccaaagaattcggcacgaggtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgt

SEQ ID NO: 8210 - DNA, 400 bp, Homo sapiens
  misc_feature 5, 21, 27: n = A,T,C or G
gaaanagctggagctcgcgcncctgcnggtcgacactagtggatccaaagaattcggcacgagggtaaagctggagctgaaagggaattccgaggcctcggtgactgcctggttaagatctacaaatctgatgggattaagggcctgtaccaaggctttaacgtgtctgtgcagggtattatcattctaccgagccgcctacttcggtatctatgacactgcaaagggaatgcttccggatcccaagaacactcacatcgtcatcagctggatgatcgcacagactgtcactgctgttgccgggttgacttcctatccatttgacaccgttcgccgccgatgatgatgcagtcagggcgcaaaggaactgacatcatgtacacaggcacgctttgactgc

SEQ ID NO: 8211 - DNA, 203 bp, Homo sapiens
  misc_feature 26: n = A,T,C or G
gacaataagctggagctcgcgcgccntgaaggtcgacactagtggatccaaagaattcggcacgagccaaagtgctggagtgaggctccagaggagactttgagttgatgggggccaggacaccagtccaggtagtgttgagacccaggcctgtggccccaccgagctggagcgggagaggaagccagcttggttttgcactt

SEQ ID NO: 8212 - DNA, 400 bp, Homo sapiens
  misc_feature 79, 87, 105, 124, 129: n = A,T,C or G
gacaaaaagctggagctcgcgcgccctgaggtccgacactagtggatccaaagaattcggcacgagcggacacgctggncctactgncctgatgctgctgagatncctggtggctctcgctggntctgnctacctggcctggatcctgttcttcgagctctatgatttctgcattgtttgtatcaccacctatgctatcaacgtgagcctgatgtggctcagtttccggaaggtccaagaaccccagggcaaggctaagaggcactgagccctcaaacccaagccaggctgacctcatctgctttgctttggaatgtgagccttgcctaagggggcatatctgggtcccttagaaggccctagatgtggggcttctagattaccccctcctcctgccata

SEQ ID NO: 8213 - DNA, 400 bp, Homo sapiens
  misc_feature 3, 22: n = A,T,C or G
ganaataatgctggagctcgcngcgcctgcaggtcgacactagtggatccaaagaattcggcacgagaagcaggtcccaaaggagatagaggggctgaaggtgctagaggaattcctggtctccctgggcccaaaggagacacgggtttgccaggtgtggatggccgtgatgggatccctggaatgcctggaacaaagggtgaaccaggaaaacctgggcctcctggtgatgcaggattgcaggggttaccaggtgtacctggaattcctggtgcaaagggtgttgcttggtgaaaagggtagcacaggtgctccagggaagcctggtcagatgggaaattcaggcaaaccgggccaacaggggcctccaggagaaggtgggaccccgaggaccccaggg

SEQ ID NO: 8214 - DNA, 306 bp, Homo sapiens
  misc_feature 8, 9: n = A,T,C or G
gaacaatnngctggagctcgcgcgcctgcaggtccgacactagtggatccaaagaattcggcacgagcggcacgagaaaaaacttttcccgaaaggagtcttcaccaaagagctcccatctggcaagaaatacctccgctacacaccccagccttaagtctcttggagaagctggtgctgtgagccaagaggatgtcagctgccaattgtgttttcctgcagcaattccataaacacatcctggtgtcatcacagccaaggtttttaggttgctataccaatggcttattaaatgaaaatggcact

SEQ ID NO: 8215 - DNA, 329 bp, Homo sapiens
gaaaaagctggagctcgcgcgcctgcaggtcgacactagtggatccaagaattcggcacgagagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaacccttc

SEQ ID NO: 8216 - DNA, 298 bp, Homo sapiens
  misc_feature 27: n = A,T,C or G
gaaataagctggagctcgcgcgcctgnaggtcgacactagtggatccaaagaattcggcacgagcttgtctcctccccgtgtccccaatgtcttcagtggggggccccctcttgggtcccctcctctgccatcacctgaagacccccacgccaaacactgaatgtcacctgtgcctgcccgcctcggtccaccttgcggcccgtgtttgactcaactcagctcctttaacgctaatatttccggcaaaatcccatgcttgggttttgtctttaaccttgtaacgcttgcaatcccaat

SEQ ID NO: 8217 - DNA, 237 bp, Homo sapiens
gaaaaagctggagctcgcgcgcctgcaggtcgacactagtggatccaaagaattcggcacgagggataacaagacttaattactgaaaaacagtaacatagcattttgaaatataatcttttaaaatattgatgctttccttttaaatggaaatttaaattttatgattaaaagtttaaacatttatgataattttcctcatcagttctcccataggaaataaagcatgtgaaaggg

SEQ ID NO: 8218 - DNA, 399 bp, Homo sapiens
  misc_feature 18, 26, 29, 232, 276, 281, 331, 351, 374, 377: n = A,T,C or G
aaaaatgctggagctcgngcgcctgnagntcgacatctagtggatccaaagaattcggcacgagccggccctcgaggactggccgggaaccgaggcgtgccaggacagcccgggagacagggcgtggagggccgggatgccactgaccagcacatcgtggatgtggcgctgaagatgctgaagagcaactggcagaggtcgccgtgagtgccaagcgggaagcccctgggtncggtgggcatgattgggtcctccaggaccttcctgggccccccntgggntaccccaggcaagcagggccccccattgggcacccctggcccttcggggngttccttgggattcgggggnacccggggggtcaaaaatcggcnacnacggggcccaagggaaaaacgt

SEQ ID NO: 8219 - DNA, 389 bp, Homo sapiens
  misc_feature 26, 31, 34, 386: n = A,T,C or G
gaacaataatgctggagctcgtgccncctgnggngcgacactagtggatccaaagaattcggcacgagcagactcggagcaggaggatgaatctgaggacacagatactgatggggaagaggagacatcacaacccccaccccaggccagccacccctctgcccactttcagagccccccgacacccttcctgcccttcgcctctactctgcctttgcccccagcgcccccgggcccctcagcacctgatgaagaggacgaagaagattacgactcctagcgccttctgccccccagaccatagccccttttagttggttttagttgctctggggggaggagagaaggtagagctgttcttaaatttattaaaaaaaaaaataaanggg

SEQ ID NO: 8220 - DNA, 183 bp, Homo sapiens
tctggagcctcgccgcgccctgcaggtcgacacctagtggatccaaagaattcggcacgagctcgtgccgaattcggcacgagaaaatactcactgactgaaattcattcatcttctctgctttttgtaatttaaagttcatctttttttgtaaggtgacttgcttatggggagtctttcttc

SEQ ID NO: 8221 - DNA, 398 bp, Homo sapiens
  misc_feature 2, 263: n = A,T,C or G
gnaaaagctggagctcgcgcgcctgcggtcgacactagtggatccaagaattcggcacgagagaaatttgtggctaccatgtattattacttgcagtttgcctattataagttgaacgacctgaagaatgcagccccctgtgcagtcagctatctgctctttgatcagaatgacaaggtcatgcagcagaacctggtgtattaccagtaccacagggacacgtggggcctctcagatgagcacttccagcccagacctggagnaagttgtggaatatgtgggatgacctcttggaactggaggagaccagctagcccacagcaaccaaagagacttcctcttggcgttcaggaaacacagattctttgtccttttcccaacagcccaggctgttgata

SEQ ID NO: 8222 - DNA, 400 bp, Homo sapiens
  misc_feature 3: n = A,T,C or G
ganaaaagctggagctcgcgcgcctgcaggtcgacactagtggatccaaagaattcggcacgaggaagaggtccttcacatcccttgtaagttggattcctaggtatattcagatcctttcttatgttcacttaaaagttattgattccaacttctgtcctagagatagcataacttggatgtttgagattaaaaaaaaatgcttttagtaacctttatttaactcgctcagcttgctatatagccaagtcggtatttataggtttgtttccacccttgataatttcatgccagtactcatcagaatggaacactgacttggctctgtctgtccttattctcatctccatcccctcctttccaacacactgcaattctagattgaagactgcacatttat

SEQ ID NO: 8223 - DNA, 400 bp, Homo sapiens
  misc_feature 3: n = A,T,C or G
ganaaaagctggagctcgcgcgcctgcaggtcgacactagtggatccaaagaattcggcacgagtgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccct

SEQ ID NO: 8224 - DNA, 400 bp, Homo sapiens
  misc_feature 34, 204: n = A,T,C or G
gaacaataatgctggagctcgcgcgcctgcaggncgacactagtggatccaaagaattcggcacgagccagaacacaggtgtcgtgaaaactacccctaaaagccaaaatgggaaaggaaaagactcatatcaacattgtcgtcattggacacgtagattcgggcaagtccaccactactggccatctgatctataaatgcggnggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagact

SEQ ID NO: 8225 - DNA, 177 bp, Homo sapiens
  misc_feature 5, 7: n = A,T,C or G
acaanangctggagctcgcgcgccctgcaggtcgacactagtggatccaaagaattcggcacgagagtaagattcaggaaaaatgcacttgggaatcaaagaaaatggaacttctttttgaaaagacaagcaaccatgttaactgtattgacacatcctcaataaaacctgttgtat

SEQ ID NO: 8226 - DNA, 189 bp, Homo sapiens
  misc_feature 4, 6, 64, 68, 69, 70, 106, 175, 181, 186: n = A,T,C or G
accntncagtgggacgctagtggatccaaagaattcggcacgagctcgtgccgaattcggcacnagcnnntcactgtcataagggagaaagaggctcattcctggnagaagtatgggggggttatcattttcaaaattattgggattctcacctccctccccacctcagtgtttngtctgnccgcnccc

SEQ ID NO: 8227 - DNA, 398 bp, Homo sapiens
  misc_feature 5, 7: n = A,T,C or G
cctgngngcgacactagtggatccaaagaattcggcacgagtgaattggagcaataattttaggaatggagcagaggggaagatttcaggactatactattttacaggtaaaatggacaggtcatggtgatagaatatggggaaggaggaaattgaagtgtgtcaagagtggttaccacgtttctgactagggtggttgggcaattttcatcaaggcagggaattcggaagaagcatgattttgaggtaagaggataaggttttatttctttgcagaaaaccgaagtggacgagtccaacaggtggctagatatccctgagtcctgatgctgtcaacccagctattagtagaaactcctaactggcctccctgtcccctgtcttgccccccttatatc

SEQ ID NO: 8228 - DNA, 397 bp, Homo sapiens
gacaataagctggagctcgcgcgcctgcaggtcgacactagtggatccaaagaattcggcacgagaatcagtcagttagcctaaacctattgattcctcgtgattatttccaatgtgaaaacagttgtgtatgattgcattaaaaatcatatcatcttttagaggttagaaaagggaaaactaaactttctaaatgctacttgagattgcagtaagaagatacgttttctaacctgaaagttaaatcgcatttgttttcttcagtagaatgggaatgtgttgctgttacttgtaatgtcaagtttatctgttaaatatgtccaaaaggcaaaatcattttttgttgcatgttatgggtccgatgttcctgtaattgcagtgccgtaaaaagcttatt

SEQ ID NO: 8229 - DNA, 174 bp, Homo sapiens
  misc_feature 2, 65: n = A,T,C or G
gnaaaagctggagctcgcgcgcctgcaggtcgacactagtggatccaaagaattcggcacgaggngcgtgtcaaaagaaggaacagctcgttctgcttcctgctgagtcggtgaattctttgctttctaaactcttccagaaaggactgtgagcaagatgaatttacttttctt

SEQ ID NO: 8230 - DNA, 398 bp, Homo sapiens
gaacaaaagctggagctcgcgcgccctgcaggtcgacactagtggatccaaagaattcggcacgagtcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttgggttggctggattcagtaat

SEQ ID NO: 8231 - DNA, 400 bp, Homo sapiens
gaacaataagctggagctcgcgcgcctgcaggtccgacactagtggatccaaagaattcggcacgagtctcactctgtcgcccaggctggagtgcagtggcgtgatctcggctcactgcagcttttgcctcctgggttcaagcaattatcctgcctcagcctcccaggtagctgggattacacgcatgagccactacccctagccgacatttttaagactttgttctcatgtcaaattttaccagtttacactcctaccagcagtctgacagtgcctttcgtagaacataaatcagtataagcatgacagtgtaaataaagaccttaaaaacacagtaggtaaacaaagatgaacaagaccattgtccctgacctaaagtaatagcctctgtattttttt

SEQ ID NO: 8232 - DNA, 233 bp, Homo sapiens
  misc_feature 124, 126, 146, 151: n = A,T,C or G
gaacaataagctggagctccgcgcgcctgcaggtcgacactagtggatccaaagaattcggcacgagctcgtgccgaattcggcacgagtaggaaaggaattattttccccccttttacagggnangtaactttctccacagaagngccantatggcaaaattacacaagaaaacagtattgcaattgacaccattacataaggaacattgaactgttagaggagtgctcttc

SEQ ID NO: 8233 - DNA, 400 bp, Homo sapiens
  misc_feature 176, 282: n = A,T,C or G
gacaataagctggagctcgcgcgcctgcaggtcgacactagtggatccaaagaattcggcacgagctcgtgccgaattcggcacgagtttggctgcatctttatacaacttttcttcattctgaatagtatttgggcacaccagatgtattacatgtttggcttcctatttctggngtttatcattttggttattacctgttctgaagcaactatacttctttgctatttccacctatgtgcagaggattatcattggcaatggcgttcattccttacgagnggctttactgcagtttatttcttaatctatgcaggacactactttcttttcaaaactgcagatcacgggaacagcaagcacaattctgtactttggttataccatgataatgggtttt

SEQ ID NO: 8234 - DNA, 400 bp, Homo sapiens
  misc_feature 169, 276, 303, 361, 375: n = A,T,C or G
gaaaaagctggagctcgcgcgcctgcaggtcgacactagtggatccaaagaattcggcacgagagatggcggaggtgcaggtcctggtgcttgatggtcgaggccatctcctgggccgcctggcggccatcgtggctaaacaggtactgctgggccggaaggtggtggncgtacgctgtgaaggcatcaacatttctggcaatttctacagaaacaagttgaagtacctggctttcctccgcaagcggatgaacaccaacccttcccgaggccccntaccacttccgggcccccagccgcatnttctggcggaccgtgcgaggtatgctgcccccacaaaaccaagcgaggccaggcccgntcttggaccgtctnaaggtgtttgacggcatcccaccgc

SEQ ID NO: 8235 - DNA, 339 bp, Homo sapiens
  misc_feature 200, 309: n = A,T,C or G
gacaataagctggagctcgcgcgccctgaggtccgacactagtggatccaaagaattcggcacgaggttcagtatctcaagcccagaaagatgaattaatccttgaaggaaatgacattgagcttgtttcaaattcagcggctttgattcagcaagccacaacagttaaaaacaaggatatcaggaaatttttggatggnatctatgtctctgaaaaaggaactgttcagcaggctgatgaataaagatctaaagagttaccctggctacagaaaagaagatgccagatgacacttaagacctacttgngatatttaaatgatgccataaaagacctat

SEQ ID NO: 8236 - DNA, 398 bp, Homo sapiens
gaacaataagctggagctcgcgcgcctgcaggtcgacactagtggatccaaagaattcggcacgaggtcaggagtcctgccctcagatttgagagtgcagaaccccgccagccccccaacttgcatgcaaaccctggcatgtgtgcctctttcctgagggatcgtccataaatatcaccagattatctaaaggttgggaaaggatccatgaaccaaaatagggcaagagccactggtcaagatgcttcccctctgcaattgcaaaagtggagtggattgtgtggtgagatgaggaagtttcattcttctcgtttgttttctcccagtacgagtatgcgttgagacatttgtaccgtgctggtcaaccctttgtgagaagccgtatccacttcacaggt

SEQ ID NO: 8237 - DNA, 400 bp, Homo sapiens
  misc_feature 25: n = A,T,C or G
gaaaataagctggagctcgcgcgcntgcaggtcgacactagtggatccaaagaattcggcacgagcggacgggagcgagtatgtccgctctgactcggctggcgtctttcgctcgcgttggaggccgccttttcagaagcggctgcgcacggactgctggagatggtggagtccgtcatgccggtggtggtgtgcacatttgagccccggtatagacagttcccccagctgaccagatcccaggtgttccagagcgagttcttcagcggactcatgtggttctggattctctggcgcttttggcatgactcagaagaggtgctggggtcacttttccgtatcctgatccttcccagtggacagatgaagaattaggtatcccctcctgatgatgaagact

SEQ ID NO: 8238 - DNA, 400 bp, Homo sapiens
gacaaaagctggagctcgcgcgcctgcggtcgacactagtggatccaaagaattcggcacgagagtatgtgccttgggggaggagggaaagattagctttgaacattcctggcgcatgctccattgtcttactattttaaaacattttaataatttttgaaaattaattaaagatgggaataagtgcaaaagaggattcttacaaattcattaatgtacttaaactatttcaaatgcataccacaaatgcaataatacaataccccttccaagtgcctttttaaattgtatagttgatgagtcaatgtaaatttgtgtttatttttatatgattgaatgagttctgtatgaaactgagatgttgtctatagctatgtctataaacaacctgaagacttgg

SEQ ID NO: 8239 - DNA, 400 bp, Homo sapiens
  misc_feature 207, 329, 366, 395: n = A,T,C or G
gaaaaagctggagctcgcgcgcctgcaggtcgacactagtggatccaaagaattcggcacgagtaacccacaggtgttggctgcctggcccatgtgcccactgtctcttccacttggtctgggtttggcaaggcacctgcctgctacttgagggccaggatgctcccccagggaagaaacggaatagtgtgggggtgtgtgcagggnctgcatcccgcagatggctgaaatattaaaattcttctatattggctggaaaattgccatggcccctgagccactgagtatgttcattgccacccctgtcccctccccctgggcaccccttnactttccctgatccctgcaattaaaagggttaaatgnggggcaatatggaaagggactcccaaggnccctt

SEQ ID NO: 8240 - DNA, 400 bp, Homo sapiens
  misc_feature 171, 273, 283, 298, 312, 322, 336, 348, 395: n = A,T,C or G
gaacaataagctggagctcgcgcgcctgcaggtcgacactagtggatccaaagaattcggcacgagggatgggcaagtgtcgtggacttcgtactgctaggaagctccgtagtcaccgacgagaccagaagtggcatgataaacagtataagaaagctcatttgggcacanccctaaaggccaacccttttggaggtgcttctcatgcaaaaggaatcgtgctggaaaaagtaggagttgaagccaaacagccaaattctgccattaggaagngtgtaagggnccagctgatcaagantggcaagaaaatcncagcctttgnacccaatgacggtngcttgaactttnttgaggaaaatgatgaggttctggttgctggatttggccgcaaaggncatgc

SEQ ID NO: 8241 - DNA, 288 bp, Homo sapiens
  misc_feature 25, 115, 225: n = A,T,C or G
gaacaataagctggagctccgcgcnccttcgcgggtcgacactagtggatccaaagaattcggcacgaggctgtttggggaaagtagcaagcacattttctgcaggcccattggntgctgttttgctttcatattctctcaccattaactatacagcagctagagcagaggagttgttaacaaaatatactttcactgctagccaaactatatacatgacttagnggtaatatttgattttatgtcatttacttatgtctctgtatgtcttacaccaagggactaaca

SEQ ID NO: 8242 - DNA, 400 bp, Homo sapiens
  misc_feature 348: n = A,T,C or G
gaacaatttgctggagcctcgcgcgcttgcaggttcgacactagtggatccaaagaattcggcacgaggccgcccaagatgccgaaaggaaagaaggccaagggaaagaaggtggctccggccccagcttgtcgtgaagaagcaggaggctaagaaagtggtgaatcccctgtttgagaaaaggcctaagaattttggcatttggacaggacatccagcccaaaagagacctcacccgctttgtgaaatggccccgctatatcagggttgcagcggcagagagccatcctctataagcggctgaaagtgcctcctgcgattaaccagttcacccagggccctggaccngccaaacaagctactcagcttgcttaagcctgggcccacaaagtacagacca

SEQ ID NO: 8243 - DNA, 180 bp, Homo sapiens
  misc_feature 9: n = A,T,C or G
gaacaatangctggagctcgcgcgccttgcaggtcgacactagtggatccaaagaattcggcacgagttgaggtgggagaatcacttcagcccactaggtcgaggctgtagtgagctataattgtaccactgcactccagcctcggggacagagtgagaccctgtctctactagaaatac

SEQ ID NO: 8244 - DNA, 396 bp, Homo sapiens
  misc_feature 27, 334: n = A,T,C or G
gaaaaagctggagctcgcgcgccttgnggtcgacactagtggatccaaagaattcggcacgagctttccccactccacgagtgagtcggcctccagagaagactggcacaattccaactagagtcaacccatgctgccctctgcccttcccactcagatctagatcctgctttcatttctggctagtgaagtagacttttgtgtttttgaggtttattagcaggtctgctcaggaaccaaactaatgagtagctttatattgggccaccccaatatatggctttgggggctgaaaaagcagatgtagacccccctccctcggatccttattggngtgcccctttagcactcccgcagactctgcggggggaacaggagtgatgataaaaatttttc

SEQ ID NO: 8245 - DNA, 400 bp, Homo sapiens
  misc_feature 20, 393: n = A,T,C or G
gacaaaagctggagctcgcncgcctgcaggtcgacactagtggatccaaagaattcggcacgagcccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaagtaaggcaggagagctgacttgggactcctggctcggccccaacagggagccccctttcccaccatncttcggc

SEQ ID NO: 8246 - DNA, 400 bp, Homo sapiens
  misc_feature 20, 24, 196: n = A,T,C or G
gaaataagctggagctcgcncgcntgcaggtcgacactagtggatccaaagaattcggcacgagtgtgtctgtcaaggatgttcgtcgtggcaacggttgctggtgacagcaaaaatgacccaccaatggaagcagctggcttcactgctcaggtgattatcctgaaccatccaggccaaataagcgccggctatncccctgtattggattgccacacggctcacattgcatgcaagtttgctgagctgaaggaaaagattgatcgccgttctggtaaaaagctggaagatggccctaaattcttgaagtctggggatgctgcattgttgatatggttcctggcaagcccatgtgtgttgagagcttctcagactatccacctttggtcgctttgtgttc

SEQ ID NO: 8247 - DNA, 358 bp, Homo sapiens
gacaataagctggagctcgcgcgcctgcaggtcgacactagtggatccaaagaattcggcacgagcacgaaaagaataaaacacctaggaatacagctaattaggaaggtgaactatgtctacaatgagaaatataaaacactgctcaaagaaatccaaggtgacacaaatggaaaaacatcccatgctcatggaaaggaagaatgaatattgttaaaatggctgtactgtctaaagaaatttacagatttaatgctattcctatcaaactacaaattacattcttcacagaactagataaaactattttaaaatctacatggaatcaaaacagaggtcaaatagctaaggcaatcct

SEQ ID NO: 8248 - DNA, 400 bp, Homo sapiens
  misc_feature 2: n = A,T,C or G
gnaaaagctggagctcgcgcgcctgcaggtcgacactagtggatccaaagaattcggcacgagcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgcctggtgaccgttttggcaattccatttcggcaaagaattca

SEQ ID NO: 8249 - DNA, 195 bp, Homo sapiens
  misc_feature 5: n = A,T,C or G
aaganaaaagctggagctcgcgcgcctgcaggtcgacactagtggatccaaagaattcggcacgagggcggttcagagatgttggaggacacccctcgccatctcgcccttgctgggggcacgggagtggggggggtgacatgggccctaggcagactgcaagcccgaccgagcacttggactcgaactctgtgc

SEQ ID NO: 8250 - DNA, 325 bp, Homo sapiens
  misc_feature 274, 298, 319: n = A,T,C or G
gaaaaagctggagctcgcgcgcctgcaggtcgacactagtggatccaaagaattcggcacgagcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggngacgccaacaccatcgtgtgcaanagcaaggacgggcggggcctnggggga

SEQ ID NO: 8251 - DNA, 390 bp, Homo sapiens
gacaataagctggagctcgcgcgcctgcaggtcgacactagtggatccaaagaattcggcacgaggagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaat

SEQ ID NO: 8252 - DNA, 389 bp, Homo sapiens
  misc_feature 11, 28, 29, 32, 36, 43: n = A,T,C or G
aaccataatantgaagtctgtgtgaccnnttnaagntgggacntctagtggatccaaagaattcggcacgaggctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgct

SEQ ID NO: 8253 - DNA, 400 bp, Homo sapiens
gacaataagctggagctcgcgcgcctgcaggtcgacactagtggatccaaagaattcggcacgagaaatcttattcttaaatgtacaaatcaaaagcttccttctctatgaagacgtctgatcactaccttcccagagaggaataacattgctcccctttgtcttccctaaacactaccatgtcatgagcacttccctcattgtgttatagtcggttggttctcttcatttccccctcagagatatttaggctttgtgaaatcatgtcttatttatctttgtgttttcagggcttaacacggtgcttgccacataaggaatgctcaatattttttgttagcttaattagaggaaagaaaattatactcttattccatataaaatagagtaggttttaaga

SEQ ID NO: 8254 - DNA, 338 bp, Homo sapiens
  misc_feature 25, 222: n = A,T,C or G
gaacaataagctggagctccgcgcncttcgcggtcgacactagtggatccaaagaattcggcacgaggccagggtgtggtggctcgacatgtaatcccaacactttgggagaccaaggcgggtggatcacctcaggtcgggagttcgagaccagcctgatcaacatggagaaaacccgtctctaccaaatatacaaaattacccaggcatggtggtgcattncttgtaatcctagctactcgggaggctgaggcaggagaatcacttgaacccaggaggtggaggttgctgtgaaccaagattgcgcccttgacaacaagagtgaaactccatccatc

SEQ ID NO: 8255 - DNA, 190 bp, Homo sapiens
  misc_feature 25, 76: n = A,T,C or G
gaacaataagctggagctccgcgcnccttcgcggtcgacactagtggatccaaagaattcggcacgagggcagtgnctcctattatgtacaattttagtgctaagtactgtgttaatgatggctatcaaacaatatgttaacatctgaaaggaaatatgtatattgagcataataaatattttataaata

SEQ ID NO: 8256 - DNA, 400 bp, Homo sapiens
  misc_feature 6, 21, 343, 361: n = A,T,C or G
gacaanaagctggagctcgcncgcttgcggtcgacactagtggatccaaagaattcggcacgagcaacagcagcagaaacatcagtatcagcagcgtcgccagcaggagaatatgcagcgccagagccgaggagaacccccgctccctgaggaggacctgtccaaactcttcaaaccaccacagccgcctgccaaggatggactcgctgctcattgcaggccagataaacacttactgccagaacatcaaggagttcactgcccaaaacttaggcaagctcttcatggcccaggctcttcaagaatacaacaactaagaaaagggaggttccagaaaagaagntacatgaactcttgaagncacaccagggcaactcttggaagaaatattatttgcata

SEQ ID NO: 8257 - DNA, 337 bp, Homo sapiens
gacaataagctggagctcgcgcgcttgcggtcgacactagtggatccaaagaattcggcacgagacaatcttcagttgctaatggtttactaactggcttgtaaatgaattcattcagtattcaagaaaatggcactacatttagaaacattttgtagcatttcttactttctaagaatttccaataggcaccatgatcactaaaaaatcataaccaggctgggggcagtggctcacgcctataattccaataatttgggagaccaaggagggaagatcacttgaggccaggagtttgagaccagcctgggcaacatagcaaagactccatctctac

SEQ ID NO: 8258 - DNA, 266 bp, Homo sapiens
  misc_feature 20: n = A,T,C or G
gaacaataatgctggagctngcgcgcttgaggtgcgacactagtggatccaaagaattcggcacgagtccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaag

SEQ ID NO: 8259 - DNA, 381 bp, Homo sapiens
  misc_feature 83: n = A,T,C or G
gacaataagctggagctcgcgcgcttgcggtcgacactagtggatccaaagaattcggcacgagacgagaacatgcctctcgnaaaggatctccttcatccctctccagaagaggagaagaggaaacacaagaagaaacgcctggtgaagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 8260 - DNA, 400 bp, Homo sapiens
  misc_feature 95, 296, 326: n = A,T,C or G
gaaaaagctggagctcgcgcgcctgaggtcgcactagtggatccaaagaattcggcacgagggcccccctagccaagctgtattctactccaagngagctgcaaacctctgctttcatcatgccttctcctgctccaatacttttactagctcttcactacatacaggataaagtctaaattccccaatcaacactaatggcttggcaaaaaaaaacccctatccactcagtaaatacttgctgaatgaatgaactcaacagagacgtggaacacgcccaccattctttgttttgnggtcactccattcttgccggctcaccttgnggatctgggccgccaatgctgcgccgttgctgaagctgtgttctgctgcttccggctctgagaggctggttcga

SEQ ID NO: 8261 - DNA, 274 bp, Homo sapiens
  misc_feature 7, 200: n = A,T,C or G
gacaatnagctggagctcgcgcgcctgcaggtcgacactagtggatccaaagaattcgccacgagattcaatggaaatacactttgctaatattttaatggtatagatctgctaatgaattctcttaaaaacatactgtattctgttgctgtgtgtttcattttaaattgagcattaagggaatgcagcatttaaatcangaactctgccaatgcttttatctagaggcgtgttgccatttttgtcttatatgaaatttctgtcccaagaaagg

SEQ ID NO: 8262 - DNA, 330 bp, Homo sapiens
  misc_feature 3, 6, 252, 298, 309, 318: n = A,T,C or G
tgnagntgcgacactagtggatccaaagaattcggcacgaggggatttgggtcgcggttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatggncgcaccctgtctgactacaacatccagaaagagtccaccctgcacntggtgctgcgnttgagaggngggatgcaaatc

SEQ ID NO: 8263 - DNA, 400 bp, Homo sapiens
  misc_feature 127, 247, 262, 321, 326, 381: n = A,T,C or G
gacaataagctggagctcgcgcgcctgcaggtcgacactagtggatccaaagaattcggcacgagctcgtgccgaattcggcacgagaaaaaacgggattcttgtttgatcaaaacaaaagcttgcngttactagtattaaaagcaaacacccaacaaagtaaaaagcccaaacatgtatttgtactaaaacctgaatacacctatacatttaaagaagcattttacttagaattatattttcctgnggaaacttgagtagngccaagagtatttacatctttgacatcacctttaccattcacagactacttaatcttanaatgngtttaattgaaaggtaagcatacttaactgtagaatgatcaggttgttttaatanagaagaactttggtttaat

SEQ ID NO: 8264 - DNA, 320 bp, Homo sapiens
gaacaataagctggagctcgcgcgcctgcaggtcgacactagtggatccaaagaattcggcacgaggctcgccttactttaaagctattttgccacagtcctgttaaatagtgtggacgtccttttgcagtctggtgtgcatgccatatgatcaggacagcttttccactttactcggtttcctacaagcaagtaggaaatacagtgaatttaccctaaaatgtccaatctgtatttatgtaccttgtcagtgttttgctgttggttttctaaaacaatctgatcaataaatcttatccaaatcaatttggttcaagttc

SEQ ID NO: 8265 - DNA, 384 bp, Homo sapiens
  misc_feature 3: n = A,T,C or G
ganaataagctggagctcgcgcgcctgcaggtcgacactagtggatccaaagaattcggcacgagagaaagggctacatctcccgaaatgatttctttacgtcatgtattggtttccttcttcaccttgaacttttgttgaactgtatgtactttaccccaaacctgttaatattttgagcgcttctatgtgaaagcaaagaaataattttaatactctggcattcataaattttattgatgagattatttattttaaaggtttgaggtaacatctctggttgtaccaaagaagaaataaatatggtttcttaatctcttgcatgttttcttataaataatcatgttcaatgaaaagaagttactgagcttatttagatacatt

SEQ ID NO: 8266 - DNA, 359 bp, Homo sapiens
  misc_feature 355, 358: n = A,T,C or G
gaaaataagctggagctcgcgcgcctgcaggtcgacactagtggatccaaagaattcggcacgagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggnggng

SEQ ID NO: 8267 - DNA, 199 bp, Homo sapiens
  misc_feature 3: n = A,T,C or G
ganaataagctggagctcgcgcgcctgcaggtcgacactagtggatccaaagaattcggcacgagggaagactggtctgcagctcccactgctcaggccactgaatgggtaggagcaaccactgactggtcttaagctgttcttgcataggctcttaagcagcatggaaaaatggttgatggaaaataaacatcagttt

SEQ ID NO: 8268 - DNA, 393 bp, Homo sapiens
  misc_feature 5, 25: n = A,T,C or G
gaaantaagctggagctcgcgcgcntgcaggtcgacactagtggatccaaagaattcggcacgagggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcgggctactacaaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactacttttt

SEQ ID NO: 8269 - DNA, 240 bp, Homo sapiens
  misc_feature 3, 6: n = A,T,C or G
ganaanaagctggagctcgcgcgcctgcaggtccgacactagtggatccaaagaattcggcacgagcctgggcaacattgtgaaaacctgtctcttaaaacaaaacaaaacaagccaggtgttgtgacacgtgcttgttgtatgagctacttgggaggctgaggatggaggttggcttgaacccagaaattgaggctgcagtgagctatgatagcaccactatattccagcctgggtgac

SEQ ID NO: 8270 - DNA, 239 bp, Homo sapiens
  misc_feature 115: n = A,T,C or G
gaaaaagctggagctcgcgcgcctgcggtcgacactagtggatccaaagaattcggcacgagttgtaatgttttttatacatatttctactgtacctctaagcatataacatgtnatgaccatgccttgcctatcttctcactacactggaaactccaggccacagtcacatcttagccttacctcctccagtttaacgtagcctgacacacagggcactctcaataaatcaccagcac

SEQ ID NO: 8271 - DNA, 165 bp, Homo sapiens
  misc_feature 67: n = A,T,C or G
gacaataagctggagctcgcgcgcctgcaggtcgacactagtggatccaaagaattcggcacgaggngcttttaaactctgccagaaaaaaataactattttgttttaatctactttttgtatttagtagttatttgtataaattaaataaactgttttcaagtc

SEQ ID NO: 8272 - DNA, 398 bp, Homo sapiens
acaaaagctggagctcgcgcgcctgcaggtcgacactagtggatccaaagaattcggcacgaggcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcg

SEQ ID NO: 8273 - DNA, 400 bp, Homo sapiens
  misc_feature 3: n = A,T,C or G
ganaataagctggagctcgcgcgcctgcaggtcgacactagtggatccaaagaattcggcacgagcgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattc

SEQ ID NO: 8274 - DNA, 400 bp, Homo sapiens
  misc_feature 3, 311: n = A,T,C or G
ganaaaagctggagctcgcgcgcctgcaggtcgacactagtggatccaaagaattcggcacgagggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttattttattgncttcctgtaagaccttcgggtcaaggcagaggcaggaaactaactggtgtgagtcaaatgccccctgagtgactgcccccagcccaggc

SEQ ID NO: 8275 - DNA, 269 bp, Homo sapiens
  misc_feature 181: n = A,T,C or G
gacaaaagctggagctcgcgcgcctgcaggtcgacactagtggatccaaagaattcggcacgagatatgttctgtgagaatagtagctttatctttgatataatacatagtctccaaataggtaatacttcgcaattgattagattttcagagtagatttagagttatctgtttttctggngagggtcaaatatttttgttaattaagctcacaaatttgataaattaagaattatctgcatttgtcttgtaacataataatgtgtaat

SEQ ID NO: 8276 - DNA, 400 bp, Homo sapiens
  misc_feature 4, 10, 55, 75, 81, 222, 225, 228, 279, 319, 320, 339, 378,394, 398: n = A,T,C or G
cgancttaanctggggcctcgccgcgcctgcggtcgacactagtggatccaaagnaattcggcacgagggtgccnttgccncatgtgaagtcactgtgccagcccagaacactggtctcgggcccgagaagacctcctttttccaggctttaggtatcaccactaaaatctccaggggcaccattgaaatcctgagtgatgtgcagcttgatcaagactggnganggngggggagccagcgaagccacgctgctgaacatgctcaacatctcccccttntcctttgggctggccatccagcaggtgttcgacaatggcnngcatctacaaccctgaagngctggatatcacagaggaaactctgcattctcgcttccngggggggggcccgcantgtngc

SEQ ID NO: 8277 - DNA, 193 bp, Homo sapiens
  misc_feature 9, 27, 99, 112, 115: n = A,T,C or G
gaacaatantgctggagcctcgccgcncctgcaggtcgacactagtggatccaaagaattcggcacgagctcgtgccgaattcggcacgaaaaaaatcnttaacctccctgntgntgacttcaacgaaatgatgtccaaagagcagttcaatgaagctcaacttgcattaattcgggatatacgtaggagggg

SEQ ID NO: 8278 - DNA, 400 bp, Homo sapiens
  misc_feature 67, 128, 143, 179, 217, 225, 285, 304, 330, 355, 392: n = A,T,C or G
gacaaaaagctggagctcgcgcgcctgcaggtcgacactagtggatccaaagaattcggcacgaggngaagtatagcctttatgtcagaaaaacattctttttagctgcttactttctcatgaaaagnaaagatgtttacagngatgccaagttttcaagtttctgtataacaacaggnagaggttctaatcatattgaaaactgtgttataatggnctgagccntgttgctaaggaaacaatagggtccaattttgtattcctgctctcctgtgctggaaaagngactgggtactgtacaggntcatgttctctggctgcaggtaaaangggctttttgcatttttgctctggnctttcaggccagaagcatgcatttttctacaagagcntcacaaca

SEQ ID NO: 8279 - DNA, 400 bp, Homo sapiens
  misc_feature 28, 229: n = A,T,C or G
gaacaataatgctggagcctcgcgcgcntgcggtcgacactagtggatccaaagaattcggcacgagctttggtagttgaagataaagttgaaggctacaagaagaccaaggaagctgttttgctccttaagaaacttaaagcctggaatgatatcaaaaaggtctatgcctctcagcgaatgagagctggcaaaggcaaaatgagaaaccgtcgccgtatccagcgcnggggccccgtgcatcatctataatgaggataatggtatcatcaaggccttcagaaacatccctggaattactctgcttaatgtaagcaagctgaacattttgaagcttgctcctggtgggcatgtggggacgtttctgcatttggactgaaagtgctttcccggaagttag

SEQ ID NO: 8280 - DNA, 400 bp, Homo sapiens
gacaataagctggagctcgcgcgcttgcggtcgacactagtggatccaaagaattcggcacgagatgtgatgctcagttctattttgatttattcattagtattcacttttacctttaaagtttacttgtagcaaatatgtttacattgataaagccagatatgttttgacaatgaaatttacatatcaagtactgcaaataaaaggtggtgctatgatatatgcttaggaggacagttttaatgattgtacttgcatgaacacaatcatatgatggtaaagcagaaacttaagaaaaaattgtttatgtgttatattcaattagcttaaataagttgctttgttatattttatttgaattgaactacgctaggcctaaatgccaataaaatatactttt

SEQ ID NO: 8281 - DNA, 118 bp, Homo sapiens
  misc_feature 6, 18, 33, 36, 39, 41: n = A,T,C or G
gagggnttgaagctacgntccctagggcatgtnttncananctttttactctcatacttctcttagcgctttctttactatgtaaaccaggggcatccaatcttttaggcttccctgg

SEQ ID NO: 8282 - DNA, 374 bp, Homo sapiens
  misc_feature 16, 19, 30, 99, 182, 209, 290, 354: n = A,T,C or G
taattcggcacgagcntgngggcgccgatngccatctctcaagaaaccaggaatctggatttttaaaaatttgaaatcaccaaagtttaagaaattggnttattttccaaaacattacatgagtcaaataaatcttattgggggacagaattcagcttgtggacttaacaatgggggagggntttattctagagcccccgccttaggcnttgattacagaggaatgcttttgaatttctaactctagaaattattagaaatctaaaagatctccagatggataaaatgangccctgtacttttatcagaaagcaaggggaaagtacccaatgatctccttttttgattactttnaactaaaaaaaaaaaaaaaa

SEQ ID NO: 8283 - DNA, 322 bp, Homo sapiens
  misc_feature 18, 20, 173, 174: n = A,T,C or G
taattcggcacgaggatncntggccgagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgnngggggaaggtcacgatcatgttaccatatcaagctgaaaatgtcaccactatctggagatttcgacgtgttttcctctctgaatctgttatgaacacgttggttggctggattcagtaataaatatgtaaggcctttctttttaaaaa

SEQ ID NO: 8284 - DNA, 399 bp, Homo sapiens
  misc_feature 14, 41, 372: n = A,T,C or G
ctggagctcgcgcncctgcaggtcgacactagtggatcttnagaattcggcacgaggaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgnttcttccttttttagttcttcaaagat

SEQ ID NO: 8285 - DNA, 282 bp, Homo sapiens
  misc_feature 6, 24, 48, 68, 76, 224, 225, 227: n = A,T,C or G
cgacanttagctggagctcgcgcncctgcaggtcgacactagtggatncaaagaattcggcacgaggnttacaagnactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaannangtttgtgatctctactactgttgattttgccctcggagcaaactgaataaagcaa

SEQ ID NO: 8286 - DNA, 400 bp, Homo sapiens
  misc_feature 8, 13, 33, 52, 54, 58, 63, 211, 212, 213, 379: n = A,T,C or G
attacccnttcantgggacgactagtggttttnaagaattcggcacgaggantnaacnaaggnaatgaaagatctgtataccgaaaactataaaacattgatgaaagaaactgaagatgacacaaataaatggaaaggtatctgtgttcatgaactggaagaactagtattattaaaatgttcatacgacccaaagcaatctacagatggnnngcaatccctatcaaaatttcaatgtcattcttcaaagaaatagaaaaagcaattctgaaattcatatggacccacaaaacacccctaatagctgaagcaacctggactaaaacaaagctagaggtattacactaccagatttcaaaatacattacaaagatatggnaatcaaaacaacatgcaatgg

SEQ ID NO: 8287 - DNA, 400 bp, Homo sapiens
  misc_feature 11, 12, 40, 59, 60, 62, 208, 215, 216, 217, 364: n = A,T,C or G
gctggagctcnngcccctgcaggtcgacactagtggattnaaagaattcggcacgagcnngncccaggccctcatcatgatccagcccattctctactcttactcctttcatgggccaccagagccagtactcttggatagcagcagcattctagctgacagaattttgctgatggatactttctttcaaattgtcatttatcttggngagaccnnngcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagncaggctcgattccttttgtccaaagtgaacccatct

SEQ ID NO: 8288 - DNA, 236 bp, Homo sapiens
  misc_feature 12, 39, 59, 68, 163, 181, 200: n = A,T,C or G
gctggagctcgnccgcctgcaggtcgacactagtggatncaaagaattcggcacgagtnataactggnttctgcttgtatccacacaacaccaggacttaagacaaatgggactgatgtcatcttgagctcttcatttattttgactgtgatttatttggagnggaggcattgtttttaanaaaaacatgtcatgtaggntgtctaaaaataaaatgcatttaaactcaaaaaaaa

SEQ ID NO: 8289 - DNA, 400 bp, Homo sapiens
  misc_feature 13, 22, 44, 70, 166, 174, 210, 221, 355: n = A,T,C or G
tctggagctcgcnccgccccgnaggtcgacactagtggatccanagaattcggcacgagtggtaggagcngggcctggagcccagggctcctgattcccaggccactgctctccacaacaccaagtcacagaatttcaagatcccacccagagtctgattttgcangatcctgngaggaacttgcctagcagtctgtggacccagactgngttcatttatngggtttctagacaaggtaaagtaggaattaagtagatgaaggcataaaggagcaactgaaacttacgggaacttgaaattctctcacaggggcagatgccatggggattttttgagactgcttctggggaaggngaaccacccatctactcagaagggaggggtcaggaatggctagca

SEQ ID NO: 8290 - DNA, 326 bp, Homo sapiens
  misc_feature 13, 25, 29, 33, 54, 55, 75, 76, 77, 80, 81, 82, 84, 86, 133,247, 257, 261: n = A,T,C or G
aacccactttttnctggagcctcgnagcncctnaggtccgacactagtggatcnnaagaattcggcacgagcccnnnttnnngngncctttattgtagcattgctgtctgcaagggagcccctagcccctggnagacatagctgcttcagtgccccttttctctctgctagatggatgtttgatgcacctggaggtcttttagcctgcccttgcatggcgcctgcttggaggggggggagagctctnctggcatgangccncaagttttcttgactggaggccatcaacccctcttgggtgagggcctttgttctgagccctggca

SEQ ID NO: 8291 - DNA, 134 bp, Homo sapiens
  misc_feature 8, 13, 24, 40, 82: n = A,T,C or G
tggagctnggagngcctgaggtgngacactagtggatccnaagaattcggcacgagccattccaatccattacaatcgagtngattccattccattccattccattccattccattccattccattccattcct

SEQ ID NO: 8292 - DNA, 400 bp, Homo sapiens
  misc_feature 7: n = A,T,C or G
gacaatnagctggagctcgcgcgcctgcaggtcgacactagtggatccaaagaattcggcacgagtgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagattgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatc

SEQ ID NO: 8293 - DNA, 400 bp, Homo sapiens
  misc_feature 6: n = A,T,C or G
gaacantaagctggagctcgcgcgcctgcaggtcgacactagtggatccaaagaattcggcacgagctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatct

SEQ ID NO: 8294 - DNA, 186 bp, Homo sapiens
  misc_feature 24, 27, 36: n = A,T,C or G
gaacacataagtctggaggctcgngcncctgcaggncgacactagtggatccaaagaattcggcacgagctgtcctctgccagcctacaggaggaaaagcaaggcttacagaaggatgttccttcaggaggaagcagcactaaaagcactctgagtcaagatgagtgggaaaccatctcaataaac

SEQ ID NO: 8295 - DNA, 400 bp, Homo sapiens
  misc_feature 5, 391: n = A,T,C or G
gaaanagctggagctcgcgcgcctgcaggtcgacactagtggatccaaagaattcggcacgaggtcatcctgagggtgcgacctccgccgcgatggtgacccggttcctgggcccacgctaccgggagctggtcaagaactgggtcccgacggcctacacatggggcgctgtgggcgccgtggggcttggtgtgggccaccgattggcggctgatcctggactgggtaccttacatcaatggcaagtttaagaaggataattaattacacaaacccttcacagactgctctggtgccttggggggtgctagctcctcccacctcagcacctgctgcatctgggagcagccccaagcctcaggatggacaagaggaaacccacagctcagcnttcaggctt

SEQ ID NO: 8296 - DNA, 301 bp, Homo sapiens
gaaaaagctggagctcgcgcgcctgcaggtcgacactagtggatccaaagaattcggcacgagctttgggaggccaaggcgggtaaatcacctgaggttgggagtttgagaccagcctgaccgacatggagaaaccctgtctctaccggaaatacaaaattggccgggcatgatggagcatccctgtagtcctagctacttgagacgctgaggcaggaaaattgcttgaacccgtgaggcaagaggttgcaatgagccgagatcgtgccattgcactccagcctgggcaataagagcagga

SEQ ID NO: 8297 - DNA, 400 bp, Homo sapiens
gacaaaagctggagctcgcgcgcctgcggtcgacactagtggatccaaagaattcggcacgaggagcatccaggtagaaatgcccagcaagtccttggagatataggaccagaatccaggagggaactagagtcaaaacaatagagttggtgactgggctgcatggaagtaatagaggcgacagggtggtggtgtctctctcacactgatgggaaaaatgaagctatcttcactcttgacatgtgcaataaataaaacaaagaaaaccattagatgctggcaaggtgtgaaactggcctcctgaaaagaaggtgggctggctcagcggaaattgggaaagagaggggaatattcatttatgctgagcttgctacatcccaagtgctctgacactgcattt

SEQ ID NO: 8298 - DNA, 343 bp, Homo sapiens
  misc_feature 14, 27, 145, 168, 178, 241, 250, 285, 295, 323: n = A,T,C or G
aaaaaccgaacatntaagctggagctncgcgcgcctgcaggtcgacactagtggatccaaagaattcggcacgagctcagcctcccgagtagctgggattacaggcatgctccaccatgcccagctaattttgtatttttagtanaaacggggtttcaccatattggncaaggctggnctcgaactccagacctcaggtgatccgcccacctcggcctcccaaactgctgggattacaggngtgagcccnccgcgcctggccagggactatactctttttaaaanagacatttgngggggctcacacaatatttgaaatagtncccctctaaaaaaaaaaaaa

SEQ ID NO: 8299 - DNA, 389 bp, Homo sapiens
  misc_feature 22, 24, 29, 313, 378, 382: n = A,T,C or G
cgacaaaagctggagctccgcncncttgnggtcgacactagtggatccaaagaattcggcacgagtgcggctccagcccagcccgctgctcactttccaccctctctccacctgcctctggtttctcaggcctctgctctccgacctctctcctctgaaaccctcctccacagctgcagcccatcctcccggctccctcctagtctgtcctgcgtccctctgtcccccgggtttcagagacaacttcccaaagcacaaagcagtttttccccctaggggggggaggaagcaaaagactctgtacctattttgnatgtgataataaatttggagaaggtttttaattaatttttggaatgcctgggaataaaggcatgngggnaaatgac

SEQ ID NO: 8300 - DNA, 400 bp, Homo sapiens
gacaataagctggagctcgcgcgcttgcggtcgacactagtggatccaaagaattcggcacgagatcaaaccagccacaacgttctgttaagcctaaacctaatccagagcaaggccctaatgctcttcaattctatggaggctgagagttgaggaagctgtggaagaaaagtttgaagctagcagagaataattcatgaggttgaaagaaagaagctgtctccagaacataaaagtgcaaggtgaagcagcaagtgctgatggagaacctccagcatgtgatccagaagacctagctgaaataactgacgagggtgactgcattaaataacaaattttcattgtagacaaaacagccttctattcaaagaagatgccatctaggactttcatggctaga

SEQ ID NO: 8301 - DNA, 318 bp, Homo sapiens
  misc_feature 4, 7, 54, 100, 105: n = A,T,C or G
gaanaanagctggagctcgcgcgcctgcaggtcgacactagtggatccaaaganttcggcacgagcagaggtgcaaggagctgggtatcacccgccctcnacatnaaactccgggccacaggaggaaaataggaccaagacccctggacctggggcccagtcggccctcagagcccttgcccgctcgggtatgaagatcgggcggattggaggatgtcacccccatcccctctgacagcactcgcaggaaggggggtcgccgtggtcgccgtctgtgaacaagattcctcaaaatattttctgttaataaattgcctt

SEQ ID NO: 8302 - DNA, 204 bp, Homo sapiens
  misc_feature 3, 28, 91, 99: n = A,T,C or G
ganaataagctggagctcgcgcgcttgnggtcgacactagtggatccaaagaattcggcacgaggggagataaacaagaaaagccaaaatnaaactttnaaagacaaaaacatttgagatgaaaattacattggatgaactaaaagcagattagaaactgcagaaagaaaagattagcaaacttgaagatacaagaacagacac

SEQ ID NO: 8303 - DNA, 132 bp, Homo sapiens
  misc_feature 76, 88, 94, 96, 114: n = A,T,C or G
gacaataagctggagctccgcgcgccttcgaaggtcgacactagtggatccaaagaattcggcacgagctcgtgcnagattggggacngagggngnaaggactcacagcgaccntttttttttctctgaaac

SEQ ID NO: 8304 - DNA, 400 bp, Homo sapiens
  misc_feature 241: n = A,T,C or G
gacaaaagctggagctcgcgcgcctgcggtcgacactagtggatccaaagaattcggcacgagtttgtctttgaccactgtcttttgaatgggcccacagtgtttatgtactcttaacaactcacagaataatacatgttcactttattttgtaaaattgggttgagaggaaactaatggagtttcattgtaactgtcctttgtaatttatataaatgtattattttcctatatccttggntcttttctgataatttacagatttagcttttcttttgttatataaactgctagccacaaattttagttatgtaaaaggctacccttgacaagaaaagacatactgtcatgtatttatattctagcatagactaaactgaataaaaatgctgataacagg

SEQ ID NO: 8305 - DNA, 370 bp, Homo sapiens
gaacaaaagctggagctcgcgcgcctgcaggtcgacactagtggatccaaagaattcggcacgagctcacttggcagtcactccccattctccctagctcctggcaacaacttaacctgtctctgtggatttgcctattctggacatttcatataaattgaatcataatttatgtagtcttttgtgactggcttcttttacttaggatgtttttaaggttcttactgttgtaggatgtatcaggagtttgtttttatgatgaatgttccatcttatggacgtaccacatttgtccattcattagttgacagacatttgaattgcttccacttcctggcttctatgaataatgctgccataaacatttgtg

SEQ ID NO: 8306 - DNA, 400 bp, Homo sapiens
  misc_feature 22, 194: n = A,T,C or G
gaaaaagctggagctccgcgcncttcgcaggtcgacactagtggatccaaagaattcggcacgagaaaatactgatgtgtgttttaactaactggtatattgatccatgggaggctgcacagaagaccctgcggccaggaggggcattgtcagtggctgcttctcctgagctccacgccttcattgcagctgantgttcgatacaatacacctgcttcacagccccatggacatccctacaggtactgtcatgtgaagccttgcctagtagttctctccagggcaaatgaagctcacagttttgcaaaggtggaaacctcttattcacatttgctttgattccccgatggagtagactgcctttgttccatacaggcaaagtaaggatattttaatatca

SEQ ID NO: 8307 - DNA, 310 bp, Homo sapiens
  misc_feature 15, 21, 32, 139, 219, 240, 247, 248, 279: n = A,T,C or G
aacacataatgctgnagcctntgtgaccttgnggtgggacacttagtggatccaaagaattcggcacgagcctcagcggcccccatcagcaccgcctccaccacccgcttgcagctcggcgccccgccccggggccgcntcgagtttcatgattctttagtctccttcaatctagatctgtccccaggattgtttaaaagcttactgacaaacctttgngactgtaaatgacctgaggtntacattnntctttacttggagaatagtaatttttttcantatgcctttaaaaggatccttacccatgaaa

SEQ ID NO: 8308 - DNA, 400 bp, Homo sapiens
  misc_feature 22, 29, 37, 315: n = A,T,C or G
gacaaaagctggagctcgcgcngcttcgngggtcganactagtggatccaaagaattcggcacgagcggcacgagcaggcctgagaaatgagttgaaatgtgcagaactgtagaaactttagaggcaacagattttgcctccccgatcagtgtgtgcctgtttacagcactatctatctttctctctccaaatgtcactgagccctttagatgtttatattcaccacgagaagccagtcataaagataaaggaaatttgtgcattataaatgcaatatcactgttttaaacttgactgttttatattattttttngggggatcaagtgttccgcaagctattccaactttacaagagaaattgtgattatgttcttttcacctgtgggttataaaaaatg

SEQ ID NO: 8309 - DNA, 400 bp, Homo sapiens
  misc_feature 213, 273: n = A,T,C or G
gacaataagctggagctcgcgcgcctgcaggtcgacactagtggatccaaagaattcggcacgagccaacatgggccgcgttcgcaccaaaaccgtgaagaaggcggccccgggtcatcatagaaaagtactacacgcgcctgggcaacgacttccacacgaacaagcgcgtgtgcggaggagatcgccattatccccagcaaaaagctccgnaacaagatagcaggttacgtcacgcatctgatgaagcgaattcagagaggcccagtaagnaggtatctccatcaagctgcagggaggaggagagagaaaaggagagacaattatgttcctgaggtctcagcctttggatcaggagattatttgaagtagatcctgacactaaggaaatgctgaagct

SEQ ID NO: 8310 - DNA, 317 bp, Homo sapiens
  misc_feature 118: n = A,T,C or G
gacaaaagctggagctcgcgcgcctgaggtcgcactagtggatccaaagaattcggcacgagctgtggagaagatgactaacgtgtcacggggaagagctccctgctgtgtgcctgcnccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatg

SEQ ID NO: 8311 - DNA, 400 bp, Homo sapiens
  misc_feature 8, 360: n = A,T,C or G
gaacaaanagcctggagctcgcgcgcctgcaggtcgacactagtggatccaaagaattcggcacgagcgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacactttgtgttcattgngggatgttaaagccaacaagcaccagattaaacaggctgt

SEQ ID NO: 8312 - DNA, 280 bp, Homo sapiens
  misc_feature 55, 69, 70, 71, 74, 106, 258, 259: n = A,T,C or G
gaacaataagctggagctcgcgcgcctgcaggtccgacactagtggatccaaagnaattcggcacgagnnngancgagaccctcctgcctaacacggtgaaacctngtctctactaaaaatacaaaaaaattagccgggcgaggaggccgggtgcctatagtcccagctgctcgggaggctgaggccggagaatggcatgaacccgggaggtggagcttgcatgtgagctgagattgcaccactgcactccaggctgnnctcagagcaagactccatctc

SEQ ID NO: 8313 - DNA, 379 bp, Homo sapiens
  misc_feature 13, 17, 210, 211: n = A,T,C or G
gctccgcgccccntcgnggtcgacactagtggatccaaagaattcggcacgagcttcagttgttcctccatggctagaaccataataaacaatgtacccgtaatttgtaacataaagtattggaatatgttagtaacaatcttgcagccttcctttccaaagttcattttattttgatcagttcagtatattgcactaattattttaggnnttttcattatatgaaagctaccatgtgtcagagatgatttaatctatttaagtgttggactgctaggagaacttgtacatttatgataatgcagaattaggaaaacggttcaccagtgtttagttttatattgaggtgctcaggttggaataaagtggtataaaaagc

SEQ ID NO: 8314 - DNA, 400 bp, Homo sapiens
  misc_feature 5, 6: n = A,T,C or G
aattnnctggagctcgcgcgcctgcggtcgacactagtggatccaaagaattcggcacgagcggcacgagccaacatgggccgcgttccgcaccaaaaccgtgaagaaggcggcccgggtcatcatagaaaagtactacacgcgcctgggcaacgacttccacacgaacaagcgcgtgtgcgaggagatcgccattatccccagcaaaaagctccgaaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagatttttgaagtagatcctgacactaaggaaatgctgaagctt

SEQ ID NO: 8315 - DNA, 328 bp, Homo sapiens
gacaataagctggagctcgcgcgcctgcaggtcgacactagtggatccaaagaattcggcacgagcaaagacgggagctatgtgaatttatatgacagctgtgtggatgatacctggaacccaaagatctttgtggtttttgatgccaaccaaatctatcctgagtacttgatagactttcattgatttcacttccaaatctcggtggtcaaggaagctttattcttttttgcaggaaggtttgctcttcagtcatctagccactaaatgttaattatctgatacttttgaaacagatatgaaaaaaagtggcctccatataaaaaga

SEQ ID NO: 8316 - DNA, 394 bp, Homo sapiens
  misc_feature 29, 129: n = A,T,C or G
gaacaataagctggagctcgcgcgcctgnaggtcgacactagtggatccaaagaattcggcacgagagaaggtggcccggaccatcggcatttctgtggatccgaggaggcggaacaagtccacggagnccctgcaggccaacgtgcagcggctgaaggagtacccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggccccgtgccaccgcccggctctttcggcatacgggc

SEQ ID NO: 8317 - DNA, 400 bp, Homo sapiens
  misc_feature 24: n = A,T,C or G
gacaaaagctggagctcgcgcgcntgcaggtcgacactagtggatccaaagaattcggcacgaggatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtctta

SEQ ID NO: 8318 - DNA, 348 bp, Homo sapiens
  misc_feature 18, 21: n = A,T,C or G
agctggagctcgcgcgcntgnaggtcgacactagtggatccaaagaattcggcacgagtgatgaccacagagctgggaaaattgttgtgaacctcacaggcaggctaaacaagtgtggggtgatcaagccccagatttgacgtgcaacctcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggactctggtgcttcc

SEQ ID NO: 8319 - DNA, 399 bp, Homo sapiens
  misc_feature 11, 33, 230: n = A,T,C or G
aacgaacattntgctggagctccgcgcgcctgnaggtcgacactagtggatccaaagaattcggcacgaggggataaccccttttttacttactgtaaagagtcattttcataaagatcaattcattgatttgttttttgtaaagctatcattcaatatatattataaattaatataaatttaagggaagctctatgtaaggagacttagagccaaactgtttaagctgnatcatcccaacaaagtatcctttcatgaacggggcatgcaatagcttaagaattgctaggattaaattaaggaaagtaaagctactcagagcagcaggttccacaagcacaaactttacacatttgtacaattttgaaatgcactacaataaacaaattagagcaacac

SEQ ID NO: 8320 - DNA, 400 bp, Homo sapiens
  misc_feature 2, 5: n = A,T,C or G
cntgnggtgcgacactagtggatccaaagaattcggcacgagcagcagcatatcctatttccccatgttggttggattcttaatagtttcaatagtttaatgtgaggtagaaagactcaaataattatattggaggtggaaatggtaaaggaaagacatatattattaatattgtgaagaaagaaaaatcctctaattgaagaggatccccttaactgaaggctaaaacccctcattgtttgacatttgacctttaatatatttcccagactcacagacaatatcttgaatctaaaggatttcgatgtatctaacaagaaagagattctgcacattcccagattctcagtgtgaaagcagggaattaatgctattcaaatgtaagagatcccagtctggg

SEQ ID NO: 8321 - DNA, 229 bp, Homo sapiens
  misc_feature 8, 19, 28, 31, 84, 153, 221: n = A,T,C or G
gtggatcnaagaattcggnacgaggttntantccacctctatgatcttgagactggtacctgcatctacatgaatagaatcagnggagaaacaatttttgttactgcacctcatgaagccacagctggaataattggagtaaacagaaagggncaagtaaggaaaccttgaaacttaagcaataaaataagataacctgatgagttgggaacaatcctgtncttttgag

SEQ ID NO: 8322 - DNA, 139 bp, Homo sapiens
  misc_feature 98, 102, 104, 106, 109, 115, 117, 119, 121, 130, 134, 135: n = A,T,C or G
acttaattggagtattatgacacttttccacacaaaggaaattaaaactaaaaaattcaggacataggaaataggatatatatatataaatatatatntaantntnatncatatntnangnaattatgtntgtnntggg

SEQ ID NO: 8323 - DNA, 170 bp, Homo sapiens
  misc_feature 5, 49: n = A,T,C or G
ccacnttttgctggagctcgcgcgcctgaggtcgacactagtggatccnaagaattcggcacgaggtctttacctatctccaagtctccaagtggttcactgagctaacattaatctaatttaattctcaaccagatttgaaaaagggagattaattggataaaaatgta

SEQ ID NO: 8324 - DNA, 400 bp, Homo sapiens
  misc_feature 4, 18, 275, 337, 362: n = A,T,C or G
gctngtgcgcctgctggncgcacttgtggatccaaagaattcggcacgagccattaggtgatacatagataagggctttttctccccgcaaacacccctaagaatggttctgtgtatgtgaatgagcgggtggtaattgtggctaaatatttttgttttaccaagaaactgaaataattctggccaggaataaatacttcctgaacatcttaggtcttttcaacaagaaaaagacagaggattgtccttaagtccctgctaaaacattccattgntaaaatttgcactttgaaggtaagctttctaggcctgaccctccaggtgtcaatggacttgngctactatatttttttattcttggnatcagtttaaaattcagacaaggcccacagaataagat

SEQ ID NO: 8325 - DNA, 329 bp, Homo sapiens
  misc_feature 12, 59, 120, 188, 212, 257, 280: n = A,T,C or G
gcactttgtggntccaatgaattcggccgagtaacccttactttttctgcattattttnatagttatgcttcttgcttcctggaaccaatcagctacagcatcacttctcaaaatgtggnctcagtactgcctacatcagattaaataggtgcattgtaaaatgtagatttctgcattccagggtcangacctatttaatcttaatattagnccagggacccgaaaatatccattttacaaaacaaatacgcattgnctttattatgcaaataacaattnggcccctcctgatgtaatgtttaaatataaagtttaatatctatcggtt

SEQ ID NO: 8326 - DNA, 278 bp, Homo sapiens
  misc_feature 1, 6, 65, 66, 80, 224, 235, 237, 240: n = A,T,C or G
nctggngctcgcgccgccccgcaggtcgacactagtggatccaaagaattcggcacgagccgagnngcgcggaggcggangcttgggtgcgttcaagattcaacttcacccgtaacccaccgccatggccgaggaaggcattgctgcttggaggtgtaatggacgttaatactgctttacaaggaggttctgaagactgccctcatccacgatggccctagcanggggggaattngngangctgccaaagccttaaaacaagcgccagccccattttt

SEQ ID NO: 8327 - DNA, 197 bp, Homo sapiens
  misc_feature 2, 11, 45, 166: n = A,T,C or G
cnaggctgacncaacactccagaaagagtccaccctgcacctggngctccgtctcagaggtgggatgcaaaatcttcgtgaagaccctgactggtaagaccatcaccctcgaggtggagcccagtgacaccatcgagaatgtcaaggcaaagatccaagataaggnaggcatccctcctgattagcagaggttgatc

SEQ ID NO: 8328 - DNA, 133 bp, Homo sapiens
  misc_feature 11, 25, 34, 55, 67, 83, 85, 89, 114, 121, 130, 133: n = A,T,C or G
tagtggatccnaagaattcggcacnagcttcagngatatacttggtagatatctnaagccttttgtnttttacacaatggggntntatnctattgttttcttttgaaaggaagnatggtgnacactggcnttn

SEQ ID NO: 8329 - DNA, 263 bp, Homo sapiens
  misc_feature 3, 15, 69, 152, 187, 196, 223, 228, 249: n = A,T,C or G
cgngcttaggaaggncgacctgtggcaaatgtggctaccctgccaagcgcaagagaaagtataactggngtgccaaggctaaaagacgaaataccaccggaactggtcgaatgaggcacctaaaaattgtataccgcagattcaggcatggnttccgtgaaggaacaacacctaaacccaagagggnagctgttgnaagcatccagttcatcttaagaatgtnaacgnttaggcatgcaataaatgggntgggtttaaaaaat

SEQ ID NO: 8330 - DNA, 120 bp, Homo sapiens
  misc_feature 2, 4: n = A,T,C or G
tngngtattgcggcaagaaggcccagctcaacattggcaatgtgctccctgtgggcaccatgcctgagggtacaatcgtgtgctgcctggaggagaagcctggagaccgtggcaagctgg

SEQ ID NO: 8331 - DNA, 311 bp, Homo sapiens
  misc_feature 23, 55, 107, 259: n = A,T,C or G
tggacactccatgctgaactgcntgagggcctcttccagagccaactgctgtgcnggggcccaagcctagcatctaagcctgttccctgttcaggtaaagccccagngattgagcttcttggctgccttgttctcagggtttgttttggaagtagaaaaaatagtggtctcactgcttatttagatgtgattcactagtcaccatggactttgaccctaaggatagttagaggaaatagggcatttgcttgtgctgagnggcagaaccagcattgagtgggcacctatcatgagttagacctgtactatgg

SEQ ID NO: 8332 - DNA, 327 bp, Homo sapiens
  misc_feature 6, 17, 41, 44, 55, 67, 80, 161, 191, 193, 224, 235, 252, 313: n = A,T,C or G
tgtgancttgaaatgcnacactagtggattcaaagaattcnttncgagctctggnccgccgccgccncgatgggcgtgcntcgggaacagtaagaccgaggaccagcgcaacgaggagaaggcgcagagtgaggccaacaaaaagatcgagaagcagctgnaggaaggacaagcaggtttaccgggccacncnccccctgctgctgttgggtgcttggagaatntggtaaaagcnccattgtgaagcagatnaggatcctgcatgttaatgggtttattggagacagggagaaggcaaccaaagtgcaggacntcaaaaacaacctg

SEQ ID NO: 8333 - DNA, 500 bp, Homo sapiens
  misc_feature 21, 26, 59, 71, 73, 147, 150, 254, 455, 465, 482: n = A,T,C or G
cttcttttgggaaaaaaaccnggatnttttgggcgcttgcaggtccacactagtggatncaaagaattcgntncgagtttgagtgaagctcttcctggggacaatgtgggcttcaatgtcaagaatgtgtctgtcaaggatgttcgncgnggcaacgttgctggtgacagcaaaaatgacccaccaatggaagcagctggcttcactgctcaggtgattatcctgaaccatccaggccaaataagcgccggctntgcccctgtattggattgccacacggctcacattgcatgcaagtttgctgagctgaaggaaaagattgatcgccgttctggtaaaaagctggaagatggccctaaattcttgaagtctggagatgctgccattgttgatatggttcctggcaagcccatgtgtgttgagagcttctcagactatccacctttgggtcgctntgctgttcgngatatgagacagacagntgcgggggggtgtcatca

SEQ ID NO: 8334 - DNA, 346 bp, Homo sapiens
  misc_feature 2, 45, 47, 68, 72, 116, 313, 318: n = A,T,C or G
tnttgggcgcttgaaggtccgacactagtggatccaaagaattcngntcgagcagattatcatggccntggnagacgaatttgggtttgaaattcctgatatagatgctgaaaagntaatgtgtccacagagaaattgtagattacattgcagataagaaggatgtatatgaataaagtatcagaccctttggctttgctgagagaggactcagatgatagtgacgaatgtctggcagtgaggacacattttggcattcttgctgactctgacagagtgattctgatggacttgtatttaaattgtatgtgtnttacntctttgaaaataaatctataaaaccaac

SEQ ID NO: 8335 - DNA, 498 bp, Homo sapiens
  misc_feature 2, 3, 45, 83, 138, 419, 430: n = A,T,C or G
tnnttgggcgcttgaggtccccactagtggatccaaagaattctntcgagctcatgctgtcttatgtcacgtgtgggactgcngaactagaagacatcatgttcttctcctgcaaagtccccaggacgcctggaggcnggtgggggtgacggaagggagctaatgctccaagtccacttcagccggagcagcttttagtgtttgttggtcggtctgttgattaccttggaagattttattggaagaaagcatttgaggaccaagttaatctactctttcaataccaacccagaaaccttaaagaaaatcttgacagatttaataggataagagttttttaaaaaatctctttggcaaaagactccgtcagccgggctaagagacgagagagaaaatacataccacattatgcctgtgtnagcttaatagncaatatataaagagcttttacagaccaataaggagagcatgagatcaccattgcaagatgagcagaac

SEQ ID NO: 8336 - DNA, 231 bp, Homo sapiens
  misc_feature 3, 5, 110: n = A,T,C or G
gcncntgaggtcgacactagtggatccaaagaattcggacgagcaacaagggagctcactcagtgggtttgatgtggtggatgctggctcgggaagttctgcgcatgcgnggaaccatttcccgtgaacacccatgggaggtcatgccctgatctgtacttctacagagatcctgaagagattgaaaaaagaagagcaggcttgttgtggaaaaggcagtgaccaaaggag

SEQ ID NO: 8337 - DNA, 100 bp, Homo sapiens
  misc_feature 5, 11, 78: n = A,T,C or G
ggtcnacactngtggatcaaagaattcggacgagtaaccttacactaatctttaagaattacatgattatgagggttntcatcagagcaattaaattaaa

SEQ ID NO: 8338 - DNA, 359 bp, Homo sapiens
  misc_feature 26, 345: n = A,T,C or G
gaacaataagctggagctcgcgcgcntgagggtcgacactagtggatccaaagaattcggcacgagtgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatattttttgatctttgagtgtattctatttgtgtaacggactttggcttacatttgaataatgtctagattttgaaaaattacctgtataatggagaattaaaactttgnagacattttgaaat

SEQ ID NO: 8339 - DNA, 398 bp, Homo sapiens
gacaataagctggagctcgcgcgcctgcaggtccgacactagtggatccaaagaattcggcacgagggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttc

SEQ ID NO: 8340 - DNA, 398 bp, Homo sapiens
  misc_feature 32, 174, 222, 226, 259, 265, 288, 308, 325, 362, 379, 393: n = A,T,C or G
acaataatgctggagctcgtgcgccttgagtncgacactagtggatccaaagaattcggcacgagttctcctctgcgctatgtggacattgccatcccatgcaacaacaagggagctcactcagtgggtttgatgtggtggatgctggctcgggaagttctgcgcatgcgtggnaccatttcccgtgaacacccatgggaggtcatgcctgatctgtacttntacngagatcctgaagagattgaaaaagaagagcagnctgctnctgaaaaggcagtgaccaaaggnggaatttcagggtgaatggncttgctcccgctccctngatttcactgctactccagcctgaggttgcaggactnggtctgaaggtgtacanggggcccctctgtngccta

SEQ ID NO: 8341 - DNA, 288 bp, Homo sapiens
  misc_feature 3, 25: n = A,T,C or G
ganaataagctggagctcgcgcgcntgcaggtcgacactagtggatccaaagaattcggcacgagaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaataaaaata

SEQ ID NO: 8342 - DNA, 245 bp, Homo sapiens
  misc_feature 2, 204, 237, 242: n = A,T,C or G
gnaggtcgacactagtggatccaaagaattcggcacgagggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagnacctgattgtatttttttttttaaataaaagcncaagncct

SEQ ID NO: 8343 - DNA, 320 bp, Homo sapiens
  misc_feature 9, 70, 256, 260, 270, 302: n = A,T,C or G
gaacaatangctggagctcgcgcgcctgcaggtcgacactagtggatccaaagaattcggcacgaggccnagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctntgcnggttcctggngaacgccatcatcaacagtgggccccgggagnactccacacgcattgggc

SEQ ID NO: 8344 - DNA, 400 bp, Homo sapiens
  misc_feature 3: n = A,T,C or G
gancaataagctggagcctcgcgcgcctgcaggtccgacactagtggatccaaagaattcggcacgagggaggccaagtacaagttgtgcaaagtgagaaagatctttgtgggcacaaaaggaatccctcatctggtgactcatgatgcccgcaccatccgctaccccgatcccctcatcaaggtgaatgataccattcagattgatttagagactggcaagattactgatttcatcaagttcgacactggtaacctgtgtatggtgactggaggtgctaacctaggaagaattggtgtgatcaccaacagagagaggcaccctggatcttttgacgtggttcacgtgaaagatgccaatggcaacagctttgcactcgactttccaacatttttgttat

SEQ ID NO: 8345 - DNA, 400 bp, Homo sapiens
  misc_feature 3, 50, 296, 397: n = A,T,C or G
aantctggagctccgcgcgccctgcaggtcgacactagtggatccaaagnaattcggcacgagaaacaaattgggatctgtcttggcattaaaccacatcatggaccaaatgtgccatactaatgatgagcatttagcacaatttgagactgaaatttagtacactatgttctaggtcagtctaacagtttgcctgctgtatttatagtaaccattttcctttggactgttcaagcaaaaaaggtaactaactgcttcatctccttttgcgcttatttggaaattttagttatagngtttaacctggcatggattaataagagttggagttttatttttaagaaaaattcacaagctaacttccactaatccattatcctttattttattgaaatgnata

SEQ ID NO: 8346 - DNA, 400 bp, Homo sapiens
  misc_feature 30, 371: n = A,T,C or G
gaacaataagctggagctcgcgcgccctgnaggtcgacactagtggatccaaagaattcggcacgagttgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttattttattgtcttcctgnaagaccttcgggtcaaggcagaggcagga

SEQ ID NO: 8347 - DNA, 356 bp, Homo sapiens
  misc_feature 9: n = A,T,C or G
gaacaatangctggagctcgcgcgcctgcaggtcgacacctagtggatccaaagaattcggcacgagcccgacgttactcggactaccccgatgcatacaccacatgaaacatcctatcatctgcaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcct

SEQ ID NO: 8348 - DNA, 130 bp, Homo sapiens
  misc_feature 7, 26: n = A,T,C or G
gacaatnagctggagctcgcgcgccntgcaggtcgacactagtggatccaaagaattcggcacgagaacgaatagtgtggatgtgatttgtcatccagtattaagttcttagtcattgatttttgtgttt

SEQ ID NO: 8349 - DNA, 400 bp, Homo sapiens
  misc_feature 12, 15, 61: n = A,T,C or G
aaaaacgaacantantctggggctcgcgcgccctgcaggtcgacactagtggatccaaagnaattcggcacgagaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacact

SEQ ID NO: 8350 - DNA, 315 bp, Homo sapiens
  misc_feature 20, 69: n = A,T,C or G
atctggggctcgccgcgccntgcaggtcgacactagtggatccaaaaattcggcacgagcttgaacagnacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctatgg

SEQ ID NO: 8351 - DNA, 400 bp, Homo sapiens
  misc_feature 395: n = A,T,C or G
gaaaaagctggagctcgcgcgcctgcggtcgacactagtggatccaaagaattcggcacgagcacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaaagagggcccagcccagagccacctggatctatccctgcggcctccacacctgaacttgcctaactaactggcaggggagacaggagcctagcggagcccagcctgggagcccaggagggggggcaagaacagnggggc

SEQ ID NO: 8352 - DNA, 400 bp, Homo sapiens
  misc_feature 340: n = A,T,C or G
gaacaataagctggagctcgcgcgcctgcggtcgacactagtggatccaaagaattcggcacgagtgatgacaaaaacaaaacggacccaggggttcatgctaccctgaagtcactcagtagtcagattgaaaccatgcgcagccccgatggctcgaaaaagcacccagcccgcacgtgtgatgacctaaagctttgccattccgcaaagcagagtggtgaatactggattgatcctaaccaaggatctgttgaagatgcaatcaaagtttactgcaacatggaaacaggagaaacatgtatttcagcaaacccatccagtgtaccacgtaaaacctggngggccagtaaatctcctgacaataaacctgtttggtatggtcttgatatgaacagagggt

SEQ ID NO: 8353 - DNA, 400 bp, Homo sapiens
  misc_feature 6, 28, 32, 67, 159, 265, 310, 326, 349, 382, 386: n = A,T,C or G
gacaanagctggagctcgcgcgccctgnggtngcactagtggatcaaagaattcggcacgagctcgngccgaattcggacgagcctaccgccagctcttccaccctgagcagctcatcacaggcaaggaagatgctgccaataactatgcccgagggcnctacaccattggcaaggagatcattgaccttgtgttggaccgaattcgcaagctggctgaccagtgcaccggtcttcagggcttcttggttttccacagctttggngggggaactggttctgggttcacctccctgctcatggaacgtctntcagttgattatggcnaagaagcccaagctggggttctncatttacccagcacccccagggtttccacaagngtgnggggtggagcccct

SEQ ID NO: 8354 - DNA, 360 bp, Homo sapiens
  misc_feature 195, 263, 302, 324: n = A,T,C or G
gaaaaagctggagctcgcgcgcctgcgggtcgacactagtggatccaaagaattcggcacgagctcgtgccgaattcggcacgagtgggaagtgtaccagagctgctgattgttctagaaccaccccactattccaagtttattaggctcagagccactgagagccttgagttctgggcacttctgtcacccatntccttttgcagcaccagacaaagaattttcctttttagcctcattgtttgcatgccttaggagtcggncactgtgctccttcgtagtctttgggtctcagaaatagngaacaggtacagcatccagggnggaatttttgcctttagtaccctcccttgaactctt

SEQ ID NO: 8355 - DNA, 294 bp, Homo sapiens
  misc_feature 115: n = A,T,C or G
aagcattgatttaaaagatgcacggaaagttatcttacagcaaactgtagtttgcctccaagacaccattgtctccctttaatcttctcttttgtatacatttgttacccatggngttctttgttccttttcataagctaataccactgtagggattttgttttgaacgcatattgacagcacgctttacttagtagccggttcccatttgccatacaatgtaaggttctgcttaatgtaacttcttttttgcttaagcatttgcatgactattagtgcttcaaagtcaatttt

SEQ ID NO: 8356 - DNA, 400 bp, Homo sapiens
  misc_feature 33: n = A,T,C or G
gaacaataagctggagctcgcgcgcctgcaggncgacactagtggatccaaagaattcggcacgagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactc

SEQ ID NO: 8357 - DNA, 288 bp, Homo sapiens
  misc_feature 2, 11, 29, 53, 61, 279: n = A,T,C or G
tnggcaacttntaactggagcctcgtgcnccttgccagttcgacactagtggntccaaagnaattcggcacgagggcaaaccgggccaacaggggcctccaggagaggtgggacccccgaggaccccaggggcttcccttggcagtagaggagaattaggaccagtgggatcccccaggccctaccaggtaaactgggttctctgggtagcccctggccctcccttgctttgccttgggcccccgtggactttcctggaatgaaaaggtgacaaggggntgtagtccg

SEQ ID NO: 8358 - DNA, 348 bp, Homo sapiens
gaaaaaagctggagctcgcgcgcctgcggtcgacactagtggatccaaagattcggcacgaggtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttattattcagtgaaaagattttatttatggaattaaccatttaataaagaaatatttaccta

SEQ ID NO: 8359 - DNA, 400 bp, Homo sapiens
  misc_feature 267, 368, 384: n = A,T,C or G
gacaataagctggagctcgcgcgcctgcaggtcgacactagtggatccaaagaattcggcacgagcagcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggnattttctcctggggctcagagtgttgtactcgtaaaacaaggatattcgatgttgtctacaatgcatctaataacgagctggttcgtaccaagaccctggngaagaattgcatcggngctcatcgacagcaca

SEQ ID NO: 8360 - DNA, 273 bp, Homo sapiens
gacaataagctggagctcgcgcgcctgcaggtcgacactagtggatccaaagaattcggcacgagtgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggc

SEQ ID NO: 8361 - DNA, 400 bp, Homo sapiens
  misc_feature 124: n = A,T,C or G
gacaataagctggagctcgcgcgcctgcaggtcgacactagtggatccaaagaattcggcacgagcacaaacatttatggaatggtaaaaattttgagcttcaaacaattgaataccatttggngatgcaagaaaatgctaattttaaaaatagcttctgattttggaattatggaagtctaaatataatgttttctcactttaaaatggaaaaaactttcgtgctgtttctaaaacacaacataaaaagggaaaaccatttggcactgtgtacacacaggaacatcccagttttagtttttaatcatgtttttcaaggaaacaattactttctccaaatgcatggtttttaaagagtacttcgtatttccaggacatcttcttttgacctagtgtgttt

SEQ ID NO: 8362 - DNA, 400 bp, Homo sapiens
gacaaaagctggagctcgcgcgccctgcaggtcgacactagtggatccaaagaattcggcacgagcggcacgagcctgattgtggaaagaagtgagatgcaccttattttcaagaagtcctgggaagcgctctcctagcacgtccatttccaggaggagaagcaagcagatgagaggttttccattttgtcatccaaggtagctgtgcacttgccttgttgctgaagttccaataatgtgaaaaccaaagtagaggtttttttcttcttctttttgttttctattaatttcacttataccaaagtgtttgaaagtatgaaatgtgttgcttctgagttatataaggctacttcatgacaagactgctttgtaatatttcactttgttttactacaaattc

SEQ ID NO: 8363 - DNA, 295 bp, Homo sapiens
  misc_feature 88, 110, 219, 293: n = A,T,C or G
gaacaaaaagctggagctcgcgcgccctgcaggtcgacactagtggatccaaagaattcggcacgagctcgtgccgaattcggcacgnggtgtttgcaagaggtgtgcantcaccttcgaccaggcccaacctgaccgtcaagctgccagatggatacgaaattcaagttccccaaccgcctcaacctggaggccatcaactacatggcagttgacggngacttcaagatcaaatgtgtggcctttgactgaaatcagccagcccatggcccccaataaaggcggctgccttntg

SEQ ID NO: 8364 - DNA, 159 bp, Homo sapiens
gacaataagctggagctcgcgcgcctgcaggtcgacactagtggatccaaagaattcggcacgagggaaaatcgcttgaaccccggaagcggaggttgcagtgagctgagattgcgacattgttctccagcctgggcaagaagagtgaaattctgtctc

SEQ ID NO: 8365 - DNA, 271 bp, Homo sapiens
gaacaaaagctggagctcgcgcgcctgcaggtcgacactagtggatccaaagaattcggcacgagattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaat

SEQ ID NO: 8366 - DNA, 400 bp, Homo sapiens
gaacaataagctggagctcgcgcgccctgcaggtcgacactagtggatccaaagaattcggcacgaggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatc

SEQ ID NO: 8367 - DNA, 398 bp, Homo sapiens
gaaaaaagctggagctcgcgcgcctgcaggtcgacactagtggatccaaagaattcggcacgagcaagcgcgctgcggttccggtggcgccatgtcgttctgcagcttcttcgggggcgaggttttccagaatcactttgaacctggcgtttacgtgtgtgccaagtgtggctatgagctgttctccagccgctcgaagtatgcacactcgtctccatggccggcgttcaccgagaccattcacgccgacagcgtggccaagcgtccggagcacaatagatctgaagccttgaaggtgtcctgtggcaagtgtggcaatgggtttgggccacgagttcctgaacgacggccccaagccggggcagtccccggattctgaatattcagcagcttcgctg

SEQ ID NO: 8368 - DNA, 281 bp, Homo sapiens
  misc_feature 24, 114: n = A,T,C or G
gacaataagctggagctccgcgcncctgcggtcgacactagtggatccaaagaattcggcacgagcttcctgtaagaccttcgggtcaaggcagaggcaaggaaactaactggngtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattg

SEQ ID NO: 8369 - DNA, 400 bp, Homo sapiens
  misc_feature 32: n = A,T,C or G
gacaataatgctggagcctcgtgcgccctganggtcgacactagtggatccaaagaattcggcacgagggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggcttttgtgttcaccaagga

SEQ ID NO: 8370 - DNA, 398 bp, Homo sapiens
  misc_feature 1, 27, 32, 222, 223, 337: n = A,T,C or G
nccatttatgtgagtcgattacatttnctggncgcaagtggatccaaagaattcggcacgagattgggcaccaagagtcttgcagggggacccacagatatgccatgtccttcacacgtgcttgggctccttaacctgaaggcaaattgctacttgcaagactgactgacttcaaggaatcagaaattacctagaagcaccatgtttttttctatgaccttnncggtccttcaggtcattttaaggtccactgcagggggttagtgagaaagggtatactttgtggtatgttttgctttcctaatagggacatgaaggaaacccagcaatttgctgntatggggaatggcctgtagagcagagtcaagagcggtgtgctttgccccgactgctcccat

SEQ ID NO: 8371 - DNA, 400 bp, Homo sapiens
  misc_feature 40, 266, 388: n = A,T,C or G
gaacaataatgctggagctcgcgcgcctgcaggtcgacanctagtggatccaaagaattcggcacgaggctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctgggggncaacatgaagggcaatgacatcagcagtggcacagtcctctccgattatgtgggctcggggcctcccaagggcacaggcctccaccgctatgtctggctggtttacgagcaggacaggccgntaaagtgtgacg

SEQ ID NO: 8372 - DNA, 281 bp, Homo sapiens
  misc_feature 222, 239, 246, 264, 276: n = A,T,C or G
gaaaaagctggagctcgcgcgcctgcaggtcgacactagtggatccaaagaattcggcacgagggcaggtgtttgagaagtcccccctgcgggtgaagaacttcgggatctggctgcgctatgactcccggagcggcacccacaacatgtaccgggaataccgggacctgaccaccgcaggcgctgtcacccagtgctacccgagacatgggtgccccggcncccgggcccggagcccnacttcanttcagatcattgaaaggngggagggagatncggcg

SEQ ID NO: 8373 - DNA, 400 bp, Homo sapiens
gaacaataagctggagctcgcgcgccctgcaggtcgacacctagtggatccaaagaattcggcacgagcgagtgtgtcatgctggcctgtgaggtggaccgagaggacgcccctgtgcgttggtacaaggacgggcaggaggtggaggagagtgacttcgtggtgctggagaatgagggcccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagcccgtgcgcctggagcgtgtggtgctgacctgtgagctatgccggcccttgggcaagaggtgcgcttgg

SEQ ID NO: 8374 - DNA, 400 bp, Homo sapiens
  misc_feature 3: n = A,T,C or G
ganaaaagctggagctcgcgcgcctgcaggtcgacactagtggatccaaagaattcggcacgagcggcacgagattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaacccccccaaaagccaaaaaatgggagacaatttcacatggactttggaaaatatttttttcctttgcattcatctctcaaacttagtttttatctttgaccaaccgaacatgaccaaaaaccaaaagt

SEQ ID NO: 8375 - DNA, 222 bp, Homo sapiens
gacaaaagctggagctcgcgcgcctgcaggtcgacactagtggatccaaagaattcggcacgaggaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctcc

SEQ ID NO: 8376 - DNA, 101 bp, Homo sapiens
  misc_feature 3: n = A,T,C or G
tcnaggggggacacatatgtggatccaaagaattcggcacgaggctctctctctctctctctctctctctctctctctctctctctctctctctctctctc

SEQ ID NO: 8377 - DNA, 338 bp, Homo sapiens
  misc_feature 89, 164, 214, 216, 294: n = A,T,C or G
ctggagctcgcgcgcctgcaggtcgacactagtggatccaaagaattcggcacgaggagatggggtttcaccctgttggccaggctggnctaaaactcctgacctcaggtgatccacctgcctcggcctcccaaagtgctgggattacaggcgtgagctactgnccccagcctcccagattctttaatgagtatgtcttactttcctaatggtnangacaaacattaaaaaccatggtacccaagagtctgtccagtatgcctcctgcccacccagccaggccaatgggggcanggggtcggccctatctttctagcctctttccctttaaatcccct

SEQ ID NO: 8378 - DNA, 400 bp, Homo sapiens
  misc_feature 2, 4, 169: n = A,T,C or G
cncncttcgcaggtcgacactagtggatccaaagaattcggcacgagcacatatgatagtgttataaatactgtaaaagcatggaaggtgcaaaactcagtatttctacaattgcagctaagaacattaggatgaatggctggctgcttctaggaatataagatgcctnaagcattcattatttatgatttgaatactgtagctattttttgttgcttggcttttgaatgagtgtaaattgttttcttttgtgtatttatacttgtatgtatgatttgcatgtttcaatgataaagggataaaacagtatactgacaactgtttacaagaaagtggagaaaaatgtacatacatttttgtatgtttaagatattacccgtaaatactcaggattgggagc

SEQ ID NO: 8379 - DNA, 262 bp, Homo sapiens
  misc_feature 91, 196, 218, 238: n = A,T,C or G
gaacaaaaagctggagctcgcgcgcctgcaggtcgacactagtggatccaaagaattcggcacgagctcgtgccgaattcggcacgaggtnatctccaacgacaaaaggagcttttgccactgactcggccgtgtcctgacacctccagaacgcaggtgctggcgcccgttctgcctgggacccccgggaaccctntcctgccggaagccggacggcnagggatgggcccccaacttnggccctgcccacttggatttcacc

SEQ ID NO: 8380 - DNA, 191 bp, Homo sapiens
  misc_feature 13, 23, 28, 31, 38, 134, 155: n = A,T,C or G
gaccatttgctgnggctgtgtgnccttnagntgggacnctagtggatccaaagaattcggcacgaggaatatccttgccgaacaactacaagcagagactgagctctttgctgaagccgaagagatgagggcantgacttgctgctataaaagcnggcaattagaagagattctacatgacttggagtcta

SEQ ID NO: 8381 - DNA, 398 bp, Homo sapiens
  misc_feature 307: n = A,T,C or G
gaaaataagctggagctcgcgcgcctgcaggtcgacactagtggatccaaagaattcggcacgagctccccccgagcgccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggnggaaatgcctccgctgaaggccccgagggcgaaggtaccgaaagcacagtaatcactggtgtcgatattgtcatgaaccatcacctgcagg

SEQ ID NO: 8382 - DNA, 274 bp, Homo sapiens
aggaacaataagctggagctcgcgcgccttgcaggtcgacactagtggatccaaagaattcggcacgagtgtcaccggggcaactgcctgggggcgggggatgggggcagggtggaagcggctccccattttataccaaaggtgctacatctatgtgatgggtggggtggggagggaatcacctggtgctatagaaattgagatgcccccccaggccagcaaatgttcctttttgttcaaagtctatttttattccttgatatttttctttttt

SEQ ID NO: 8383 - DNA, 400 bp, Homo sapiens
  misc_feature 15, 22, 34: n = A,T,C or G
gaaccataatgctgnagctcgngcgcctgcaggncgacactagtggatccaaagaattcggcacgagtaaatctggtgttcacattacacaacaaaatgattgtacttcaagaaggaaagaaacagcaactcacgtggggcatggttttttagaactgatcaattttctgggttcttctcctggaggtgtgcaaagtccagagaagccagtgctggacaaggaaaagaagccacaagattagacttggctcacagcccacaaaataaactacttagaactacctttacttctcctcttttgggaatttggaaaaaatctcagttcttccacaaacccaatggaagccagctactgcagaaggggttcaggcagacctttccttaatgtccatgttgaaca

SEQ ID NO: 8384 - DNA, 398 bp, Homo sapiens
gaacaataagctggagctcgcgcgcctgcaggtcgacactagtggatccaaagaattcggcacgagggaaaaggaagatgcactgactagaactgaacttgaaacacttcaaaaacagaagaaagttaaaaaaccaaaacctgaatttcctgtatacacacctttagaaactacatatattcagtcttatgatcatggaacttccatagaagaaattgaggaacaaatggatgattggttggaaaacaggaaccgaacacagaaaaaacaggcacctgaatggacagaagaggacctcagccaactgacaagaagtatggttaagttcccaggagggactccaggtcgatgggaaaagattgcccacgaattgggtcgatctgtgacagatgtgacaa

SEQ ID NO: 8385 - DNA, 400 bp, Homo sapiens
gaaaaaagctggagctcgcgcgcctgcaggtcgacactagtggatccaaagaattcggcacgaggccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctg

SEQ ID NO: 8386 - DNA, 394 bp, Homo sapiens
gacaaaagctggagctcgcgcgcctgcaggtcgacactagtggatccaaagaattcggcacgagaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattcagtaattcagaaaaactcaagatttaagttaaaaagtggtttggacttggggaacaggactttatacctcttttactgtaacaagtactcattaaaggaaattgaatg

SEQ ID NO: 8387 - DNA, 400 bp, Homo sapiens
gacaaaagctggagctcgcgcgcctgcaggtcgacactagtggatccaaagaattcggcacgaggttccctgtgtataataagaaagatagtaggctaaatgatttggttgagcataataaattttggttatgtctacctttttgttaagtaggtcaggaattttcattctttttaacaggcattttacttatataataacatgattcttccaacaacctttagaggaatcaggaggtgtgggttaaataatttatccgagctactaaatggcagagctgagattcaaaaccagtcttataaagttcatatgactaccacttttggccatatcttagctaggactactaatattttggtttttggttttggttttgagacagagtctcactccagcctgg

SEQ ID NO: 8388 - DNA, 400 bp, Homo sapiens
gaacaataagctggagctcgcgcgcctgcaggtcgacactagtggatccaaagaattcggcacgagctcgtgccgaattcggcacgaggtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcaccttggaaaacaacccagctctggagaaactgctgcctcatatccgggggaatg

SEQ ID NO: 8389 - DNA, 100 bp, Homo sapiens
  misc_feature 29: n = A,T,C or G
agtgagtcgtattacaattcactggccgntagtggatccaaagaattcggcacgagagcactacaactgcgagcactccaagatcaacttccgcgacaag

SEQ ID NO: 8390 - DNA, 400 bp, Homo sapiens
  misc_feature 25, 33: n = A,T,C or G
gaacaataatgctggagctcgtgcncctgaggncgacactagtggatccaaagaattcggcacgagccacactcaagtccctcaacaaccagattgagagcatccgcagccccgagggctcccgcaagaaccctgctcgcacctgcagagacctgaaactctgccaccctgagtggaagagtggagactacttggattgaccccaaccaaggctgcaccttggacgccatgaaggttttctgcaacatggagactggcgagacttgcgtctaccccaatccagcaaacattcccaagaagaactggtggagcagcaagagcaaggagaagaaacacatctggtttggagaaaccatcaatggtggcttccatttcagctatggagatgacaatctggctc

SEQ ID NO: 8391 - DNA, 400 bp, Homo sapiens
  misc_feature 7, 8: n = A,T,C or G
acatttnntgggcgctagtggatccaaagaattcggcacgagaaaaggttgattacatttcttgcctgtctgtacattctttgtataaacgtgaagaaaaataaaaatatagattttccagcactgggactatgaaatttgagatttaacatttattcattagtcagatttaaaggaatttaccttaagtcatagtttatattgtttttggaggacctgagtaaggattctattaaaaatgattaattttgtcattatttgaaatattgataggattttaatatgttccttttttgaaaatactaaaattataaattaacttacacttaatagcaaatagttcgtaagtatgtccgtaatcaacttattgactaaaaattttgtaaaagatgccatttat

SEQ ID NO: 8392 - DNA, 294 bp, Homo sapiens
  misc_feature 5, 6, 240: n = A,T,C or G
aatannctggagctcgcgcgcctgcaggtcgacactagtggatccaaagaattcggcacgagcttctttctacatgcacttaagactaaaacacaggtttggattaattttatttgcttcctttttccgcttttcttcccgcagagcctgatgggagaatgtccagggcagggaaaccacattttttgtaggtgataactcaatgaaaattggtgcttattttttacacttctctcttgnggctctcttgtggtgctatctgttttaaggtctccttgaaggcgcactggggtc

SEQ ID NO: 8393 - DNA, 400 bp, Homo sapiens
  misc_feature 5, 6: n = A,T,C or G
aatannctggagctcgcgcgcctgcaggtcgacactagtggatccaaagaattcggcacgagaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcag

SEQ ID NO: 8394 - DNA, 400 bp, Homo sapiens
  misc_feature 244: n = A,T,C or G
gaaaataagctggagctcgcgcgcctgcaggtcgacactagtggatccaaagaattcggcacgagaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttattttattgncttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgt

SEQ ID NO: 8395 - DNA, 173 bp, Homo sapiens
gacaataagctggagctcgcgcgcctgcggtcgacactagtggatccaaagaattcggcacgagtctttatattctgtataaaaacaaaagcaaatttatatactaaaatcatttgtctaaaaatttaagttgttttcaaataaaaattaaaatgcatttctgatatgcactg

SEQ ID NO: 8396 - DNA, 280 bp, Homo sapiens
gaaaataagctggagctcgcgcgcctgcaggtcgacactagtggatccaaagaattcggcacgagatccaaacaacaaagcataatatttcgcccactaagccaatcactttattgactcctagccgcagacctcctcattctaacctgaatcggaggacaaccagtaagctacccttttaccatcattggacaagtagcatccgtactatacttcacaacaatcctaatcctaataccaactatctccctaattgaaaacaaaatactcaaatgggcct

SEQ ID NO: 8397 - DNA, 398 bp, Homo sapiens
  misc_feature 12, 29, 31, 44, 225, 312, 380: n = A,T,C or G
aaccataatatntgaaggtctgtgtgacncnctgaggtgggacnctagtggatccaaagaattcggcacgaggctgcgtgtggccagctcttctctgggcatggggccgcagcacgccatgcagacggctgagcggctctacacgcaaggctacatcagctacccacggacagagaccacccactaccctgagaactttgacctgaagggctctctgcggcaganggccaacccacccctactgggccgacacggtgaagcggttgttagcagaaggtatcaaccgcccgcggaaaggccatgacgccgggngaccattcccccccatcacccccatgaagtctgccacagaggccgaattaggggggtgaccgcgtggngggcttttatgagtacat

SEQ ID NO: 8398 - DNA, 334 bp, Homo sapiens
acaaaagctggagctcgcgcgcctgcaggtcgacactagtggatccaaagaattcggcacgaggaacagagtaaagccatggaagccatgaacagtaagagactgccgcctggcatggtttcttcttctgcagaagatgaaactgaggagaaacaagacaacatccttcataccaggaatggtcaagataatgcaagaagaaaaaagctttcaaacaaatcagaaggcagtcaacaaacagaaagggggacattccttccctggcagttactcaaaactgaaattgcttattgtgtacaccggggcttgtacttggggaatttaataaaaatgc

SEQ ID NO: 8399 - DNA, 400 bp, Homo sapiens
  misc_feature 344: n = A,T,C or G
gaaaaagctggagctcgcgcgcctgcaggtcgacactagtggatcaaagaattcggcacgagagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggnggacatggtgaatgacggcgtggaggacctccgctgcaaatacgtctccctcatct

SEQ ID NO: 8400 - DNA, 372 bp, Homo sapiens
  misc_feature 3, 12, 300, 354, 364: n = A,T,C or G
aangaaaataanctggagctcgcgcgcctgcaggtcgacactagtggatccaaagaattcggcacgagtcgacctgcgccccagcccccagtacctcgtccggagcactgtgagggagctgcagcaggactcaaggcagcccaggggccacctgctcctgctgtgcctccaaatacagatgtcatggcctgcacacagacagccctcttgcagaagctgacctgggcctctgctgaactgggctctagcacctccctggagactagcatccagctgtgtggccttatccgcgcatgtgcnggaggcccttgcgcagccttgcagcagctacagcacttaagagaagcccctganaaaaaccctnttggaaaa

SEQ ID NO: 8401 - DNA, 400 bp, Homo sapiens
gaacaataagctggagctcgcgcgcctgcaggtcgacactagtggatccaaagaattcggcacgagttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattat

SEQ ID NO: 8402 - DNA, 400 bp, Homo sapiens
  misc_feature 3: n = A,T,C or G
ganaataagctggagctcgcgcgcctgcaggtcgacactagtggatccaaagaattcggcacgagcggcacgaggccgcagaagcgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataacttggagtgccaaggctaaaagacgaaataccaccggaactggtcgaatgaggcaccttaaaaattgtataccgcagattcaggcatggattccgtgaaggaacaacacctaaacccaagagggcagcttgttgcagcattccagttcatcttaagaatgtcaacgatt

SEQ ID NO: 8403 - DNA, 380 bp, Homo sapiens
  misc_feature 14, 25, 33, 35, 42, 324: n = A,T,C or G
aaccataatgctgnagcctgtgtgncccttgangntgggacnctagtggatccaaagaattcggcacgagtttgcctagattttctcctgttttgttctaaaaattagacaatttggttttacatttaagtctatgatccattttcaatttttgtataaggtataaggtttaggttgattattgtatatttttagcctatgatgtccaatagctccagcgccctttgttcaaaggctgtctttcctccaacacattgtttctgtacccttgtcaaaaatcaattgtgtgtaatcccagcattttgggaggctgaggcgggagcnttgcttgagcccaggagtttgaggccagcctggcaacataatgaaaccctgtctct

SEQ ID NO: 8404 - DNA, 400 bp, Homo sapiens
  misc_feature 3: n = A,T,C or G
ganaataagctggagctcgcgcgcctgcaggtcgacactagtggatccaaagaattcggcacgagctccctcctaggtgttcccctcaggggaagtaggcagggtcaccgggcaagcagcgcacgctgtgggcagacactgtcccaagtcttagcctgcgtgaactcactggcgccacaaccccatcgcggttttgtgatcacccctattctacaggaaactaagacacagagaggacaagtcacttgaccaaagtcactgagctggctgggcgcaatggctcacgcctgtaattccagcactttgggaggccgaggcgggtggatcacctgaggtcaggagttcgagaccagcctgaccaacatggtgaaaccccgtctctactaataatacaaaatta

SEQ ID NO: 8405 - DNA, 400 bp, Homo sapiens
gacaataagctggagctcgcgcgcctgcaggtcgacactagtggatccaaagaattcggcacgaggccaagggagagatcccagttgggagacagaccagagccagaaagcagtgtgggatttttaagccacagatttaatttcctgatgatatttttttcaggctgatattagcagcatttttcattccccaagcagatctgccaatcgtgaaaaagtgatccagagtgagctgggtgatgggccagtttgaacctgaacagacccatcaggatagcccaaagtcaaggcaatatgtcctctctttttctaaccactagagactaaggacaaattttgcttctggctggtcttggaggagagagaaagaacagtttctaggcagctctggtgaataaat

SEQ ID NO: 8406 - DNA, 278 bp, Homo sapiens
  misc_feature 2: n = A,T,C or G
gnaaaagctggagctcgcgcgcctgcaggtcgacactagtggatccaaagaattcggcacgagcgacccccctgctcagctcgggaaaatccccgtgcggctccagccccgggtcacgctcaggagcgatgagaggggcgccctggccacgcttcaggaaagcctgtgtctgcgcgcggggcaaggggctccacgacaaaaggacaagatttgacttaaattaagtttttcccttgaggatattttcattttctttaaaagaatataattttcttcta

SEQ ID NO: 8407 - DNA, 211 bp, Homo sapiens
  misc_feature 1, 26, 31, 71, 193: n = A,T,C or G
ncctatagtgagtcgtattacaattnctggncgctagtggatccaaagaattcggcacgagagcacaagcnattcttgtgcctcagcctccagaatagctgggattacaggtgggtgccaccacgccgagctaatttgtgtgcgtgtgtgtgtgtgtgtgtgtgtgtgtgtatatatatatatatatatattnttttttccccccttctct

SEQ ID NO: 8408 - DNA, 400 bp, Homo sapiens
gaacaataagctggagctcgcgcgcctgcaggtcgacactagtggatccaaagaattcggcacgagataaaatatttttcacttttttttactccccatatcttagtcttgttcagtaagagagagggaaatggtaactggctgatttacatagtccttgattttagttcacctcttaggctggcactattatttggacaatggattctagttgtttactgaaagagatatgatgccacaggccctgtttgcagctccaaagtacccacactgaaccttgaaatgcacctcagacctccttgactatgatagccatatcgaaccactttttcagcttcctgatcgaggttaaactgatcagcaatttaaagttttggtgctgggcaactggcctgagtga

SEQ ID NO: 8409 - DNA, 152 bp, Homo sapiens
gaaaaagctggagctcgcgcgcctgcaggtcgacactagtggatccaaagaattcggcacgagccgttctgtacctggacctagcacccagcacctttctctgagctgagtggctggagtggtcaataaagccacatgtgcctgtggcccag

SEQ ID NO: 8410 - DNA, 400 bp, Homo sapiens
  misc_feature 3: n = A,T,C or G
ganaaaagctggagctcgcgcgcctgcaggtcgacactagtggatccaaagaattcggcacgaggcgtggcctacatggaccagcagactggcaacctcaagaaggccctgctcctccagggctccaacgagatcgagatccgcgccgagggcaacagccgcttcacctacagcgtcactgtcgatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccgga

SEQ ID NO: 8411 - DNA, 400 bp, Homo sapiens
gacaataagctggagctcgcgcgcctgcaggtcgacactagtggatccaaagaattcggcacgagaaaaattaaagtgattgaaggcagtcttcagcctattatcaaaactgaaggacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattg

SEQ ID NO: 8412 - DNA, 400 bp, Homo sapiens
  misc_feature 3: n = A,T,C or G
ganaataagctggagctcgcgcgcctgcaggtcgacactagtggatccaaagaattcggcacgagccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcggggttcgaccacttggccgatgggaatggtctgtcacagtctgctccttttttttgtccgccacacgtaactgagatgc

SEQ ID NO: 8413 - DNA, 268 bp, Homo sapiens
gacaaaagctggagctcgcgcgcctgcaggtcgacactagtggatccaaagaattcggcacgagtcctgtttctacgtttctgtattttcctattgaagatgagaggcagctgcacttcttccccctgcttaaggactacggaatagatgtaagagaatttaacaatcattaaacattgaaaaatatatcagtgaagaaggtcttaaagtcattttttttagagtcctttaaaattaaaatctattttcatgtgtccaagatggttta

SEQ ID NO: 8414 - DNA, 400 bp, Homo sapiens
aataagctggagctcgcgcgccctgcaggtcgacactagtggatccaaagaattcggcacgagccggtgtggctctgccgttggtcctgtgcggtcacttagccaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaat

SEQ ID NO: 8415 - DNA, 103 bp, Homo sapiens
  misc_feature 4, 14, 28, 76, 98: n = A,T,C or G
gctngcgcgcctgnaggtcgacactagnggatccaaagaattcggcacgagctcgtgccgaattcggcacgagctntcaaatgtcatttttgagtggnccaag

SEQ ID NO: 8416 - DNA, 400 bp, Homo sapiens
  misc_feature 280, 289, 307, 355: n = A,T,C or G
aaataagctggagctcgcgcgcctgcaggtcgaactagtggatccaaagaattcggcacgagagcagcccagaagcccagtaactgccctttccctgcatatgcttctgatggtgtcatctgctccttcctgtggcctcatccaaactgtatcttcctttactgtttatatcttcaccctgtaatggttgggaccaggccaatcccttctccacttactataatggttggaactaaacgtcaccaaggtggcttctccttggctgagagatggaaggcgnggtgggatntgctcctgggttccctangccctagtgagggcagaagagaaaccatcctctcccttcttacaccgngaggccaagatcccctcagaaggcaggagtgctgccctctcccat

SEQ ID NO: 8417 - DNA, 345 bp, Homo sapiens
  misc_feature 1, 20, 80, 106, 108, 142, 179, 216, 231, 266, 274, 334: n = A,T,C or G
ngctttccgaaccaaaaggngacctcacgaaatgcccctttgagctcaaaggctagttacccccaggggcccttccactntcggggacaggcgaaacctctttgtntntgcctcggcctgcggcccccagcccagcctccgngctttccctccgccagtccttgtcaatcaaacctggngccaaacgcggcagctgaagttttcagggacacattngcttctccccttgangaaccagttacaaagcgggatgtcctctctggggncccatcanaacaaagaaacaggtctaaagaccctcattccagagagcatcctgccccatatccagaangaaatccatgc

SEQ ID NO: 8418 - DNA, 308 bp, Homo sapiens
  misc_feature 290, 305, 307: n = A,T,C or G
aataagctggagctcgcgcgcctgcggtcgacactagtggatccaaagaattcggcacgagcttttcctagctttgccaggagatgtagttacctaaaagagaagagataaaactactttttaatttcactttaccttcctattagtgtactgtattagaaataaaattagacaaaggaaaatcccctcaaaacaaaaaaactcgagagtacttctagagcggccgcgggcccatcgattttccacccgggtggggtaccagggtaagtgtacccaattcgccctatagngagtcgattacaatncng

SEQ ID NO: 8419 - DNA, 400 bp, Homo sapiens
  misc_feature 8, 27, 31, 40, 73, 99, 142, 156, 225, 251, 256, 284, 289,301, 338, 365, 374: n = A,T,C or G
caaaaagntggagctcgcgcgcctgcnggtngacactagnggatccaaagaattcggcacgagccacaatggngcgcatgaatgtcctggcagatgctntcaagagtatcaacaatgccgaaaagagaggcaaacgccaggngcttattaggccgngctccaaagtcatcgtccggtttctcactgtgatgatgaagcatggttacattggcgaatttgaaatcnttgatgaccacagagctgggaaaatngttgngaacctcacaggcaggctaaacaagtgnggggngatcagccccanatttgacgtgcaactcaaagacctggaaaaatggcanaataatctgcttccatcccgccagttnggtttcatngtactgacaacctcagctggcatcat

SEQ ID NO: 8420 - DNA, 400 bp, Homo sapiens
aaaagctggagctcgcgcgcctgcaggtcgacactagtggatcaaagaattcggcacgagcacagtggacattgggcggcctccgtcgtggccccctcggggctgacactaatggacagaggctctcggtgccgaagattgcctgccagaggactgaccacagcctggctggcagctgctctgtggaggacctccaggactgagactgggctctgttttccaagggtcttcactaggccccctagctacacctggaagtttcagaacccactttggggggcctcctgcctgggcaggctcttcaagtgtggccctctttggagtcaaccctccttcccgaccccctccccctagcccagccccagtcactgtcagggtcgggccagcccctgcactgcct

SEQ ID NO: 8421 - DNA, 376 bp, Homo sapiens
  misc_feature 8, 19, 32, 36, 73, 91, 108, 236, 257, 259, 343, 362: n = A,T,C or G
aaactggngctcgcgcgcntgcaggtcgacantagnggatccaaagaaattcggcacgaggtttgacagaagngtgatatatgtaacttgngccatggaccaaatggncactttaccacagctaaaaatgagttacgatagcagcttgatggggattgtattgtattcctttaatcaaaaaggaaacacaatattctaagtatctttagcccaaataccatgacatattgagcatntttaaataaccagactgtatngnccttcatatgtgaagttgacactactgatttgtcaataccaaattttgggttaaagggttaaatttttatgtatttattttctngtggcctcaaaagatgatngcattctaactttt

SEQ ID NO: 8422 - DNA, 121 bp, Homo sapiens
  misc_feature 5, 18, 43, 98, 102, 106: n = A,T,C or G
aaaanaagcctggggctngcgcgccctgaaggtcgacactagnggatccaaagaaattcggcacgagctcgtgccgaattcggcacgagcaggttccntttntctnattcacaagatgctt

SEQ ID NO: 8423 - DNA, 400 bp, Homo sapiens
aaaagctggagctcgcgcgcctgcaggtcgacactagtggatccaaagaattcggcacgagctctgcttgacaagttcctgatcaagaactgcaatgatttccagtatgagagcaaggtgttttacctgaaaatgaagggtgattactaccgctacttagcagaggtcgcttctgggggagaagaaaaacagtgtggtcgaagcttctgaagctgcctacaaggaagcctttgaaatcagcaaagagcagatgcaacccacgcatcccatccggctgggcctggccctcaacttctccgtgttctactatgagatccaggatgaagaagcaggagaaggcaactgaagatccttcaggtcccctggcccttccttcacccaccacccccatcatcaccga

SEQ ID NO: 8424 - DNA, 327 bp, Homo sapiens
  misc_feature 10, 12, 34, 38, 89, 103, 105, 154, 171, 196, 276, 283, 311,325: n = A,T,C or G
aaaagctggngntcgcgcgcctgcgggtcgacantagnggatccaaagaattcggcacgagattccagacagcattggaaaagacatanaaaaggcttgccantntatttatcctctccatgatgtcttcgttagaaaagtaaaaatgctgaanaagcccaagtttgaatngggaaagctcatggagcttcatggngaaggcagtagttctggaaaagccactggggacgagacaggtgctaaagttgaacgagctgatggatatgaaccaccagnccaagantctgtttaaagttcagacttcaaatagnggcaaataaaaagngc

SEQ ID NO: 8425 - DNA, 400 bp, Homo sapiens
  misc_feature 21, 38, 67, 88, 97, 104, 186, 203, 217, 238, 245, 253, 308,350: n = A,T,C or G
aaaagctggagctcgcgcgcntgcaggtcgacactagnggatccaaagaattcggcacgagctcatntacatcccacttcctgatganaagtcccgngttgccntcctcaaggctaacctgcgcaagtccccagttgccaaggatgtggacttggagttcctggctaaaatgactaatggcttctntggagctgacctgacanagatttgccagcgngcttgcaagctggccatccgngaatccntcgagagngagattaggcgagaacgagagaggcagacaaacccatcagccatggaggtagaanaggatgatccagtgcctgagatccgtcgagatcactttgaanaagccatgcgctttgcgcgccgttctgtcagtgacaatgacattcggaag

SEQ ID NO: 8426 - DNA, 100 bp, Homo sapiens
  misc_feature 4, 5, 91: n = A,T,C or G
cgtnnagtggatccaaagaattcggcacgaggccagtatgctgggggaggagaaataccgccaggacctgactgtgcctccaggctactgncagtacttc

SEQ ID NO: 8427 - DNA, 247 bp, Homo sapiens
  misc_feature 63: n = A,T,C or G
aataagctggagctcgcgcgcctgcggtcgacactagtggatccaaagaattcggcacgaggngctgaacagaataagatgttaacgctgagttattaggactggaaggctatgaaaagaacttgaaattgtcggaatatgtgctctcttcatgtcatattcaatagaagtttctagtttaagattgattttgtgttttcttaggcatttcaagtgacaagcaaagtaaatgtatatattatgtgat

SEQ ID NO: 8428 - DNA, 143 bp, Homo sapiens
  misc_feature 6, 20, 46, 60, 112: n = A,T,C or G
ccttgnagtgggacactagnggatccaaagaaattcggcacgagtntatgtaacataagngaattctgggtttagtcttgggctccatccccaaggggtctcattatgtatntgtaaacattccagaaataaaaaaaaatatc

SEQ ID NO: 8429 - DNA, 130 bp, Homo sapiens
  misc_feature 35, 39, 77, 122: n = A,T,C or G
aaaagctggagctcgcgcgccctgcgggtcgacantagnggatccaaagaattcggcacgagtaggagcagactgtntaccaggaacacaatgagtactttatggccacctcgagtagtaanaacgagga

SEQ ID NO: 8430 - DNA, 302 bp, Homo sapiens
  misc_feature 23, 26: n = A,T,C or G
aataagctggagcctcgcgcgcntgnggttcgacactagtggatccaaagaattcggcacgagtgggaggccaaggtggacagatcacgaggtcaggagttcaagactagcctggccagtatggtgaaaccctgtccttaaaaatacaaaaattagctgggtgcagtggtgcacgccttgtaatcccagctactcgggaggctgaggcaggagaatcgcttgaacccgggaagcagaggttgcagtgagctgagatcgtgccactgccctccagcctgagcgacagagtgagactccatctc

SEQ ID NO: 8431 - DNA, 400 bp, Homo sapiens
  misc_feature 12, 21, 29, 316: n = A,T,C or G
aataagctggangctcgcgcncctgcagntcgacactagtggatccaaagaattcggcacgaggtctcacagaaagttctccgctcccagacatgggtccctcggcttcctgcctcggaagcgcagaagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccatttgtagagacaccacccatggnggttgtgggcattgtgggctaccgtggaaacccctcgaggcctccggaccttcaagactgtctttgctgagcacatcagtgatg

SEQ ID NO: 8432 - DNA, 174 bp, Homo sapiens
  misc_feature 12, 58, 59, 63, 88, 90, 95, 100, 109, 110, 112, 113, 118,122, 123, 124, 128, 131, 142, 145, 150, 154, 155, 159, 161,163, 166, 168: n = A,T,C or G
ctcgcgcgcccngcggggtcgacactagtggatccaaagaattcggcacgagctcgtnnggcntatggcacaacgcctagtgtaaaancntctcnaaaanatcacctcnngnnaatangatnnntttnaancttaaccaaanatnaactntttnnttgnananctntntcatgg

SEQ ID NO: 8433 - DNA, 147 bp, Homo sapiens
  misc_feature 2, 45, 86, 128, 136: n = A,T,C or G
anttcggcacgagccggcctgaccctgtggccccgggacccagcngagctgggggagggatcagcccccaaagaaatgggggtgcntgctgggcctggccccctggcccacccccactttccagggcngaaagggnccagggttctt

SEQ ID NO: 8434 - DNA, 122 bp, Homo sapiens
  misc_feature 51, 122: n = A,T,C or G
aataagctggagctcgcgcgcctgcaggtccgacactagtggatccaaagnaattcggcacgagcttaaatatatggaaaaatgaaataagggtgaagctgaataaagttctacttactgtn

SEQ ID NO: 8435 - DNA, 199 bp, Homo sapiens
  misc_feature 9, 17, 45, 169, 178, 183: n = A,T,C or G
ctggggctngcgcgccncgcaggtcgacactagtggatccaaagnaattcggcacgagctgtcattctacagggctctaatgatgttgaacttgttgctgagggcaacagcaggttcacttacactgttcttgtagatggctgctctaaaaagacaaatgaatgggggnaagacaatnattgnatacaaaacaaataag

SEQ ID NO: 8436 - DNA, 100 bp, Homo sapiens
  misc_feature 7, 20, 28, 29, 51, 53, 58, 61, 64, 79, 84, 98: n = A,T,C or G
acatttntctgggggctggnggaccctnnggggcgacactagtggatccananaattnggnacnagcttttttctcatnctagnatgacaaatggagnga

SEQ ID NO: 8437 - DNA, 152 bp, Homo sapiens
  misc_feature 4, 14, 49, 122: n = A,T,C or G
cggncaaggtgaangagtcctggggtcgccactgggccgccgccccccncccgttgttacccggtattgtaagaacaagccgtacccaaagtctcgctttctgcccgaggtgtcccttgatnccaagattcgattttttgacctggggcggg

SEQ ID NO: 8438 - DNA, 326 bp, Homo sapiens
  misc_feature 4, 6, 268: n = A,T,C or G
cggncnagaacctgggccgggttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaaggaggagacaattatgtncctgagggctcagccttggatcaggaggattattggaagtagatcctgacacttaagg

SEQ ID NO: 8439 - DNA, 160 bp, Homo sapiens
  misc_feature 16, 31, 33, 34, 36, 38, 39, 40, 45, 144, 146: n = A,T,C or G
gggtttgggggggggnacccgggtttgggcngnntntnnncgccngcggtcgacactagtggatccaaagaattcggcacgagctcgtgccgaattcggacgaaaaatggtcattgatgtccttcaccccgggaaggcgacagngnctaagacagaaatt

SEQ ID NO: 8440 - DNA, 373 bp, Homo sapiens
  misc_feature 65, 334: n = A,T,C or G
tggagctcgcgcgcctgcaggtcgacacttgtggatccaaagaattcggcacgaggtggattctngccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccatagacctgataaattatatagacgttgcccagcaagatggaaagttgccttttgttcctccggaggaagaatttattatgggaggtttccaagtatggnataaaagtatcaacatcagatcaatatgatgttttgcac

SEQ ID NO: 8441 - DNA, 100 bp, Homo sapiens
  misc_feature 29, 40, 75, 76, 96: n = A,T,C or G
acactagtggatccaaagaattcggcacnagggctgaccnttttttgtggtgtactccgtgccatcatgtccgtnnctgacgccgctgctgctgcngggg

SEQ ID NO: 8442 - DNA, 340 bp, Homo sapiens
  misc_feature 3, 25, 213, 214, 221, 224, 226, 227, 228, 235, 238, 245,251, 259, 262, 266, 268, 279, 289, 292, 303, 306, 310, 312,318, 326, 333: n = A,T,C or G
ctntgtagagttagagaatattgcnctgagacataaagtatagcgatgattgatgataacattaaatgtttctaccgcaattttactacgcatttaacgtacattatctcatttagtcttcacatcctccaatgttaccattcccactcatatttccctgaagaggcaactaaagtttaaagagattaaggtgaattacttgaagtcaagggnnccccccnggntnnnttccccnttngagggcntttttncacccccnttngagnanaaatttttttncccccccggnggngatttggcccnaanttcntnaaaagngcccccgngggagtnacccggg

SEQ ID NO: 8443 - DNA, 236 bp, Homo sapiens
  misc_feature 2, 4, 41, 96, 125, 190, 223: n = A,T,C or G
ancnaaagctggagctcgcgcgcctgcaggtcgacactagnggatccaaagaattcggcacgagttatgagctaccgggtaaatgaattacatgcnctttgaagtaaataggttttctattgggngtcaacaacgctgatttctcccaaaactatagtttctcttacggtcttttcctcctttaccctgnggatatacactcaggaataatctgacattttanaaaagccgaacag

SEQ ID NO: 8444 - DNA, 400 bp, Homo sapiens
aataagctggagctcgcgcgcctgcaggtcgacactagtggatccaaagaattcggcacgagcaaacagtattctaaaggaaataaaaaattctctgaggtcagtgcaagagaagaaaatggaagacagttcccgaccttctaccccacagagatcagctcatgagaatctcatggaagcaattcggggaagcagcataaaacagctaaagcgggtggaagttccagaagccctgcgataaaaacatgatctttagaagaggatgcagaactgttcagtggtattacatgaaatgcattgtgagatgtttctaaaataccttcttcaattcaaaatgatccctgactttaaaaataatctcacccattaattccaaagagaatcttaagaaacaatcagc

SEQ ID NO: 8445 - DNA, 388 bp, Homo sapiens
  misc_feature 13, 26, 212, 293, 302, 306, 328, 349, 352, 357, 387: n = A,T,C or G
cgcctgagggtcncacttgtggatcnaagaattcggacgagggaagctggagcgcatcgcgcgcctggaggacaaggtgaagacgctcaaggccgagaacgcggggctgtcgagtaccgccggcctcctccgggagcaggtggcccagctcaaacagaaggtcattgacccacgtcagcaacggctgtcaagctgctgcttggggtcaaggnacacgccttctgaacgtccccttgcccttttacggacaccccctcgcttggacggctgggcacacgccttaggggcgccgnaaaccaaantggnactccgggccttcctaccctgngcccaagtcctttccaccttnaangtttncaaagcccccccctttccactttttttttng

SEQ ID NO: 8446 - DNA, 398 bp, Homo sapiens
  misc_feature 1, 2, 28, 53, 388: n = A,T,C or G
nnaaaaaagctggagctcgcgcgcctgnaggtcgacactagtggatccaaagnaattcggcacgaggcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccaggttcgaatgcctaccaagactttgagaatcactacaagaaaaactccttgtggngaaggttcta

SEQ ID NO: 8447 - DNA, 125 bp, Homo sapiens
  misc_feature 3, 5, 38, 41, 58, 73, 95: n = A,T,C or G
ggngngggggggtttggggggggaaacccgggtttggnggngtggaacgcctgcggtngacactagtggatcnaaagaattcggcacgagctcgngcccaattcggcacgagcagaaattctaca

SEQ ID NO: 8448 - DNA, 400 bp, Homo sapiens
  misc_feature 10, 21, 29, 38, 76, 151, 288, 290, 303, 331, 350, 379, 395,396: n = A,T,C or G
aaaagctggngctcgcgcgcntgcaggtngacactagnggatccaaagaattcggcacgagcgacatttacatttntacatgtagtaacagtctactttgatatatgagtatttaaactaaggcattaagagatattagatatttcttaangttttcatagggctcaataggggtagtagcaatgatattacctctgaaaccaaatactcttttatccttgattccactatgggaccttataactagtccatgaaaccaagctcagaaaagctttaactcttatattngngtatatgtatgcngcttctgaaaatataatttttctaagtngtgggaatgactttaattngtaatcagctaaggcttaagatttcattngtttctaagtttctgnntttc

SEQ ID NO: 8449 - DNA, 181 bp, Homo sapiens
  misc_feature 11, 39, 41, 59, 64, 65, 66, 68, 137, 144: n = A,T,C or G
ctggagctcgngcgccctgcaggtcgacactagtggatntnaagaattcggcacgaggngaagnnncngacgccacccagccctggggggaggcccacgcctgctggaccaacgcgggttctggggtgcacaagccnccaggtntaacgctgaaaccctgcccccgcttgagcccaggagc

SEQ ID NO: 8450 - DNA, 127 bp, Homo sapiens
  misc_feature 12, 24, 27, 29, 50: n = A,T,C or G
ctttgtgagtcnaagaacttcggncgngnctggctgacgcctttagtgcncagaccccaaggccatcggccatcggaactaccatgcaggctactccatgtttggggctggcctcaccgtaggcctg

SEQ ID NO: 8451 - DNA, 312 bp, Homo sapiens
  misc_feature 3, 14, 28, 74, 173, 179, 254, 259, 277, 285, 295, 311: n = A,T,C or G
tcnaagaattcggncgagctcgtgccgngttgatatggttcctggcaagcccatgtgtgttgagagcttctcanactatccacctttgggtcgctttgctgttcgtgatatgagacagacagttgcggtgggtgtcaatcaaagcagtggacaagaaggctgcctggagctgncaaggncaccaagtctgcccagaaagctcagaaggctaaatgaatattatccctaatacctgccaccccactcttaatcanggggnggaagaacggtctcaganctgtttgnttcaattggncatttaagtttagtang

SEQ ID NO: 8452 - DNA, 111 bp, Homo sapiens
  misc_feature 5, 15, 96: n = A,T,C or G
gtgcncttgaagtgngacactagtggatccaaagaattcggcacgagcgagaacgacccccggaccgaccaaagcccgcgcgccgttgcttcccgngtccagcacctacgt

SEQ ID NO: 8453 - DNA, 162 bp, Homo sapiens
  misc_feature 27, 28, 32, 33, 49, 54, 71, 92, 98, 111, 132, 144, 160: n = A,T,C or G
ttttgggggggggaaacccggttttgnntggnntgcggaacgccctgcnggggngacactagtgggatttnaaagaattcggcacgagagangcccancattacctgcagngtctgcgctaccaggaagccnctgatttgtttngaaatgcacacttggncg

SEQ ID NO: 8454 - DNA, 131 bp, Homo sapiens
  misc_feature 4, 16, 111: n = A,T,C or G
gtcnaagaacttcggncgggggaaaggccccacttaaaagcagcagtctgataaaagtttgtaattcgtgtttaagaagacagagtagcaagtgttatcagtgagcctggncagaaaaccacactggaagg

SEQ ID NO: 8455 - DNA, 110 bp, Homo sapiens
  misc_feature 3, 5, 43, 94, 99: n = A,T,C or G
aancnaaagcctggagctcgcgcgcctgcaggtcgacactagnggatccaaagaattcggcacgagcggcacgaggcctgaaatcatatttcanagttngcttttttttt

SEQ ID NO: 8456 - DNA, 400 bp, Homo sapiens
  misc_feature 5: n = A,T,C or G
aaccnaagctggagctcgcgcgcctgcaggtcgacactagtggatccaaagaattcggcacgaggaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtcccgcacagtcgaagccacacctggtctgttttctgtgcactgtagccttagtgtcacct

SEQ ID NO: 8457 - DNA, 400 bp, Homo sapiens
  misc_feature 4, 7, 53, 310, 384: n = A,T,C or G
accnaantctggagctcgcgcgcctgcaggtcgacactagtggatccaaaganttcggcacgaggcgactccgccgcgatggtgacccggttcctgggcccacgctaccgggagctggtcaagaactgggtcccgacggcctacacatggggcgctgtgggcgccgtggggcttggtgtgggccaccgattggcggctgatcctggactgggtaccttacatcaatggcaagtttaagaaggataattaattacacaaacccttcacagactgctctggtgcctgggtggcgctagcttcctcccacctnagcacctgctgcatctggagcagcccaagcctcaggatggacaagaggaaacccacagctcagcttcaggcttnttatgtttctgaaaac

SEQ ID NO: 8458 - DNA, 218 bp, Homo sapiens
  misc_feature 20, 23, 28, 37, 73, 79: n = A,T,C or G
aaactggaagctcgcgcgcntgnaggtngacactagnggatccaaaaaattcggcacgagcgcaacctggganagctgngccagcgcctcgtacgcaacggggagtactaccagagcaactatgtgttcgtgttcctgggcctcatcctgtactggggggggacgtcccctatgttgctgggggctctggctgtctttttcggcgcctgttacattct

SEQ ID NO: 8459 - DNA, 341 bp, Homo sapiens
  misc_feature 14, 23, 36, 40, 71, 83, 96, 113, 140, 150, 164, 218, 238,244, 255, 288, 316: n = A,T,C or G
aaagcctggaagcntcgcgcgcntgcaggtcgacantagnggatccaaaaaattcggcacgagcaggccanatgggaattcgnggccttccgggcnttaaggggccccctggngctcttggtttgaggggacctaaaggngacttggganaaaagggggagcgnggccctccaggaagaggtcccaacggtttgcctggagctataggtctcccaggngacccaggccctgccagctntggcanaaatggccganacggtgagcgaggcccccccagggggggcaggnatttcttggagtgcttgaccccccggancctctgggctttccgggtttttgga

SEQ ID NO: 8460 - DNA, 189 bp, Homo sapiens
  misc_feature 20, 22, 32, 176: n = A,T,C or G
tggtgatccaagaattcggncnaggaaaactntgatcaaacatatttgttatgctcttctcttgttaacctgtcattgttatataggtgtcacgccatgactgttaggatgggaaggaaaggaattaatccctaaccagcttctacactgtgctttaagaaactatataataaggngtaaccaggaaat

SEQ ID NO: 8461 - DNA, 133 bp, Homo sapiens
  misc_feature 13, 66, 92: n = A,T,C or G
cgagtgcccaccnaaccctctaaatccccttgtaaatttaactgtgagtccaaagaggaacagctntttggacactaggaaaaaaccttgtngagagagtaaaaaatttaacacccatagtaggcctaaaagc

SEQ ID NO: 8462 - DNA, 190 bp, Homo sapiens
  misc_feature 4, 14, 126: n = A,T,C or G
gccntgttggccanggctggtctcgaactcctgacctcaagtgatcccctcccccccacctcgacctcccaaagtgctgagattaccacgcccggccttgtccattccattttgtagtcccatgtncagctcaggtcttagcacgcagtaggagctttcatctaacgcagagcctggagtttaagtagtg

SEQ ID NO: 8463 - DNA, 131 bp, Homo sapiens
  misc_feature 4, 6: n = A,T,C or G
aggngnggaccggactgggcgaggcggccttgagtctcagtacgagtgtgcgtgagtgtgagccaccttggcaagtgcctgtgcagggcccggccgccctccatctgggccgggtgactgggcgccggctg

SEQ ID NO: 8464 - DNA, 126 bp, Homo sapiens
  misc_feature 3, 9, 41, 42, 44, 49, 61, 68, 70, 73, 84, 97, 101: n = A,T,C or G
tcnaagaanttcggacagctcgtgccgaattcggcacgagnnanccganatcttccagganttctgcnanaangacgaacacanagggaaagagganaggnacccgatatatgttctctaggcctt

SEQ ID NO: 8465 - DNA, 400 bp, Homo sapiens
  misc_feature 4, 19, 30, 58, 59, 61, 209, 277, 344: n = A,T,C or G
tggngctcgcgcgcctgcnggtcgacactngtggatccaagaattcggcacgagcccnngnactttccaatctcagtcactctaggactctgcactgaatggctgacctgacctgatgtccattcatcccaccctctcacagttcggacttttctcccctctctttctaagagacctgaactgggcagactgcaaaataaaatctcggngttctatttatttattgtcttcctgtaagaccttcgggtcaaggcagaggcaggaaactaactggtgngagtcaaatgccccctgagtgactgcccccagcccaggccagaagacctcccttcaggtgccgggcngcaggaactgtgtgtgtcctacacaatggtgctattctgtgtcaaacacctctgta

SEQ ID NO: 8466 - DNA, 319 bp, Homo sapiens
  misc_feature 248, 299: n = A,T,C or G
ctggagcctcgcgcgcctgcaggtcgacactagtggatccaaagaattcggcacgaggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgngaaagttggagataaagttcttctcccagaatatggaggcaccaaagtagntctagatgacaaggattatt

SEQ ID NO: 8467 - DNA, 400 bp, Homo sapiens
  misc_feature 3, 22, 39, 77, 183, 260, 264, 286, 360: n = A,T,C or G
aanaagctggagctcgcgcgcntgcaggtcgacactagnggatccaaagaattcggcacgaggctgctgtagcgaanagagtttggcgcgatgtctcacaccattttgctggtacagcctaccaagaggccagaaggcagaacttatgctgactacgaatctgtgaatgaatgcatggaaggngtttgtaaaatgtatgaagaacatctgaaaagaatgaatcccaacagtccctctatcacatatgacatcagtcagtngttngatttcatcgatgatctggcanacctcagctgcctggtttaccgagctgatacccagacataccagccttataacaaagactggattaaagagaanatctacgtgctccttcgtcggcaggcccaacaggctggga

SEQ ID NO: 8468 - DNA, 256 bp, Homo sapiens
  misc_feature 14, 23, 27, 36, 94, 102, 187, 215: n = A,T,C or G
aaactggagctcgngcgcttgangttngacactagnggatccaaagaaattcggcacgaggcagcaggctcaagtagagaaggaggacttcagngacatggnggctgagcacgctgccaaacagaagcaaaaaaaacggaaagctcagccccaggacagccgggggggcaggcaagaaatataaggngttcaagttttaggtcccctcacactanccctttttttggccctacgtctggatgcctgggcttcacac

SEQ ID NO: 8469 - DNA, 161 bp, Homo sapiens
  misc_feature 156, 158, 159, 160: n = A,T,C or G
gctggagctcgcgcgcctgcaggtcgacactagtggatccaaagaattcggcacgaggtagaggatactatttccagaatagtgtttagctcacctagggggatatgtttgtatacacatttgcatatacccacatggggacataagctattttgnannna

SEQ ID NO: 8470 - DNA, 235 bp, Homo sapiens
  misc_feature 5, 44, 191: n = A,T,C or G
atttngctggagctcgcgcgcctgcaggtcgacactagtggatncaaagaattcggcacgagaaaaacctcaccataaaaactgagagcactttgaaaacaacacagttttcttgtaccctgggagagaagtttgaagaaaccacagctgatggcagaaaaactcagactgtctgcaactttacagatggngcattggttcagcatcaggagtgggatgggaaggaaagcacaat

SEQ ID NO: 8471 - DNA, 209 bp, Homo sapiens
  misc_feature 4, 29, 57, 58: n = A,T,C or G
tgangctcgcgcgcctgcggtcgacactngtggatccaagaattcggcacgagcgcnngttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaag

SEQ ID NO: 8472 - DNA, 400 bp, Homo sapiens
  misc_feature 16, 21, 29, 38, 70, 101, 111, 118, 215, 235, 375, 391: n = A,T,C or G
aaagcctggagctcgngcgcntgcaggtngacactagnggatccaaagaattcggcacgaggccccgttntatcaggttgcagcggcagagagccatcctntataagcggntgaaagngcctcctgcgattaaccagttcacccaggccctggaccgccaaacagctactcagctgcttaagctggcccacaagtacagaccagagacaaagcangagaagaagcagagactgtnggcccgggccgagaagaaggctgctggcaaaggggacgtcccaacaaagagaccacctgtccttcgagcaggagttaacaccgtcaccaccttggggggagaacaagaaagctcagctggggggggattgcacacgacgnggatcccatcgagctnggttggctt

SEQ ID NO: 8473 - DNA, 399 bp, Homo sapiens
  misc_feature 2: n = A,T,C or G
anaagctggagctcgcgcgcctgcaggtcgacactagtggatccaaagattcggcacgagcattatcttagccccagaacacagaatgttcttggtgagaagggccggcggattcgggaactgactgctgtagttcagaagaggtttggctttccagagggcagtgtagagctttatgctgaaaaggtggccacctagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttggggatggcctgatgatccacagcgg

SEQ ID NO: 8474 - DNA, 271 bp, Homo sapiens
  misc_feature 19, 21, 27, 29, 54: n = A,T,C or G
ccatatagtggagtctgtntnaccttnangctgggacgctagtggatccaaagnaattcggcacgaggcaagttaggtatgtttgcaggagaaaagtatcaagacgtttaactgcagttgactttctccctgttcctttgagtgtcttctaactttattctttgttctttatgtagaattgctgtctatgattgtactttgaatcgcttgcttgttgaaaatatttctctagtgtattatcactgtctgttctgcacaataaacataacag

SEQ ID NO: 8475 - DNA, 163 bp, Homo sapiens
  misc_feature 6, 14, 27, 40, 107, 129, 138: n = A,T,C or G
aataancctggtgntcgcgcgcttgcnggtcgacactagnggatccaaaaaattcggcacgagtttagccttattgcacaccaactcccaaaatataggttactctngttcaaaaggaaaaaaaaaatngggattttntttgaggggtatatgttattaatta

SEQ ID NO: 8476 - DNA, 400 bp, Homo sapiens
ataagctggagctcgcgcgcctgcaggtcgacactagtggatccaaagaattcggcacgaggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctctggtgatggaatgataaaagtgaagaatcagc

SEQ ID NO: 8477 - DNA, 400 bp, Homo sapiens
  misc_feature 2, 51: n = A,T,C or G
cngaagctggagctcgcgcgcctgcaggtcgacactagtggatccaaaganttcggcacgagagaagaatctggagatgagattgatgttccaaaggatgagcttagtatagaattagaaaatttattcattggtggaaccaaaccaccttagtgagtaaccctaagaattgacacaaatctcatattttaggagattatattggttctgcctctggcatgctggtagactagggccatcctaacttattattttccagaggttctcctccagacaagacctgcagtaagcaaagagttatattctacctctctctcaattttctttttcttttctctgtatcctcatcgttagccacacacagatttgtgtggcttttattgtagaactaaacttagca

SEQ ID NO: 8478 - DNA, 208 bp, Homo sapiens
  misc_feature 9, 24, 28, 37, 121, 148, 157: n = A,T,C or G
aaagctggngctcgcgcgcttgcnggtngacactagnggatccaaagaattcggcacgaggaaagctcagaaggctaaatgaatattatccctaatacctgccaccccactcttaatcagngggggaagaacggtctcagaactgttngtttcaatnggccatttaagtttagtagtaaaagactggttaatgataacaatgcatcgt

SEQ ID NO: 8479 - DNA, 178 bp, Homo sapiens
aataagctggagctcgcgcgcctgaaggtcgacactagtggatccaaagaattcggcacgagctatgctgcagagaaactatgcattaggtctcttttcaattagaaacctttactatttccaatgtatgtttgttaaaaataataataataaaaccaaaagcctttgtggaaaccca

SEQ ID NO: 8480 - DNA, 279 bp, Homo sapiens
  misc_feature 5, 24, 28, 41, 130, 148, 158, 225, 240: n = A,T,C or G
aaaanaagctggagctcgcgcgcntgcnggtcgacactagnggatccaaagaattcggcacgagggcaaactaagccgattttccggaaaaaggctaaaattacaaagaagattgtgctaaggcttgagngcgttgagcccaactgcngatctaaganaatgctggctattaaaagatgcaagcattttgaactgggaggagataagaaggagaaagggccaagngatccagttctaagngtcatcttttattatgaagacaataaaatcttgagttta

SEQ ID NO: 8481 - DNA, 310 bp, Homo sapiens
  misc_feature 3, 5, 49, 271: n = A,T,C or G
tangnctggagctcgcgcgcctgcaggtcgacactagtggatccaaagnaattcggcacgagtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgaagggccgcccggnaactgctgacgcttgatgagaaggacccacggcggtctg

SEQ ID NO: 8482 - DNA, 207 bp, Homo sapiens
  misc_feature 16, 18, 37, 46, 120, 123, 159: n = A,T,C or G
aaaaaaaaagcctggngnctcgcgcgccctgcaggtngacactagnggatccaaagaaattcggcacgagctcactgtcttaaatagaatttttaaatagtatatattcaggggcatttnggngaacaaagggaatttacttcgacttcttaaattttngtaaaagactataagtttagacatctttctcattcaaatttaaagata

SEQ ID NO: 8483 - DNA, 400 bp, Homo sapiens
  misc_feature 49: n = A,T,C or G
aaaagctggagctcgcgcgcctgcaggtcgacactagtggatccaaagnaattcggcacgagaatggatgtgggttagaaaaagacttggaagttatcatcacagaagtgataataagatgtaatggaattaacaagaaaacctaggaaaaggtatgaaatggaaaaacaagagaaacaaagtctgagtcttaaggaactcgggcatataaaagtctggtactgcaggaagagacagtaaaaatactaaaagggattcaatttctttctggttcaatcttggaagggcgtatgtgtccaggaatttatccatttcttctagatttgctagtttatgtgcatagaggtattcataatattccctgagggttgtaacagactaataatgaggtctgaaattg

SEQ ID NO: 8484 - DNA, 128 bp, Homo sapiens
  misc_feature 40, 97: n = A,T,C or G
caataagctggagctcgcgcgcctgcaggtcgacactagnggatccaaagaattcggcacgagctcgtgccgaattcggcacgagggaaattctgangagcattactattcactgatgcagaaagacg

SEQ ID NO: 8485 - DNA, 114 bp, Homo sapiens
  misc_feature 11, 15, 37, 79, 83, 90, 105: n = A,T,C or G
aaaaagctggngctngcgcgccctgcgggtcggacantaggggatccaaagaattcggcacgagcattcttgagcaatngctnggtccgnggacaataaacagtnttatcaaag

SEQ ID NO: 8486 - DNA, 400 bp, Homo sapiens
aataagctggagctcgcgcgcctgcaggtcgacactagtggatccaaagaattcggcacgagctccccaacaaggggctcactatccccaaagaaggagctgttggggacccacgacgcagcccctgtactggattacagcatattctcatctctggccccgaggctgcctgtggggcgagtggagacctcccatcactgagacagatcacagaccacgagtgcctttcccggacctggacgttgcctccagagcaggcaccagctctttccctctctagacagaaatatttttgtaaggttctggggcagggagggagcatgaagtacgaggaaaacttgaattccagatttttaatgcaaagtatttatcatttctaccagaaataaacgttttaagg

SEQ ID NO: 8487 - DNA, 400 bp, Homo sapiens
  misc_feature 352, 363: n = A,T,C or G
aataagctggagctcgcgcgcctgcaggtcgacactagtggatccaaagaattcggcacgaggacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggacatgctggcatctactggggtcagggctcttnctgcttcgggnggcttgtgcaacctttgggccaaggttccctcaacct

SEQ ID NO: 8488 - DNA, 398 bp, Homo sapiens
  misc_feature 38, 88, 109, 121, 155, 210, 218, 258, 288, 312, 356: n = A,T,C or G
aaaagctggagctcgcgcgcttgcaggtcgacactagnggatccaaagaattcggcacgagcatcagaatcagaggtatcaatggagngagcccaaaggttcgaaaggngttgcaggcttnttcgccttcgtcaaatcttcaatggaacctttgngaagctcaacaaggcttcgattaacatgctgaggattgtagagccatatattgcntgggggtnccccaatctgaagtcagtaaatgaactaatctacaagcgnggttatggcaaaatcaataagaagcgaatngctttgacagataacgctttgatngctcgatctcttggtaaatacggcatcatctgcatggaggattngattcatgagatctatactgttggaaaacgcttcaaagaggc

SEQ ID NO: 8489 - DNA, 397 bp, Homo sapiens
  misc_feature 3, 10: n = A,T,C or G
aanaataagnctggagctcgcgcgccctgcaggtcgacactagtggatccaaagtaattcggcacgaggccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcattcgatgttgtctacaatgcatctaataacgagctggttcgtaccaagaccctggtgaagaattgcatcgtgctcatcgacagcacaccgtaccgacagtggtacgagtcccactatgcgctgcc

SEQ ID NO: 8490 - DNA, 300 bp, Homo sapiens
  misc_feature 10, 21, 38, 115, 261, 263, 296: n = A,T,C or G
aaaagctggngctcgcgcgcntgcaggtcgacactagnggatccaaagaattcggcacgagcagaaggctaaatgaatattatccctaatacctgccaccccactcttaatcagngggggaagaacggtctcagaactgtttgtttcaattggccatttaagtttagtagtaaaagactggttaatgataacaatgcatcgtaaaaccttcaaaaggaaaggagaatgttttggggaccactttggttttcttttttgcgngnggcagttttaagttattagtttttaaaatcagnactt

SEQ ID NO: 8491 - DNA, 312 bp, Homo sapiens
  misc_feature 4, 9, 56, 71, 111, 235, 294: n = A,T,C or G
gacnctagnggatccaaagaattcggcacgaggggacttgaaatcaaatgtttggnaatggggcccttggnggcaacctcccattttagatgtttaaaggaccctatatgnggcattcctttctttaaactataggtaattaaggcagctgaaaagtaaattgccttctagacactgaaggcaaatctcctttgtccatttacctggaaaccagaatgattttgacatacagganagctgcagttgtgaaagcaccatcatcatagaggatgatgtaattaaaaaatggccagngggcaaagaaaagaactg

SEQ ID NO: 8492 - DNA, 268 bp, Homo sapiens
  misc_feature 4, 6, 213, 220, 238: n = A,T,C or G
gtgngnactagtggatccaaagaattcggcacgaggagagtagtttatgtcaaataaaacatgcaggtagagtcaatgtaacagacatcctaagttggatctgagcacaaaaaaggaaaacactgagtaacgtctggagtttaggtaatcatgttgtagccatgttcattttcttagctttttaatatgttaacattcagggggaacctgggngaacggnatacaggaactctctccnacactatctttgggattggctggggatcag

SEQ ID NO: 8493 - DNA, 399 bp, Homo sapiens
  misc_feature 2, 51, 304, 353: n = A,T,C or G
cntaagactggagctcgcgcgcctgcaggtcgacactagtggatccaaagnaattcggcacgaggggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgntgtctacaatgcatctaataacgagctgggttcgtaccaagaccctggngaagaattgcatcgtgctcatcgacagcacaccgtaccgacagtgg

SEQ ID NO: 8494 - DNA, 233 bp, Homo sapiens
  misc_feature 2, 13, 41, 72, 77, 120, 126, 183, 206, 221: n = A,T,C or G
ancgaaagctggngctcgcgcgcctgcaggtcgacactagnggatccaaagaattcggcacgaggcttcttntaggnggtcatgattacctgcttgctttgagctcagcagcagtcttcntaaacncatttaaaacaagatcctgggtttttggggtttgacttctatggggttttaaaaaancacagatttttagggttaatatngggaaaatgtactcnccttagggattc

SEQ ID NO: 8495 - DNA, 400 bp, Homo sapiens
aaaagctggagctcgcgcgcctgcaggtcgacactagtggatccaaagaattcggcacgagattcagtgcttggcaggttagtatatttttatgcctttttcagagtcagcagtttcaaatcttattgttatcatgttataaaattttagcccacatttcaggctccgtaaatcatttgagccattattttttcccaacaaatggtgaattttttctttaaatgtggatatatatgttgtaatttatgattcctggttatgtatttttgtgggatcctgcagtaaaattgacttttttgtgtctttgggagatttaaattgcgctaacagtgttgcgcaaaaatgagttcatgccatttaacatattgtattttaattattaactgtattaaatttacta

SEQ ID NO: 8496 - DNA, 393 bp, Homo sapiens
  misc_feature 1, 2, 28, 33: n = A,T,C or G
nnaaaaataagactggaagcctcgtgcncctgnaggtcgacactagtggatccaaagaattcggcacgaggcgaacgcggagaagcacgccatgaaggcctcgggcacgctacgagagtacaaggtagtgggtcgctgcctgccacccccaaatgccacacgccgcccctctaccgcatgcgaatctttgcgcctaatcatgtcgtcgccaagtcccgcttctggtactttgtatctcagttaaagaagatgaaagaagtcttcaggggagattgtctactgtgggcaggtgtttgagaagtcccccctgcgggtgaagaacttcgggatctggctgcgctatgactccccggagcggcacccacaacatgtaccgggaataccgggacctga

SEQ ID NO: 8497 - DNA, 180 bp, Homo sapiens
  misc_feature 10, 21, 29, 38, 161: n = A,T,C or G
aaagcctggngctcgcgcgcntgcaggtngacactagnggatccaaagaaattcggcacgagaaaatgatcgggcaagcaactgcggcagaccaggagaaaaaccctgaaggggatggcctccttgagtacagcaccttcaacttctggagagctcccatngccagcatccactccttcg

SEQ ID NO: 8498 - DNA, 127 bp, Homo sapiens
  misc_feature 25, 38, 72, 83, 97, 106, 118: n = A,T,C or G
aaaagctggagctcgcgcgcctgcnggtcgacactagnggatccaaagaattcggcacgagctcgtgccganttcggcacganccggccgcgaaggnggcaagaanaagccactgaancagcccaag

SEQ ID NO: 8499 - DNA, 384 bp, Homo sapiens
  misc_feature 271, 274: n = A,T,C or G
ataagctggagctcgcgcgcctgcaggtcgacactagtggatccaaagaattcggcacgaggataatgagccctttggctaaatggcaccgctctaaagagggtctgactgagcgctttgagctgtttgtcatgaagaaagagatatgcaatgcgtatactgagctgaatgatcccatgcggcagcggcagttttttgaagaacaggccaaggccaaggctgcagggtgatgatgaggccatgttcatagatgaaaacttctgtactgccntgnaatatggggctgcccccccacagctgggctgggggcatgggcattgatcgagtcgccatgtttctcacggactccaacaacatcaaggaagtactttctgtttcctgcca

SEQ ID NO: 8500 - DNA, 334 bp, Homo sapiens
  misc_feature 2, 278, 312: n = A,T,C or G
anaagctggagctcgcgcgcctgcaggtcgacactagtggatccaaagaattcggcacgaggctgcagtgacaagaagggcagagggcagtcatggggcccaggaccatgccactggccctgctcccccagccgcaggcctcacctgcaggtgctcctcgatgtccttgcggtcgtaggtgatgccactgggcgtgatgcacggctcccgcatcagctcaaagctgatcttgccacacaggtagtcgggggatgtctcgcttctgtggcacaggggcncacggtcaagaggctgaaaaaggggcactgcacngagcacccttgccaagccatcg

SEQ ID NO: 8501 - DNA, 398 bp, Homo sapiens
  misc_feature 16, 21, 38, 112, 118, 126, 191, 203, 316: n = A,T,C or G
aaaagctggagctcgngcgcntgcgggtcgacactagnggatccaaagaattcggcacgagatttgcaatgccttattttaagggaaaatttcacccccccaaaaaaatcanacactntaaaatgngagcaacacataaaaccaaactataaccagactgttacaaaaatgcctgaacatgagaagtccanaaacttcatatngggggatagtaccacagtactgcttaagtcaaaggcaaggtttatgtatatacagtcttaaacaggcctaaataagttatttagagatatgcaaatatggaattgcacttttngtacaaaacgactgagggtttttcaaagcaaattaaattttacgggatgcttcaaaatggcacgcgacatgcagagttgagc

SEQ ID NO: 8502 - DNA, 355 bp, Homo sapiens
  misc_feature 2, 24, 38, 64, 81, 144, 186, 196, 215, 221, 263, 282: n = A,T,C or G
anaagctggagctcgcgcgcttgnaggtcgacactagnggatccaaagaattcggcacgagagnggcctcaggttcacagngcaccatgtcactgtgctatcctacgaaatcatttgtttctaagttgggtttattcctggagngacatgccaccccgaatggctcactttcactgaggatgctgncctctgattnagctgctgcctccagcctntggctngagaacttactaaaggcacttccttcctgttaaacccctgtnaactctccataaatttggngattctctgctaggcctaagattttgagttaacatctcttgaagccaaactccaccttctgtgctttttgctt

SEQ ID NO: 8503 - DNA, 102 bp, Homo sapiens
  misc_feature 80, 84: n = A,T,C or G
cagaagctggagctcgcgcgcctgcaggtcgacactagtggatccaaagaattcggcacgagctcgagtttttttttttngctngttggttggtttggaact

SEQ ID NO: 8504 - DNA, 210 bp, Homo sapiens
ataagctggagctcgcgcgcctgcaggtcgacactagtggatccaaagaattcggcacgaggaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttg

SEQ ID NO: 8505 - DNA, 399 bp, Homo sapiens
  misc_feature 2: n = A,T,C or G
anaagctggagctcgcgcgcctgcaggtcgacactagtggatccaaagaattcggcacgagggtaagcccaagagttcatgagcaactttcaggggttgctctcccgaagcccttcctcattgtaacctgcccagtagtgtctgggtccctgggctctaccttttcagccctccagccagcttgggtggttgaggcttgatttaccctactctctggtgcactttgactgaaccacgtcagagctaagcagcgagaagccagagagaaaaagcatgaaggtttccccaccctctggggacctcagactctctggttggaaaggaagtttgcctggcctgatgactttaattatctgccatttctcactagggccacaaaatttcttgaggtctggggca

SEQ ID NO: 8506 - DNA, 312 bp, Homo sapiens
  misc_feature 3, 34, 43, 82, 130, 161, 186, 191, 195, 247, 268, 290: n = A,T,C or G
aancgaaagcctggagctcgcgcgcctgcaggtngacactagnggatccaaagaattcggcacgagcgtaaggttattttgngtttttaagttggttttacaattctttcctggggaaattatttctggnggggaaaaagatccattctacgtatccttgnggagaaaagctaaataacctttaanaatgngggnggtattggagaaagaagatgaattatagctccggagaatcaagatcttaagngaagcctttctgttcagatgngatctataaaaaatcataattnggggaaagtttaagcaaatctg

SEQ ID NO: 8507 - DNA, 356 bp, Homo sapiens
  misc_feature 24, 28, 74, 334, 336, 355: n = A,T,C or G
agaattcggcacgagacgacgatnaggngacagtcacggaggataagatcaatgccctcattaaagcagccggngtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaaagaaagaagaatccgaggagtctgatgatgacatggggcctttgggtctttttgactaaacctctttttataacatgntncaataaaaagctgaacttnt

SEQ ID NO: 8508 - DNA, 400 bp, Homo sapiens
  misc_feature 3, 5: n = A,T,C or G
aanantaagactggagctcgcgcgcctgcaggtcgacactagtggatccaaagaattcggcacgagcaggtgtgtaattgtgacaactgcagtgatttggaaagtctctttgtcttgggcaaatagaaggggttcctgttgttctgctcttgtccttcgtctcctccccttttcccccagacctcccccttctttttgtcaacttgctgggagctttgctttattggttggcagtgaccctaagaacaggatatggtgaggatgtcattggaagagaagagctctttccgtggtattctttggcaagagccatgtctactaagaggttaggtgacttcagtatacttataaaattcagtgagagtgccttcttctcttctaccacactctggcatagata

SEQ ID NO: 8509 - DNA, 399 bp, Homo sapiens
  misc_feature 4: n = A,T,C or G
accnaagactggagctcgcgcgcctgcaggtcgacactagtggatccaaagaattcggcacgagggtttctacactttcaaagagctgtaataacagattatggaattctgtaagtagaaaagccatggattctcctggtccattcagccagggtattcactgtgcacagactaaagtggggctaagatattcactgtgcacagactaaagtgggagagaggtggtgaaaagacggaaagagaacaacacaaaaatttaatttttaatctttggaaatttggatctcatagaagcaaagattgcagactatcatacttagaaacgatgtaatttttccaattcagccatctgccccattcacagacactctcaccaacagagtccttcattcaagaata

SEQ ID NO: 8510 - DNA, 143 bp, Homo sapiens
  misc_feature 2, 11, 112: n = A,T,C or G
gngacactagnggatccaaagattcggcacgagggacctttcccccttcaagaaaagaatccagccaactattcgaaggactgggctcgccgccctccgacactaccttttngggcctccaaagctccaccagcgccttcggg

SEQ ID NO: 8511 - DNA, 368 bp, Homo sapiens
  misc_feature 56: n = A,T,C or G
cagaaagctggaagcttcgcgcgccctgcaggtcgacacctagtggatccaaaganttcggcacgagctgagtgacatgcccaagattctgcagctagcaaatgctagtattgggattctaatcaaggactacttgcctccaaattctgcacttgtaaccattgctgtatctcttaccctaacccacaatcctacttttccatgtgaatttcacctgctagcaatgcatgctcccggtgggttgtgcatttggtgcagatgtctttgccatctcaaggataaaccatgtagatatttccctttctggccattttcaactcctgaagacaactgtggccagggaaccacagttcaaattgcaaatgctc

SEQ ID NO: 8512 - DNA, 100 bp, Homo sapiens
  misc_feature 2, 12, 31, 36, 37, 38, 43, 66, 81, 84, 86, 97: n = A,T,C or G
gngggtggacantaggggatccaaaaaattnggacnnngaaangcctccactgactatgacctatntgacaagagcataanccntntggggggcttngac

SEQ ID NO: 8513 - DNA, 399 bp, Homo sapiens
  misc_feature 20, 28, 33, 37, 130, 133, 192, 212, 217, 269, 277, 302, 304: n = A,T,C or G
aaacctggagctcgcgcgcntgcaggtngacantagnggatccaaagaattcggcacgagaagaaaatgaaaaagttgtcaaggtaggacatcaagcaaatgaccaatcttgacccatggctaggtcttntanactcctgaacccggaggcatgaagcctgggtctggcataaagccaaatctttgggcttnggtttctcatctttcaaaanaaggnaattgttctgcctgcctcctagggttactatgggaactggggaaaaggaaanaaaggtgnggaggttcctaggccttcatgaggngnggcaaaaaggagcctcggcccacccaggagggacccttgaacctgccctgctctgtgggtcagggagcaggttggccctcattgatcctacattt

SEQ ID NO: 8514 - DNA, 399 bp, Homo sapiens
  misc_feature 52, 233, 241: n = A,T,C or G
accgaagctggagctcgcgcgcctgcaggtcgacactagtggatccaaaganttcggcacgagctcgtgccgaattcggcacgagtgtagatattgcaccctatgacattggtggtcctgatcaagaatttggtgtggacgttggccctgtttgctttttataaaccaaactctatctgaaatcccaacaaaaaaatttaactccatatgtgttcctcttgttctaatcttgncaaccagngcaagtgaccgacaaaattccagttatttatttccaaaatgtttggaaacagtataatttgacaaagaaaaatgatacttctctttttttgctgttccaccaaatacaattcaaatgctttttgttttattttttttaccaattccaatttcaaaatg

SEQ ID NO: 8515 - DNA, 400 bp, Homo sapiens
cagaagctggagctcgcgcgcctgcaggtcgacactagtggatccaaagaattcggcacgagcagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcata

SEQ ID NO: 8516 - DNA, 400 bp, Homo sapiens
  misc_feature 13, 22, 74, 94, 117, 122, 153, 155, 176, 203, 231: n = A,T,C or G
gcgcttgaaggtngacactagnggatccaaagaattcggcacgagaacaatgcctccactgactatgacctatntgacaagagcatcaaccctntggggggctttgtccactatggngaagngaccaatgactttgtcatgctgaaaggctgngnggggggaaccaagaagcgggngctcaccctccgcaagtccttgctggngcagacgaagcggcgggctctggagaanattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggggggggtctcaataaaag

SEQ ID NO: 8517 - DNA, 302 bp, Homo sapiens
  misc_feature 2, 23, 31, 40, 146, 155, 227, 229, 262, 290, 293: n = A,T,C or G
cnaaagcctggagctcgcgcgcntgcaggtngacactagnggatccaaagaattcggcacgaggtcactgcactccagcctggggacagagcaagactccgtctccaaaaaaaagaaaaagaaaattattttctaatatatttcgnattttattnagggggtctgtttctcttccaccaggatttaagctccaccagggtaggggtttgtctgttttattcagggtngnatctccagggcctaggacaaaaccaaacatgcngcatatggtcaagacctattagttgagnggnggactgaat

SEQ ID NO: 8518 - DNA, 239 bp, Homo sapiens
  misc_feature 7, 20, 87, 101, 104, 118, 125, 139, 143, 144, 154, 176, 179,180, 182, 191, 203, 210, 212, 214, 219, 221, 222, 224, 227,231, 232, 233: n = A,T,C or G
gcaggtngacactagtgggntccaaaaaattcggcacgagcttcaacactctttatgataacaacactgtgttatattctttgaatnctagcccatctgcngancaatgactgtgctnaccagtnaaagataacctttntttnngaaatagggnaaatacgaaattagaaaagccntgnntnttttaactncctgaactgggnggaaacncngnttggntnntntgngggnnngaagat

SEQ ID NO: 8519 - DNA, 344 bp, Homo sapiens
  misc_feature 4, 39, 57, 92, 180, 291, 303: n = A,T,C or G
tggngctccgcgcgcctgcaggtcgacacttgtggatcnaagaattcggcacgaggntaaaaacaatataaaaaatttcagccgggcgcggnggctcacgcctgcaatcccagcactttgggaggccgaggtgggcagatcaggaggtcaaggcatcaagatcatcctggccaaaatggngaaaccctgtctctactaaaagtacaaaaattagctgggcgtggtggtgtagacctgtagtcccagctacttggcaggctgaggcaggagaatcccttgaaccagggaggnggaggttgcagntgagccaagattgtgccatttcaccccagcctggcaacaga

SEQ ID NO: 8520 - DNA, 114 bp, Homo sapiens
  misc_feature 3, 12, 45, 52, 54, 57, 71, 87, 107: n = A,T,C or G
ctnggtgagtcnaagaattcggagcgagctcgtgccgaattcggnacgaggngnagntggaggccattatnataaatgaattaatgnagggaatagaaaaataaatnctggaat

SEQ ID NO: 8521 - DNA, 109 bp, Homo sapiens
  misc_feature 3, 15, 40, 100, 105: n = A,T,C or G
tcnaagaacttcggncgggtcttcctgaagatctctaccntttaattaagaaagccgttgctgttcgaaagcatcttgagaggaacagaaaggataaggntgctnaatt

SEQ ID NO: 8522 - DNA, 399 bp, Homo sapiens
ataagctggagctcgcgcgcctgcaggtcgacactagtggatccaaagaattcggcacgaggcagtatatacccatgaagcagggaaaatctggagaataggaatcaaccaccctcacccattcttccctttctccctgctaagcaaatcttgagttccctgagcctgtttatgccatgaagcatggcctccttccatgtggtggggttcagttggcaggaatttgtcctgctcatttacattgtgcctgttgtctggctttggatccctcagacctggtttttctttctagggcctctgcctgaagcttggaatcaagtttgggaaggaaaaggtatttcagaggccctttgtgtctgtgtagtgtctcaaatgtgccctgctgaatttgcagttctc

SEQ ID NO: 8523 - DNA, 112 bp, Homo sapiens
  misc_feature 11, 12: n = A,T,C or G
gaggactgttnngcaggctgatgaataagatctaagagtacctggctacagaaagaagatgccagatgacacttaagacctacttgtgatatttaaatgatgcaataaaaga

SEQ ID NO: 8524 - DNA, 205 bp, Homo sapiens
  misc_feature 4, 14, 143, 146, 152, 167: n = A,T,C or G
cggncaacgctgangtcctcgcttggccattttgtatgccaagagggccagtgtcttcgtcaaattacagaagccaaatgctgccatccgagactgtgacagagccattgaaataaatcctgattcagctcagccttacaagnggngggggnaagcacacagacttntaggccactgggaagaagcagcccatgatcttgccctt

SEQ ID NO: 8525 - DNA, 399 bp, Homo sapiens
  misc_feature 22, 30, 39, 67, 136, 140, 157, 191, 207, 245, 250, 310, 371: n = A,T,C or G
gaaagcctggagctcgcgcgcntgcaggtngacactagnggatccaaagaattcggcacgagaaccntatcctggaaattctccccaggcagtaacctgaggcaatagtaaccctcatatcattgtttcacatctntcanatgtcattgttagatgngcactgtcttgcagtccatcattccagaaagatngtccatttttacatgngataagccatatctaatcccaataaatttttccacaangtttngtttcattcttccagcaactactctatcattactgtaccaccacctgtatggatctcgtngcccatatgaaactgagtaaggaacaatgggcatcacactcacagagaaagatggacaagngagctggcctttgtatcactaaagggga

SEQ ID NO: 8526 - DNA, 373 bp, Homo sapiens
  misc_feature 2, 6, 328, 338: n = A,T,C or G
anaatnagctggagctcgcgcgcctgcaggtcgacactagtggatccaaagaattcggcacgaggtctgagtgggcatagggtctgtgcccccagctccctgccctcacccttgcctttctccccaccctcctagaagtgagtgagtgtggaactgcagggccctgaacggcccagggcagggcatttgctttgcctgacttgctgggggccttgggacagccccttgcagagcaagggagacttggctgggagatctccaactttccttcccgccctcgcttttggggagtcccatgactttgctgtgtgacccttcaggggcgggngggaaggggntgagaatctgggtgaggctctcaaggctcaggaag

SEQ ID NO: 8527 - DNA, 400 bp, Homo sapiens
  misc_feature 7, 19, 27, 36, 138, 205, 208, 222, 330, 352: n = A,T,C or G
aagctgnagctcgcgcgcntgcaggtngacactagnggatccaaagaattcggcacgagaaggcattcaccacccaacacccattcagatccagggcatccccaccattctatctggccgtgacatgataggcatcgntttcacgggttcaggcaagacactggggttcacgttgcccgtcatcatgttctgcctggaacaaganaanaggttacccttctnaaagcgcgaggggccctatggactcatcatctgcccctcgcgggagctggcccggcagacccatggcatcctggagtactactgccgcctgctgcaggaggacagctnaccactcctgcgctgcgccctntgattgggggcatgtccgtgaaagagcagatggagaccatccgacacg

SEQ ID NO: 8528 - DNA, 101 bp, Homo sapiens
  misc_feature 2, 15, 39, 40, 46, 70, 97: n = A,T,C or G
gncgacactagtggntccaaagaattcggcacgagcggnncgaggnaacattttgtcatataagattcanatttacttcttatacatttgataaagnaagg

SEQ ID NO: 8529 - DNA, 253 bp, Homo sapiens
  misc_feature 3, 16, 67, 153, 171, 239: n = A,T,C or G
aangaacttcggacgngcaagcgttccgcctgccttagcgtcccagagtgctatggattactggggngagccaccggcacccaacctggccaaaaaattaaagtctgtgatgcttattagtttttgggaaataggcactcttacattacttgngaaagctaataaattttnaagagcctttatcgagattattttagcaatattgctggctgggatggcttacatttataatcccagcnctttggaggcagag

SEQ ID NO: 8530 - DNA, 259 bp, Homo sapiens
  misc_feature 19, 164, 171: n = A,T,C or G
tagaaacgcttaagcagtngccttttttaaacatcgatacgagacctctgaatttgtattttttcttgttaaccattttaatttgttggctggatgtataaagatgtttaaaaaattcagttgctttttggggtaatttgaattacttttttaatgactggggntccattngactgtttgcattgagattgcaatgtgcgcaattttttttgtagttgtggcatcttgttgacatcgaatatgactttgataataaata

SEQ ID NO: 8531 - DNA, 130 bp, Homo sapiens
  misc_feature 30: n = A,T,C or G
caaagaccgcaaaaagcatcctcgaacggnaagccaaatctcgccaagtaggaaaggaaaagggcaaatacaaggaagaaaccattgagaagatgcaggaataaagtaatcttatatacaagctttgatt

SEQ ID NO: 8532 - DNA, 498 bp, Homo sapiens
  misc_feature 2, 26, 45, 64, 103, 107, 189, 242, 303, 320, 341, 366, 383,446, 450, 491: n = A,T,C or G
gnacgaggagccctatgagtacgggncctcctatactcacacctnatttcttactgagcccctnaaaggagctataccattctatgaatgcaaggattgtggnaagncctttattcatagcacagtcctcactaaacataaggagcttcatctggaagaagaagaagaagatgaagcagcagcagctgnagcagctggcagcccaggaagttgaagccaatgtccatgttccacaagtagtnctgaggattcagggcttaaacgtagaggctgctgagccagaagtggaggctgccgagccanaagtggaggctgctganccagaagtggaggctgctganccaaacggagaggctgaagggccanatggagaggctgcagancccattggagaggctggacagccaaatggagaggccgagcagccaaatggggatgctgatganccanatggggcaggttttgaagaccccaaaaaaagagctgaaganccgaggg

SEQ ID NO: 8533 - DNA, 329 bp, Homo sapiens
  misc_feature 73, 322: n = A,T,C or G
cagtcgccaatatgcagctctttgtccgcgcccaggagctacacaccttcgaggtgaccggccaggaaacggncgcccagatcaaggctcatgtagcctcactggagggcattgccccggaagatcaagtcgtgctcctggcaggcgcgccccttggaggatgaggccacttctgggccagtgcggggtggaggccctgactaccctggaagtagcaggccgcatgcttggaggtaaagtccatggttccctggcccgtgctggaaaagtgagaggtcagactcctaaggtggccaaccgggagaagaagaagaagaagacnggtcggg

SEQ ID NO: 8534 - DNA, 500 bp, Homo sapiens
  misc_feature 38, 45, 71, 93, 99, 202, 469, 475, 490: n = A,T,C or G
tcgagaggaaagagagaaatcttccataactcccaggntgctggngaaggaccatgtgtacggtgttaagngacgctgactaaagtttagggngcctgngggatagccgacttgtgacagcaggtaagcatttaatatgcagatgtgaagctcaagatagaggtcatgagctgaagatagaattttgaacatcggcagtggntaaaaccacaaaaactgaggacttaataatgagagacatcaaaatgtacaggccagggagaggactttgagtagggactttgtttgggtcagtgttgtatcctcagacatcccctagcacatagtaggctcaaaaatgtttctttaatgaataaatgaataataataataataaacattctattcaatacgaactcttctaattgtggcagcataatatttcattgagtaaatacagcacaatttacatatctatttccttattggnccagtnatcaatggctgccgnaacaaattgc

SEQ ID NO: 8535 - DNA, 500 bp, Homo sapiens
  misc_feature 21, 23, 37, 39, 67, 78, 96, 278, 441: n = A,T,C or G
cttcttgggaaaaaaccccgntntttggggcgcttgnangacccacactagtggatccaaagaattntttttcgaggnaacacgagaaagcacatnccaaggccaccacacaccacctgtccaaaaaggccttcgatacgggataatcctatttattacctcagaagtttttttcttcgcaggatttttctgagccttttaccactccagcctagcccctaccccccaactaggagggcactggcccccaacaggcatcaccccgctaaatcccctanaagtcccactcctaaacacatccgtattactcgcatcaggagtatcaatcacctgagctcaccatagtctaatagaaaacaaccgaaaccaaataattcaagcactgcttattacaattttactgggtctctattttacccccctacaagcctcagagtactncgagtctcccttcaccatttccgacggcatctacggctcaacattttttgtagccacag

SEQ ID NO: 8536 - DNA, 438 bp, Homo sapiens
  misc_feature 1, 19, 29, 49, 60, 62, 144, 363: n = A,T,C or G
nacaaaaaccctggttttngggcgcttgnaggtccgacactagtggatncaaagaattcntnacgagcactgcttaagtacattcctggatgtttggaagatttttaagcgccatagagagggtacttatgctatggaaattgngtttatatatatatgcataattgccactgaaattctgaacagacccaaaggaagaaaaatactgtgatttaaataaagctaacataattaatttatatctattttatatttgacttagtgggataaattgttttgtggaaaaccatattataaaatagtctaagttttttatagttgaggaagaatttgaggtgaaagatcatgttaattgtaacaatngccagtactttgtgtccactatgtgtctggcactgatttatgtttattaatttactacatcctcagaacaattca

SEQ ID NO: 8537 - DNA, 209 bp, Homo sapiens
  misc_feature 12, 22, 28, 52, 54, 85, 88, 92, 97, 179, 194: n = A,T,C or G
accctggttttngggcgcttgnaggtcnacactagtggatccaaagaattcntnacgagacactttttacatatatgcacatagnatngttngcttnttatgttgaccatcagcctcgtgttgagccttaaagaagtagctaaggaactttacatcctaacagtataatccagctcagnattttagttttgttntttggttgtttgttt

SEQ ID NO: 8538 - DNA, 102 bp, Homo sapiens
gggaaatttgtcataaagaatttcttttatttttgaaatcgagtttgtaaatgtccttttaagaagggagatatgaatccaataaataaactcaagtcttgg

SEQ ID NO: 8539 - DNA, 164 bp, Homo sapiens
  misc_feature 2, 61, 66, 76, 77, 101, 104, 144, 153, 154: n = A,T,C or G
gnaggccagggtgctcggggcaaggcggctgggagcggccctcacattgatggctcctgcnccctnctccgcaggnntgctccctgaggccaagaagcctnggntccctgacggcacccctgatcatgaaggacagcgtgagtnccaggacgnncttttggagg

SEQ ID NO: 8540 - DNA, 500 bp, Homo sapiens
  misc_feature 55, 66, 146, 150, 328, 405: n = A,T,C or G
cttcttgggaaaaaaacccggttttcgggcgcttgcaggtccacactagtggatncaaagaattcntttcgagctgcggagtctgctgctattctccgagcttcgcaatgccgcctaaggacgacaagaagaagaaggacgctggnaagncggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctntgagagactgaagattcgaggctccctggccagggcagcccttcaggagctccttagtaaaggacttatcaaactgntttcaaagcacagagctcaagtaatttacaccagaaataccaagggtggagatgctccagctgcctggtgaagatgcatgaataggtccaaccag

SEQ ID NO: 8541 - DNA, 495 bp, Homo sapiens
  misc_feature 5, 19, 29, 31, 36, 49, 60, 82, 415: n = A,T,C or G
ggganaaaacccggttttngggcgcttgnangtccnacactagtggatncaaagaattcntttcgagcacgccgccgcttgngctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgngaagacctggagcgactgaagaagattcgggcccatagagggctgcgtcactttctggggccttcgtgtccgaggccagc

SEQ ID NO: 8542 - DNA, 500 bp, Homo sapiens
  misc_feature 11, 13, 30, 40, 44, 54, 120, 334, 467, 478: n = A,T,C or G
ggggcgcttgnangaccacactagtggatncaaagaattntttncgagcgtggncccaagaagcatctgaagcgggtggcacgctccaaagcattggatgctggataaattgaccggtgngtttgctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatggatgtcatcagcattgacaagacgggaganaatttccgtctgatctatgacaccaagggtcgctttgctgtacatcgtattacacctgaggaggccaagtacaagttgtgcaaagtgagaaagatctttgtgggcacaaaaggaatccctcatctggtgactnatgatgcccgnaccatccgctaccccgatcccc

SEQ ID NO: 8543 - DNA, 118 bp, Homo sapiens
  misc_feature 29: n = A,T,C or G
tacgagggagatcgccattatccccagcnaaaagctccgaacaagatagcaggttacgtcacgcatctgatgaagcgaattcagagaggcccagtaagaggtatctccatcaagctgc

SEQ ID NO: 8544 - DNA, 488 bp, Homo sapiens
  misc_feature 32, 221, 337, 340, 385, 469: n = A,T,C or G
cgggtccaaagggtgaacagggtgcctctggngaagaaggtgaagcaggagaaaggggggaacttggagatataggattacctggcccaaagggatctgcaggtaatcctggggaacctggcttgagagggcctgagggaagtcgggggcttcctggagtggaaggaccaagaggaccacctggaccccggggtgtgcagggagaacagggtgccaccggnctgcctggtgtccagggccctccgggtagagcaccgacagatcagcacattaagcaggtttgcatgagagtcatacaagaacattttgctgagatggctgccaagtcttaagcgtncanactcaggtgccacttgggcttcctggaaggcctggccctcctggnccccccggccctcctggagaaaatggtttcccaggccaaatgggaaattcggggcctttccggcatttaaggggccccctgggnctcttgggtttgaggggac

SEQ ID NO: 8545 - DNA, 208 bp, Homo sapiens
  misc_feature 107, 198: n = A,T,C or G
gctggagcctcgcgcgcctgcaggtcgacactagtggatccaaagaattcggcacgagcggcacgaggctgtgatcgcctccttcgaccagctgtacgacgcctggnggggcgggctggactggtgcaatgccggctggctcagtgatggctctgtgcaatatcccatcacaaagcccagagagccctgtgggggccngaacacagtg

SEQ ID NO: 8546 - DNA, 400 bp, Homo sapiens
gctggagctcgcgcgcctgcaggtcgacactagtggatccaaagaattcggcagaggcgagagctgcgaagggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaag

SEQ ID NO: 8547 - DNA, 400 bp, Homo sapiens
  misc_feature 392: n = A,T,C or G
gacaataagctggagctcgcgcgcctgcaggtcgacactagtggatccaaagaattcggcacgagcagattcctttatatgtagtggaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagngttctaag

SEQ ID NO: 8548 - DNA, 400 bp, Homo sapiens
  misc_feature 4, 8: n = A,T,C or G
cacntganggtgggacgctagtggatccaaagaaattcggcacgagcacttttctggctgtcataaagatataaagagaaaaatcagaatggatagctcaaaaatgtcatcttcattttatagctgaagaagctgaggctcatagtgctaaggtagtctcagatcacacaggtaggaagtggagaagctgcatatgactcctaatgccatgttcactcacagaacaaatatctacatagaggccacatctccattctgagttttttcagtggcctcctaaaaagatatcacaaacttgggcatgaccattgggagcaaggcattgcctgagatcttgccagattggtctccattaacacacagtctcatgcgtatccccaaactcataaagaaaacatgc

SEQ ID NO: 8549 - DNA, 383 bp, Homo sapiens
  misc_feature 164, 168, 183, 210, 217, 298, 332, 336, 339, 370: n = A,T,C or G
cgaacaataagctggagctcgcgcgcctgcaggtcgacactagtggatccaaagaattcggcacgaggtgcttcttagcatcatcttcatgaatggaaatcggtccagtgaggctgtcatctgggaggtgctgcgcaagttggggctgcgccctgggatacatnattnactctttggggacgngaagaagctcatcactgatgagtttgngaagcanaagtacctggactatgccagagtccccaatagcaatccccctgaatatgagttcttctggggcctgcgctcttactatganaccagcaagatgaaagtcctcaagtttgcctgcnaggnacnaaagaaggatcccaaggaatgggcagctcancaccgagaggcga

SEQ ID NO: 8550 - DNA, 400 bp, Homo sapiens
gtctggggcctcgcgcgcctgcaggtcgacactagtggatccaaagaattcggcacgagggaaagacacaagcatcatgcagtggcgcgtcatttagtacccaccgagagctgtggggagcagcatgggcaaggaagacacagactcgcattacccttggtcactgtgatttctgttttgtttaaaaaaattcttacaaacctcaggaaaactgtgccctccgccggctaccttagcttagcgtgtcagcgggcgccacagcggatcagcggttccgtgttcacttttgttgtacaatatatgacacagtgcacattgaataccaacaaggttgcaacgtttacattatagccacatcaacagaagtaactggtatattcttagtaacttttctatgaac

SEQ ID NO: 8551 - DNA, 208 bp, Homo sapiens
  misc_feature 47: n = A,T,C or G
tctggggctccgcgcgccctgaaggtcgacactagtggatccaaagnaattcggcacgagcttggactactttaatttggatcctttgggtttggagaaagggaatgtgaaagctgtcattacagacaacaggtttcagtgatgaggaggacaacactgcctttcaaactttttactgatctcttagattttaagaactcttgaattg

SEQ ID NO: 8552 - DNA, 374 bp, Homo sapiens
  misc_feature 24, 28, 221, 236, 304, 334, 354: n = A,T,C or G
cgacaaaagctggagctccgcgcncctnaggtcgacactagtggatccaaagaattcgccacgaggcgtgtttcagcatttgaaattgtattacacttcttggactgttggccagttttgagattttcatcatactttttttttcttcatgtctttttatgccagttaggaaggatctattgacctatcttcaagctctttgattcttttctcaactgagnccgatctccacgtgnccatcaaagacattctttatttttattatagggctttggattcctgtttcctttacagtttttctcgnctaatacctctgctttcactggccatctgntttgcatactttctaccctnaccattaaaatccattaaac

SEQ ID NO: 8553 - DNA, 336 bp, Homo sapiens
gacaaaagctggagctcgcgcgcctgcaggtcgacactagtggatccaaagaattcggcacgagtctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagga

SEQ ID NO: 8554 - DNA, 274 bp, Homo sapiens
  misc_feature 9, 56, 183, 190, 199, 216, 268: n = A,T,C or G
gaacaatangctggagctcgcgccgcctgcgggtccgacactagtggatccaaagnaattcggcacgagctcgtgccgaattcggcacgagctgctacacaagaccctgagaactgacctgcagggacgaaaccatgaagagcctgatccttcttgccatcctggccgccttagcggaggtancttttgngttatgaancacatgaaagcatggantcttatgaccttaatcccttcattaacaggagaaatgcaaaatcccttcatntcccct

SEQ ID NO: 8555 - DNA, 397 bp, Homo sapiens
gaacaataagctggagctcgcgcgcctgcaggtcgacactagtggatccaaagaattcggcacgagagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtggagttgtgcaattcacagcaaagtagtcaggaatcgatctcgtgaagccccgcaaggaccgaacacccccaccccgatttagacctgcgggtgctgccccacgt

SEQ ID NO: 8556 - DNA, 400 bp, Homo sapiens
  misc_feature 19, 28, 32, 87, 372, 389: n = A,T,C or G
gacaataagctggagctcnccgcctcgnggtngacactagtggatccaaagaattcggcacgagctgaaacccagtttcagcaaggnaaaatgatgggactctcaaacctccctcctcatcttcccttcccctctgtcttatgcctggcctggccttttttgttgttgttggcttttcataagtaagaaaaatttattgtagtatttcaagactgcagaatttcaagtgtatatctataaatctttttttaaaatcttcggctacacagtaacatcaattaaaacagaagagtgagtctaagtctgtaatatgctgtaggaccagataagattttgaatgagactaaacttgactgccatattttaagaggnaattgaaactttatggnggagaatggat

SEQ ID NO: 8557 - DNA, 400 bp, Homo sapiens
  misc_feature 28: n = A,T,C or G
gacaataagctggagctcgcgcgcttgnggtcgacactagtggatccaaagaattcggcacgagaagtgatcttgggtctaaaaatatagcctaaggaaataatatgaatcgcatatgaagatttataaatgtttattaccatcttatctgtaatacaaaaaatggaaacaaagccccaataacaaaatatttaaataaattagtgtagtttatatatctatattgataaaactcagttacaaaagttttttaaaaatttaatgacttggaaatatacttgcaatgtattccgtaaaaaagtgaaatttaatatattatcttatgtgtaaaatataattttgaaataaatatataaaattcatttaatcaaaagtatttattaagctgttactctaagac

SEQ ID NO: 8558 - DNA, 400 bp, Homo sapiens
gacaataagctggagctcgcgcgcctgcaggtcgacactagtggatccaaagaattcggcacgaggaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaac

SEQ ID NO: 8559 - DNA, 124 bp, Homo sapiens
  misc_feature 7, 16, 20, 23, 26, 32, 34, 38, 39, 55, 62, 66, 71, 72, 74,81, 82, 86, 90, 93, 100, 120, 121: n = A,T,C or G
aggaaangaatttcanaatntgnagncggctntnccannggcaacgagtgaatgnccgatangtancaaanngncattcanncgantgcnccncgctganacccccataaacaaaatggnngaa

SEQ ID NO: 8560 - DNA, 103 bp, Homo sapiens
  misc_feature 4, 9, 34, 44, 55, 57, 60, 62, 69, 81: n = A,T,C or G
tgcncgccnctatctgtgcccgactcggttcacngggcaagaangcaatttttcnanacntnttggtantcggctgatcancacgggcagaccgagtgcaatg

SEQ ID NO: 8561 - DNA, 108 bp, Homo sapiens
  misc_feature 9, 18, 38, 43, 50, 62, 67, 74, 79, 87, 88, 90, 101: n = A,T,C or G
cgttttgcngctggtcanaggaaaagaatttcacaatntggtntgggctntacgagcggcantcganttgaatngccgnttattacnngnacacaattcanctcgatg

SEQ ID NO: 8562 - DNA, 100 bp, Homo sapiens
  misc_feature 2, 11, 13, 14, 28, 54, 55, 56, 66, 74, 82, 83, 88, 99: n = A,T,C or G
angcatttcananngtggtgttcggctntccgacggcgcgagtgaatggcgatnnntcctaacacncattcagncgttgccnngctgntaccccgaaana

SEQ ID NO: 8563 - DNA, 120 bp, Homo sapiens
  misc_feature 7, 8, 9, 10, 19, 20, 30, 41, 49, 51, 53, 56, 67, 70, 75,83, 92, 97, 98, 106, 118: n = A,T,C or G
aggggcnnnnaaaatgganncagtgaatgncgagcagtgcnaaaaggananancgngaggaagaganganacccnaaaaaaangagaaaagngaggnntataaaanagggaaaggagnaa

SEQ ID NO: 8564 - DNA, 128 bp, Homo sapiens
  misc_feature 2, 5, 12, 15, 16, 20, 31, 32, 46, 50, 56, 57, 62, 66, 75,76, 84, 95, 106, 112: n = A,T,C or G
cnatntgttggngannatangattgccagcnngtgaatgggcgatnttcnataacnngcatncgcnggcgcactnngtgacacnccattaacaangttgagaattntgtctnacgagactgctaaagt

SEQ ID NO: 8565 - DNA, 100 bp, Homo sapiens
  misc_feature 16, 27, 31, 33, 63, 65, 66, 68, 74, 89: n = A,T,C or G
ttcgcgatcgcatcanacgcgttttgngccntnttcccgctggtcacaggaaaacgcatttcncnntntggtgncggctgtcacgcagnggcgcgagtga

SEQ ID NO: 8566 - DNA, 100 bp, Homo sapiens
  misc_feature 8, 17, 28, 33, 39, 49, 52, 54, 57, 62, 67, 70, 82, 90: n = A,T,C or G
ccacgccnttagcgccnttttgccgctngtcanaggacnacgcatttcnccntntgntgtgngaatntangattgccagccngtgaatgngcgattttcg

SEQ ID NO: 8567 - DNA, 111 bp, Homo sapiens
  misc_feature 5, 7, 8, 9, 30, 35, 46, 52, 55, 56, 61, 74, 84, 85, 86, 109: n = A,T,C or G
ttcanannntggtgtcgggctatcagcagnggcancgagtgcaatnccccgnttnntcctnaacacgcattcanccgttgccgnnntgttaccccacaacaaaaggganaa

SEQ ID NO: 8568 - DNA, 101 bp, Homo sapiens
  misc_feature 2, 7, 8, 11, 12, 21, 26, 36, 40, 43, 47, 52, 64, 87, 88, 89: n = A,T,C or G
tnaagannggnntttttctcncaggntatcagaggnggtntgntgcnctatntgccggatggtnacaggaagaagcattttctagcnnngttggtagtgcg

SEQ ID NO: 8569 - DNA, 106 bp, Homo sapiens
  misc_feature 10, 11, 13, 14, 15, 16, 17, 18, 20, 28, 36, 41, 46, 49, 58,60, 63, 75, 82, 83, 88, 103, 105, 106: n = A,T,C or G
gccattttcnntnnnnnngnaagcacgntaatactngcagncgctnctnaaccagtgngngantatatttattcncgatacnnaagtnccagcacccggatcnann

SEQ ID NO: 8570 - DNA, 105 bp, Homo sapiens
  misc_feature 16, 19, 49, 51, 53, 56, 81: n = A,T,C or G
ctatctctgcccgacncgnggtgcacagtgcaagaacgcaatttttcancncntcnttggtagttcgggctgattcacgcngcgtgcagacgaagttggcagatg

SEQ ID NO: 8571 - DNA, 100 bp, Homo sapiens
  misc_feature 4, 17, 31, 33, 41, 46, 49, 54, 61, 66, 77, 78, 81, 88, 90,93, 96: n = A,T,C or G
cagnaacgccgtttacngtcgttacgatgcncnagacagtnccagngantttgncgcgtgntggtngaaaaattagnnttncagccgngnggnacngcca

SEQ ID NO: 8572 - DNA, 100 bp, Homo sapiens
  misc_feature 8, 14, 28, 34, 41, 55, 61, 70, 73, 79, 82, 83, 84: n = A,T,C or G
cctttacntgtctnttacgatgcgcaangtagtnccgtgantttgtcgcgtgctngtcganaaattaggnttncagccngtnnnactgccatttttcgct

SEQ ID NO: 8573 - DNA, 103 bp, Homo sapiens
  misc_feature 9, 10, 13, 36, 41, 48, 64, 65, 72, 74, 87: n = A,T,C or G
cattttcannctnttggtagtcgggctgtcagcagngtgcngacgagntgcaatgcccggtttnngtaatgnancacccattcaccncggttgccccttgtgg

SEQ ID NO: 8574 - DNA, 100 bp, Homo sapiens
  misc_feature 22, 27, 29, 45, 49, 51, 61, 62, 63, 64, 66, 71, 78, 86, 91: n = A,T,C or G
ttccgatcgcatcaacgcggcntgtgncnttttcccgctggtcanaggnantcgcatttcnnnntntggtntcggctntcacgagnggcancgagtgaat

SEQ ID NO: 8575 - DNA, 100 bp, Homo sapiens
  misc_feature 3, 4, 5, 6, 8, 13, 15, 20, 27, 32, 33, 40, 49, 50, 57, 63,67, 69, 76, 78, 87, 89: n = A,T,C or G
tcnnnntntggtntnggctntccgagnggcanngagtgantgcccgttnntattgancaccantcantngttgccntntgatacccnanacaaaattgaa

SEQ ID NO: 8576 - DNA, 134 bp, Homo sapiens
  misc_feature 13, 25, 30, 40, 82, 83, 85, 99: n = A,T,C or G
caccgcataggcnatccagacggcngggcntggtcgcccntatcttgcccgctcggtgcacaggcaagaccgcaatttcacnntntggtagttcggctntcacgcagcgtgcagacgagttgcaatggccgatt

SEQ ID NO: 8577 - DNA, 376 bp, Homo sapiens
  misc_feature 3, 349: n = A,T,C or G
ganaataagctggagctcgcgcgcctgcaggtcgacactagtggatccaaagaattcggcacgaggccagcctcaggctgagtgaggaggagctgctggacaagctagagatcttctttggcaagactaggaacggaggtggcgatgtggacgttcaggagctactgccagggagtgtcattgctggggtttgctagggatggagtgcctcagcgtctgtgccaaatcggccagttcacagtgccactgggtggcaagcaagtccctctgagagtctctccgtatgtgaatggggagatccagaaggctgagatcaggtcgcagcccagttcccccgctcggacttggngctcaacattcctgatatcttggatgg

SEQ ID NO: 8578 - DNA, 400 bp, Homo sapiens
  misc_feature 3, 25: n = A,T,C or G
ganaataagctggagctcgcgcgcntgaggtcgacactagtggatccaaagaattcggcacgaggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcacctgattcccagttagggggtgccctaactgagcagtagggatagaaggtgtgaaccttgggagtgcttttataaattattttccttgtagattttatttttaatttatctctgtgacctgccagggagaggggagagagagagagatgctgttgagcacatgacaaaataaaataaaat

SEQ ID NO: 8579 - DNA, 373 bp, Homo sapiens
  misc_feature 2, 5, 54, 303: n = A,T,C or G
cnagnggctccaaagaattcggcacgaggagagccagaaggggcagttcctgcnaagaggcagagagaggctgctgttgagaagcaagctgcggattcccttcggacaaccatgcaaacctgttttaaccatcacaacaattgtgccacttgcttcccctagccatttccccttaccacctaggtcctctccattttccagttatgcttaacacccaggctggaaaataagaccccagcagaaggtagggaagaattgttctccatgttccaaagagtgcgggccatactgaagccatcttgntatctcgcagaacacctagcagggtgcctcatctcttccaggcagattggtttgtaatggatgcatatat

SEQ ID NO: 8580 - DNA, 398 bp, Homo sapiens
acaaaagctggagctcgcgcgcctgaggtcgacactagtggatccaaagaattcggcacgagccagaagacagcaatggtgccagtgccccctccagagcccaaagaccagtaccctccagccttccatctcagggcgcttcccaagaatatgtcccacccgttttgaaagctccatttgagctcgtgccgaattcggcacgaggtggaccttagtgatcaggtggcacctactgacattgaagaagggatgagagtgggcgtggatagaaataaatatcaaattcacattccattgcctcctaagattgacccaacagttaccatgatgcaggtggaagagaaacctgatgtcacatacagtgatgttggtggcttgtaaggaacagattgagaaac

SEQ ID NO: 8581 - DNA, 112 bp, Homo sapiens
  misc_feature 6, 9, 56, 61, 67: n = A,T,C or G
gtgagncgngtacatttaggtgggacgctagtggatccaaagaattcggccgagantacgngggggnctgagtattaagactactggcttacatcctctgatgtcattactt

SEQ ID NO: 8582 - DNA, 113 bp, Homo sapiens
  misc_feature 24, 83: n = A,T,C or G
aggacaataagctggagctcgccncctgaggtcgacactagtggatccaaagaattcggcacgaggggcggcgggctccgccnagccgtttgtccttgatctgcccgcggggc

SEQ ID NO: 8583 - DNA, 100 bp, Homo sapiens
  misc_feature 22, 72, 80, 86, 91, 93: n = A,T,C or G
gaaaatgctggagctcggcgcntgcaggtcgacactagtggatccaaagaattcggcacgagctcgtgccgntttggcangaaganaagcngngatgacg

SEQ ID NO: 8584 - DNA, 400 bp, Homo sapiens
  misc_feature 22, 28, 31, 34, 160: n = A,T,C or G
cgacaataatgtctggagctcngcgccnccntgnaggtcgacactagtggatccaaagaattcggcacgagcaagagctgagcagaccacctcctttatgtaggcaaaacttccatcattttggcttttgttctaaacagaactaaatgacatgcatagnatgggtaacttacagatcgcttaattggagtaaaactcagagtaatagagggaaatatgggctcttcagtgcctttttagcttttttgagttgaagacgttcctacagatgtagtttaaacattacaaagtaggcttctttatccaaaaatcccaatgtgtcatagtacacaggatagtttaaaatatgtagccacggggaaaggggaggcatgtaaatgtcttgaagaggagaaaaagt

SEQ ID NO: 8585 - DNA, 400 bp, Homo sapiens
  misc_feature 77, 307, 313, 377: n = A,T,C or G
gaaaaagctggagctcgcgcgcctgaggtcgacactagtggatccaaagaattcggcacgagctcgtgccgggcttntgcgacgagcgcctcgtgcccttcgatcacgccgagagcacgtacggcctctaccggacgcattttctctccagactgccgatcccagaaagccaggtgatcaccattaaccccgagctgcctgtggaggaggcggctgaggactacgccaagaagctgagacaggcattccaaggggactccatcccggtttttcgacctgctgatcctgggggtgggccccgatggtnacaccntgctcactctttccagaccacccccttcctacaggagcgggagaagattggggctccaatcagngactccccgaagccacccgccac

SEQ ID NO: 8586 - DNA, 400 bp, Homo sapiens
  misc_feature 22, 24: n = A,T,C or G
gaaaaagctggagctccgcgcncntgcaggtcgacactagtggatccaaagaattcggcacgagcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaacggcacgagagtacttctagagcggccgcggccccatcgattttccacccgggtggggtaccaggtaagtgtcccaattc

SEQ ID NO: 8587 - DNA, 400 bp, Homo sapiens
gaacaataagctggagcctccgccgccgccttgcgggtcgacactagtggatccaaagaattcggcacgagactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaaggtgttg

SEQ ID NO: 8588 - DNA, 327 bp, Homo sapiens
  misc_feature 66: n = A,T,C or G
gacaaaagctggagctcgcgcgcttgcggtccgacactagtggatccaaagaattcggcacgagcntacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcaagggttgagatgtgttttatctgttttatattttaaaagattctgccagaaaataaaaccagaccttgttct

SEQ ID NO: 8589 - DNA, 333 bp, Homo sapiens
  misc_feature 7, 315: n = A,T,C or G
gacaatnttgctggagctccgcgcgcttgcaggtcgacactagtggatccaaagaattcggcacgagcttgggcttgcgggcccagttccagaggtggaagttacagaagaggaggtactgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaantaaactgaaaaaaaaaac

SEQ ID NO: 8590 - DNA, 199 bp, Homo sapiens
  misc_feature 91, 108, 113, 132, 144, 146: n = A,T,C or G
gacaataagctggagctcgcgcgcctgcaggtcgacactagtggatccaaagaattcggcacgagctcgtgccgaattcggcacgagctcntgtgcagacctgcgcgngtggncacctaaccatttaccggngggaggtgattncntctaaaaataaaatataacaaatctgagagagagtctagggtttcaggggctg

SEQ ID NO: 8591 - DNA, 400 bp, Homo sapiens
  misc_feature 17, 346: n = A,T,C or G
gacaaaagctggagctngcgcgcttgaggtcgacactagtggatccaaagaattcggcacgagcagcaaggctgtggattgctggtccataggtgtcatcgcctacatcttgctctgggttaccctcccttctatgacgagaatgatgccaaactctttgaacagattttgaaggccgagtacgagtttgactctccttactgggacgacatctctgactctgccaaagatttcatccggcacttgatggagaaggacccagagaaaagattcacctgtgagcaggccttgagcacccatggattgcaggagatacagctctagataagaatatccaccagtcggngagtgagcagatcaagaagaactttgccaagagcaagtggaagcaagccttcaa

SEQ ID NO: 8592 - DNA, 331 bp, Homo sapiens
  misc_feature 39, 57, 64, 111: n = A,T,C or G
tacgagctcccctgggccactaaccatcctggcccgggntgcctgtctgacctccgngcctagncgtggctctccatcttgtctcctccccgtgtccccaatgtcttcagnggggggccccctcttgggtcccctcctctgccatcacctgaagacccccacgccaaacactgaatgtcacctgtgcctgccggcctcggtccaccttgcggcccgggtttgactcaactcagctcctttaacgctaatatttccggcaaaatcccatgcttgggttttgtctttaaccttgtaacgcttgcaatcccaataaagcattaaaagtcatgat

SEQ ID NO: 8593 - DNA, 317 bp, Homo sapiens
  misc_feature 273: n = A,T,C or G
gagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggcttccaagagtgtggcccgccgggncctccaagccctggagggctgaaaatggtggaaaaggaccaaga

SEQ ID NO: 8594 - DNA, 348 bp, Homo sapiens
ctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggttgaagggg

SEQ ID NO: 8595 - DNA, 100 bp, Homo sapiens
  misc_feature 10, 12: n = A,T,C or G
gcccgaattngncccgagtgaaggtgctccttgcccgccgccctcatcgcggggtccgggttcttcctgctgctgccgggagccttcggcggccgatgag

SEQ ID NO: 8596 - DNA, 237 bp, Homo sapiens
  misc_feature 25, 36, 38, 45, 66, 78, 112: n = A,T,C or G
cgcttgaggtcgacactagtggatncaaagaattcntnacgaggnggctcacaggccgggcgtggnggctcacgcctntctgtaatcctaggacttcgggaggccgaggcgngtgggttgcctgagctcaggagttcaagcctagtctgggcaacacggtgaaaccccttctctactaaaacacaaaaaaattaactgtgtgtgtcgtccagcctgagcaacagagtgagactccat

SEQ ID NO: 8597 - DNA, 500 bp, Homo sapiens
  misc_feature 3, 30, 41, 126, 162, 234, 362, 388, 428: n = A,T,C or G
cgngcgcttgaaggccgacactagtggatncaaagaatttngcacgagggtgaagcgagctgagaggctttgtcctcgtgccagtaactctgaaatctctcttaattcctgctgtccaggcagcanaatgccatggtttccccaagtaggtagctgctttancagttaaagcccaaatgtctgttctgttgatcagaggtctctgaatttctgaagtggtgtttcgtttctggngactgagttaatcctttacaatccctcttgtaaagtgtgctaatagaaagaatccacctttcaaagctgcagaaccagaccgtgccctaaattgaccaacgtaactgatgtgcctcaggaagtctctngccagctgtccctgtgaagacccccnctactcccccccagctgctgccttgcacacttgaagcatntcagactgtgcaaagccatgtagtcatcaagacagtaaatcccagggcttggttaagtgctgtgtgataact

SEQ ID NO: 8598 - DNA, 456 bp, Homo sapiens
  misc_feature 81, 202, 288, 376, 382, 400, 428, 454: n = A,T,C or G
gcattctcagccacaaccaaaaaaaaataaaaagggcagccctccttaccactgtggaagtccctcagaggccttggggcntgacccagtgaagatgcaggtttgaccaggaaagcagcgctggtggagggttggagaaggaggtaaaggatgagggttcatcatccctccctgcctaaggaagctaaaagcatggccctgntgcccctccctgcctccacccacagtggagagggctacaaaggaggacaagaccctctcaggctgtcccaagctcccaagagcttncagagctctgacccacagcctccaagtcaggtggggtggagtcccagagctgcacagggtttggcccaagtttctaagggaggacttnctcccntcgcccattagtgccagnccctgctggctggggcctgagcccttanacagcccccctgccccgaggcctgcntt

SEQ ID NO: 8599 - DNA, 488 bp, Homo sapiens
  misc_feature 7, 26, 37, 71, 148, 186, 235, 393, 440, 462: n = A,T,C or G
cgcttgnaggccgacactagtggatncaaagaatttngcacgaggagacgacgtgcacgaaatggcacctngaaaggggaaggaaaagaaggaagaacaggtcatcagcctcggacctcaggtggctgaaggagagaatgtatttggngtctgccatatctttgcatccttcaatgacacttttgnccatgtcactgatctttctggcaaggaaaccatctgccgtgtgactggngggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctgnggcccagtcggccctcagagcccttgcccgctcgggtatgaagatcnggcggattgaggatgtcacccncatcccctctgacagcactagcagga

SEQ ID NO: 8600 - DNA, 110 bp, Homo sapiens
  misc_feature 18, 20, 21, 22: n = A,T,C or G
tacttctagagcggccgngnnnccatcgattttccacccgggtggggtaccagggtaagtgtacccaattcgccctatagtgagtcgtattacaattcactgggccgaca

SEQ ID NO: 8601 - DNA, 445 bp, Homo sapiens
  misc_feature 27, 43, 87, 258, 426: n = A,T,C or G
gccaataaacaaaaacaactgtttggnttacctcagttgcagnagttattttcatttagaagttgttctcagattattgtttcagtnatatagaggattactaggactagttatgaagaaaccccactacattcaatggaattggggcttaaaatctcatcgatgtgctgtctctggagtgataagaaagggctacatctcccgaaatgatttctttacgtcatgtattggtttccttcttcaccttgaacttttgtngaactgtatgtactttaccccaaacctgttaatattttgagcgcttctatgtgaaagcaaagaaataattttaatactctggcattcataaattttattgatgagattatttattttaaaggtttgagggaacatctctggttgtaccaaagaagaaataaatatggnttcttaatctcttgcatgt

SEQ ID NO: 8602 - DNA, 298 bp, Homo sapiens
  misc_feature 24, 42, 66, 68, 204, 233: n = A,T,C or G
cttcttgggaaaaaaacctggttnttcgggcgcttgaggtcnacactagtggatccaaagaattcntnacgagggctatgggggcccctcacacagggggagtgaaacttggctggacagatcatcctcactcagttccctggtagcacagactgacagctgctcttgggctatagcttggggccaagatgtctcacaccctanaagcctagggctgggggagacagccctgnctgggagggggcgttgggtggcctctggtatttatttggcatttataaatatataaactcctttt

SEQ ID NO: 8603 - DNA, 496 bp, Homo sapiens
  misc_feature 22, 60, 113, 204, 210: n = A,T,C or G
acacattaactgcccgactagnggatccaaagattttttcgagaaaacgttcagcatctnctgagtcatcatcatcatcgtcaaagaagaagaaaacaaaggtagaacatggnggatcgtcaggctctaaacaaaattctgatcatagcaatggatcatttaacttgaaagctttgtcagggaagctctggatataagtttggngttctngctaagattgtgaattacatgaagacacggcatcagcgaggagatacgcatcctctaaccttagatgaaattttggatgaaacacaacatttagatattggactcaagcagaaacaatggctaatgactgaggctttagtcaacaatcccaaaattgaagtaatagatgggaagtatgctttcaagcccaagtacaacgtgagagataagaaggccctacttaggctcttagatcagcatgaccagcgaggattaggaggaattcttttagaagacatagaagaag

SEQ ID NO: 8604 - DNA, 161 bp, Homo sapiens
  misc_feature 24, 90: n = A,T,C or G
ctcgcctgcatctactcggccctnattctgcacgacgatgaggtgacagtcacggaggataagatcaatgccctcattaaagcagccggngtaaatgttgagcctttttggcctggcttgtttgcaaaggccctggccaacgtcaacattgggagcctcat

SEQ ID NO: 8605 - DNA, 457 bp, Homo sapiens
  misc_feature 11, 18, 31, 42, 222, 249, 302, 341, 347, 366, 388, 450: n = A,T,C or G
cgggcgcttgnaggtccnacactagtggatncaaagaattcntacgagcatacaagaacattttgctgagatggctgccatgtcttaagcgtccagactcaggtgccacatgggcttcctggaaggcctggccctcctggtccccccggccctcctggagagaatggtttcccaggccagatgggaattcgtggccttccgggcattaaggggccccctggngctcttggtttgaggggacctaaaggngacttgggagaaaagggggagcgtggccctccaggaagaggtcccaacggttngcctggagctataggtctcccaggtgacccaggccctgncagctnttggcaaaaaatggccganacggtgagccaaggccccccangggtggcaaggaattcctggagtgcctggaccccccggaacctcctgggcttcccgggtttntgggagc

SEQ ID NO: 8606 - DNA, 249 bp, Homo sapiens
  misc_feature 28, 29, 72, 73, 98, 242: n = A,T,C or G
ctttcctgggggaaaaaaacccctgttnnttggggcgccttgaggcccgacactagtggatccaaagaattnntgcacgagtataaccacaaattgtncgtgtgtgtgtgtgtttattgcaactaatactaatatgctgtttcaaccaaaacattcatctggaaggaagacaatttgctttaaaaaaaattccccaaggtgagcttttggggcttaccctgattctgcattgacttcttttncctccat

SEQ ID NO: 8607 - DNA, 497 bp, Homo sapiens
  misc_feature 17, 30, 41, 44, 69, 293, 295, 300: n = A,T,C or G
gggcgcttgcaggtccnacactagtggatncaaagaattcngtncgagattaaaaatgtccttgtgggntttttggaggaaggtaggtagaggtaagacagcatagaatcatgatgatgatgatgatgatgatttttattattattcagaatgattatttcttgtacaacccccaaaagtcaatagaatacaagacacaaaaagagagcataatttctatcaccagttagtagaggtgctggaaattatgctctctcaaaatttcaaaggaaatttcattacttgtgaaatgngnagggncttatattctgtattttacccatttttacagttgaaatggcacccagcagtatcttttgtgtagaaaacattcacagtaaatttgtgggttttaagattatagtttgagtttatccctcctctatgaagctgaaaaacagtacagaggagaaatttttaatatgtcaccgagacttgcaggataaggcagaacccag

SEQ ID NO: 8608 - DNA, 427 bp, Homo sapiens
  misc_feature 2, 377, 411: n = A,T,C or G
gnaactttacatgctttctcatgatttatttgcacatttagagtgctgtagacatagaaacatttccattttgatttattcatttagaaatatttattgagcacttacaatgtgaatatcagtaggtcccgcttatctgcaaggcaagagacatgctccacaacccccagtggatgcctgaaaccatggatagtaccagactctgtacagtatatgttatgttttttccatctgataattgaggcaggatatatagcgtgggtaaagctggacaaagagatgattcaggtccagggttagctggagcaggatggcttgagatttcaccttgcttctcagaacagcacataattaaaaacatatgaattgtgtatttntggaattttccatttaacattttcagactttggntgactgtaggtaaatg

SEQ ID NO: 8609 - DNA, 101 bp, Homo sapiens
  misc_feature 5, 8, 94: n = A,T,C or G
ggaanccngcttaattgcttttcaaaaagttgaatcaacctaagcatttaacactaggaagttgtttaaatcattgacagaatatccatcccgnggaaacc

SEQ ID NO: 8610 - DNA, 297 bp, Homo sapiens
  misc_feature 9, 15, 32, 54, 60, 167, 215, 246, 261: n = A,T,C or G
aaaaaaacncctgtntttggggcgcttgaggnccgacactagtggatccaaagnaatttnttacgaggttcggcgagagcatgaccgatggattccagttcgagtatggcggccagggctccgaccctgccgatgtggccaatccagctgaccttcctgcgcctgangtccaccgaggcctcccagaacatcacctaccactgcaagaacagcgnggcctacatggaccagcagactggcaacctnaagaaggccctgctnctccagggctccaacgagatcgagatccgcgccgag

SEQ ID NO: 8611 - DNA, 334 bp, Homo sapiens
  misc_feature 2, 20, 45, 47, 229, 265, 296: n = A,T,C or G
tncttgggcgcttgaggtcnacactagtggatccaaagaattcgntncgagcttcagctctaaggatattagcaacaatgataaaacttggccttgaagaaatttacacaactagttagaacttgttactattgtaaaggaagagtcaactggaaaattcaaggagttaataaaatttgtttactttggtcccagcttttgagagataaatcccttatgaatccctggnctaaaatactttcctacagctgtgtaaaatactggncaaggagaactttttccttttacctcatgtngtaaacttaagtggctcaataaaaattgatccactgtc

SEQ ID NO: 8612 - DNA, 152 bp, Homo sapiens
  misc_feature 20, 24, 78: n = A,T,C or G
ggttggggttttttgtgtcntggngtcaatctgagagtctttctctttcaatgaaggagttttacccattaatagtcnttgttataagataaatacactctctcatctataaaagtgatcttcaaaaaggttaagtaaaaggcatttcagga

SEQ ID NO: 8613 - DNA, 500 bp, Homo sapiens
  misc_feature 17, 23, 30, 35, 45, 58, 94, 215, 299, 310, 359, 422, 483,496, 497: n = A,T,C or G
cttcttgggaaaaaaancctggnttttcgngcgcntgcaggtccnacactagtggatncaaagaattcttacgagggcctctgggccgtttggnagtaatcacccaggggctggtaaagcccctcctcttggcacctcagaatcacagtgttactgatcagggatgtgaggctgctgttgggggtggggggaggggaatgggcaggcaagccagncttctgtcttcctttgctaacttagggttttgagcaggttggggtatggtgcctgtcatacccacctgccaccctgggaacctnactgttctctntttcagcctagacctgctgatccagggtgtgtgtgagttgagggtgggnggaggggtttgcagtgtgggaatgtggccctgcagttgacctgagctgcttcacatggttgtncattctggggcttaaagaactgggaccagaccaagtagaggccttggtgctggttgggggnggggcctgcagannctt

SEQ ID NO: 8614 - DNA, 183 bp, Homo sapiens
  misc_feature 100, 127, 155, 158: n = A,T,C or G
ggggcccattatggaccaggggaccttgccttgactgaggcactttcatgagctcagtgagaagggccctgtattcacctccactgcccccagggcctgnggacaaaccggctgggggactgcccancttcccacctgtttatttaacttatttnagngctttataataaaggaaaccctaac

SEQ ID NO: 8615 - DNA, 222 bp, Homo sapiens
  misc_feature 2, 20, 33, 53, 161, 181, 198, 202: n = A,T,C or G
tnttgggcgcttgaggtccnacactagtggatncaaagaattcggtacgaggntttaccaggggatagaaattgtaatcccctaaacatctctgctacattaaatggacttttgtatgtctcctttgaacactgattttttttttttaaattgtcaaactnggaaaaaagcaccagcgtgnccaagtttctctagggncttnatttcattttcaggttttca

SEQ ID NO: 8616 - DNA, 500 bp, Homo sapiens
  misc_feature 25, 146, 359, 440: n = A,T,C or G
tcgaggctagataggaacctctgcnccagaattgccaggataattattggagggtcataactattcttcatatttttttttcttttttctcctttggtttctgggttatctttcttaacctcacgtatttctttatcctttttagngggggcctgtaattcaggctaattcaatagcaacaatagacaacatgatatggctgctgtcactttgaaacccaaaaggtctttgggtaggaatagagtaatgaaagaggaccagtcaacttcagtatatatacaaaggaaagacaaagagatgataaaccaaggctgaggaaatttttctgatgctttcttcatttctctaatatacctttngcattctttttctgataattgggctattaggcagaagacacaagttaccacgttgtgtattaaaagcagtaggtaggttgngccagtattttttcagccagtaagcatatacaggtaacttatataattaaaaattgggtt

SEQ ID NO: 8617 - DNA, 230 bp, Homo sapiens
ctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaac

SEQ ID NO: 8618 - DNA, 497 bp, Homo sapiens
  misc_feature 13, 225: n = A,T,C or G
gggcgcttgaggnccccactagtggatccaaagaattctttcgagcggaacctgtatccgggcccaacctgaaaacatcccagccaagaactggtataggagctccaaggacaagaaacacgtctggctaggagaaactatcaatgctggcagcctgtttgaatataatgtagaaggagtgacttccaaggaaatggctacccaacttgccttcatgcgcctgtnggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcgggg

SEQ ID NO: 8619 - DNA, 412 bp, Homo sapiens
  misc_feature 6, 42, 44, 80, 284, 323, 405: n = A,T,C or G
tgtgancttgaagatgcgacactagtggatccaaagaattcntnacgagagaagtcaaagctaaccgaggctgtgccttncgagacccccgggatggcccctgggaggccaaggagtcggggactgggtacccggagcagagtcactgtggccactggagaaccgcagcttgagctttatgaagccacgtggccacacctcccggtgcctccaccccaagcaaacacagatcgctcagaaaatgggaacccagggcaaattgtatgtgctcctttactgggttngttataagtgtcacatgttttttataataaaacataggngatttcaccttaaacacagttttcacacagcccctgctgcattctctgtccatctgtctgtttctattaataaagatttgtngatctgt

SEQ ID NO: 8620 - DNA, 496 bp, Homo sapiens
  misc_feature 2, 5, 30, 41, 122, 131, 189, 198, 222, 452: n = A,T,C or G
gngancttgaaatgcccacactagtggatncaaagaattcntttcgaggaaaagtgtgccatgaccgctctgagctccaagctgatctcccagcagaaagctttctttgctaagatggtggnggatgcagngatgatgctcgatgatttgctgcagcttaaaatgattggaatcaagaaggtacagggnggagccctngaggattctcagctggtagctggngttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtctngtccaaactccccattggggatgtggccacccagtactttgctg

SEQ ID NO: 8621 - DNA, 377 bp, Homo sapiens
  misc_feature 3, 12, 104, 118, 148, 190, 191, 197, 279, 280, 355: n = A,T,C or G
tgngagcacatnaagatgccccgactagtggatccaaagaattcttttcgagtagaagtctccctgcacagccctctagtgtccggggaccttgtgggaccagncccacaccgctggnccctgccctcccctgctcccaggttgaggngcgctcacctcagagcagggccaaagcacagctgggcatgcnntgtctngagcggcgcagagccctccaggcctgcaggggcaaaggggctggcttggagtctcagagcacagaggtaggagaactggggnncaagcccaggcttcctgggtcctgcctggccctccctcccaaggagccattctatgtgtgactctgggaggaagngcccaagcccctgcccctacgg

SEQ ID NO: 8622 - DNA, 251 bp, Homo sapiens
  misc_feature 2, 19, 106, 136, 149, 223: n = A,T,C or G
gnggctcatacctgtaacnccttgcactgtggggggccagaggtgagaggactgcttgaggccatggagctcaagaccagcctgggcaacatagaaagacctgggnggcatacacctgtggaccctactacttggnaggatgaggtggnaggattcatcacttgatcccaggagtttcaggctgcagtaagccatgatcacaccactgcacttcagcctgggngacagagccagaccatgtctcaaaaagt

SEQ ID NO: 8623 - DNA, 423 bp, Homo sapiens
  misc_feature 6, 19, 113, 141, 174, 308, 322, 345, 402, 419: n = A,T,C or G
caggtngaagcagataganggtaattttaaagttaatttattatgaatcattttcccctaatctgctaaatgaattagaactgattttaataaaaatattctgtgtaaaaagnactcagaaaaacatctaaagctgttggngaagagggactcatataaatagttggattgcgntttgctttttatttctttataaaaatatgtcaaaaacagtttttaattttagaaatcttatacttgaaagaaacctcaattatcagtggctttatgaagtaaagttaaaaacaaacataggaaatgtgaaaatntttgtgtttgtttngtctgactaacttgctgctaaangctatctttaggtgtgtgaaagttctttgatatgttattgtccttttacatcttgtnaaatagccattgctttngaga

SEQ ID NO: 8624 - DNA, 449 bp, Homo sapiens
  misc_feature 2, 17, 42, 52, 54, 82, 129, 170, 208, 210, 293, 366: n = A,T,C or G
gnccccactagtggatncaaagaattcttttcgagctggctngaagcctagngncttcataatgtaattcaatgaaaactgntggagaaatatttaaacacctcaatgtaggtacagttacactcttgntgcggggaggggatttaccagaatacagtttatttcgtganttctaaaaaacaaaaagatgaatctgtcagtgatatgngngtattataacttattaatcttgctgttgagctgtatacctggtttaaaaaatagtactgtttaatgctaagtaaggcagcagncatttgtgtattcaggctttttaaataaaattagagctgtaaggaaaatgaaaagccacaaatgcaagactgntcttaaatggaaggcatagtcagcgagggtaaatcctataccactttaggaagtattaaaaatatttttaagatttgaaatat

SEQ ID NO: 8625 - DNA, 500 bp, Homo sapiens
  misc_feature 2, 20, 36, 46, 48, 73, 145, 192, 275, 347, 440: n = A,T,C or G
tntttggggcgcttgaaggnccgacactagtggatncaaagaattntntacgagattcagccggcggttcggngcgacggactctccattccagaaccatggcccaatttgtccgtaaccttgtggagaagaccccggcgctggngaacgctgctgtgacttactcgaagcctcgattggccacattttggnactacgccaaggttgagctggttcctcccacccctgctgagatccctagagctattcagagcctgaaaaaaatagtcaatagngctcagactggtagcttcaaacagctcacagttaaggaagctgtgctgaatggtttggtggccacgtgaggngttgatgtggttttatgtcggagagattataggcaagcggggcatcattggctatgatgtttgaagaccaatctttaacatctgattatattngatttattaatttgagtgttggtggaccatgtgtgatcagactgctatctgaataaaata

SEQ ID NO: 8626 - DNA, 110 bp, Homo sapiens
tacttctagaagcggccggggccccatcgattttccacccgggtggggtaccagggtaagtgtacccaattcgccctatagtgagtcgtattacaattactgggccgaca

SEQ ID NO: 8627 - DNA, 362 bp, Homo sapiens
  misc_feature 1, 11, 31, 45, 93: n = A,T,C or G
ngggcgcttgnaggtcccacactagtggatncaaagaattctttncgagctctggcgtggtgaccaagcatgaagatgcagaggaccattgtnctccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattccc

SEQ ID NO: 8628 - DNA, 496 bp, Homo sapiens
  misc_feature 4, 18, 23, 52, 63, 64, 66, 72, 101, 131, 161, 176, 482, 491: n = A,T,C or G
gggnacaaaaacccaggnttttngggcgcttgcaggtccacactagtggatncaaagaattcnntncgaggngaacctcagccagcaccatctgggtcctntcccggcctccccactccttgtgtaactgngtcagtagcccagacccccatgtagtcggngttattggggctttngcaccaaaagaactgaatgttttgttttttgggtggccttgactatatatcaagacatcagccaccaacacaattgtctaaaatttaagaccatcctgactaacaaggatgttaaaatacacattaatgtacttacattccaggattacttagagctaatcctgcagggttgaatctctctagaagccctgctccctgagcttagagtgtcttagcacctgataccagtccgtttagacaggtgtttggaggaacgaagaatagaaatggacaaaagatcaaaacgggtccatagctattactcanaagagctgngcaag

SEQ ID NO: 8629 - DNA, 492 bp, Homo sapiens
  misc_feature 2, 18, 34, 230, 281, 323, 354, 355, 420, 432: n = A,T,C or G
cntttgcctacataagtnctcatttatttgtgtnttatttattacagggctgctattttcataatgtacatgaacaatgtcacagaacttttttaatttttttgaataattataagtatcagtaaaggaagtgaaagacaggattgcatttaatagataaaacgtttaggcgataattgaacaaaagaatcctggcatatttctaacactaatggcaatttacttatggnatttattttcagtagtaaagacccagcttgaatgtaaattttgtatagtgnaagtatgaagaacatagtgcaactgtacaggtagtcaccagntattgtgatatgataaataattgggctattnngatgaagaaaactttgttcatttgtttctactttctaagagaaattgccacgattcctctgcttntcaacatttcgnatgacttttttttcgggtgggaataaaaagctgtgaaattgttcaacctactttgtaacc

SEQ ID NO: 8630 - DNA, 100 bp, Homo sapiens
  misc_feature 10, 11, 49, 58, 68, 72, 98: n = A,T,C or G
gcgggagcgnnccaaatgaagtttaatccctttgtgacttccgaccgangcaagaatngcaaaaggcntttnaatgccccttcccacattcgaagganga

SEQ ID NO: 8631 - DNA, 175 bp, Homo sapiens
  misc_feature 36, 53, 54, 60, 135: n = A,T,C or G
gtcaaaataaatggattatcacctgaggcttggaantcttacatggtaatatnnatttantgagactttgcctttactgcagagtagaagcaatcttccctttagaaataaattctgaaagtttacctgtaattntgatatttgaaatttaggttatgttgtatagaaactatgt

SEQ ID NO: 8632 - DNA, 470 bp, Homo sapiens
  misc_feature 4, 41, 71, 73, 294: n = A,T,C or G
cttntttggggaaaaaaaaccctggtttttcgggcgcttgnaggtcgacactagtggatccaaagaattcntnacgaggacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgncatcccagtgctgatcttccaggcctatggatagatcaggaggcatcactgaggccaggagctctgcccatgacctgtatcccacgtactccaacttccattcctcgccctgcccccggagccgagtcctgtatcagccctttatcctcacacgcttttctacaatggcattcaat

SEQ ID NO: 8633 - DNA, 110 bp, Homo sapiens
  misc_feature 1, 18, 20, 81: n = A,T,C or G
nacttctagagcggccgngngcccatcgattttccacccgggtggggtaccagggtaagtgtacccaattcgccctatagngagtcgtattacaattcactgggccgaca

SEQ ID NO: 8634 - DNA, 498 bp, Homo sapiens
  misc_feature 1, 11, 41, 43, 101, 395, 425, 446, 457, 493: n = A,T,C or G
ngggcgcttgnaggcccacactagtggatccaaagaatttntnacgagccgacaggatgggcaagtgtcgtggacttcgtactgctaggaagctccgtagncaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttgggcgcaaaggtcatgctgttggngatattcctggagtccgctttaaggttgtnaaaagtagccaatgtttcttnttttggccctntacaaaggcaagaaggaaagaccaagatcataaatnttaat

SEQ ID NO: 8635 - DNA, 175 bp, Homo sapiens
  misc_feature 5, 103, 109, 136, 151, 171, 173: n = A,T,C or G
ctggngtgagtcaaatgccccctgagtgactgcccccagcccaggccagaagacctcccttcaggtgccgggcgcaggaactgtgtgtgtcctacacaatggngctatnctgtgtcaaacacctttgttttttttnaaaacatcaatgggntattaaaaatgaaaagattntngg

SEQ ID NO: 8636 - DNA, 495 bp, Homo sapiens
  misc_feature 100, 124, 128, 224, 244, 262, 283, 305, 350: n = A,T,C or G
atttaattaagacatgcccacattatttcttacttttcaaggaacaacatgttttacgacttgagattatctgtctagtgaccttagagctgcacagctngagaaacagagtcttcacaatgcntggnatgagggagagatgagtctcactagccacagagagaaaaacaggcagttaattttaaaggactccagccctttctcttcctcaaggggaattgggntttcttacatacaactgagnttttgcttacacagtctntaatttcttttaattcctgtnccataatgacaaaggggccagntcaccaggaagatataacggttatatctgcatctgacagcagagngctcaaatgtgtgacataaacgtttagaggattgaagggagacatagtagcacaatgtaaataggggactgtctgaccttgtatgtagagaaccctaaagatcccaaacacacaaaaaatgttacagctcatgaacaaattcagc

SEQ ID NO: 8637 - DNA, 101 bp, Homo sapiens
  misc_feature 2, 44, 55, 69, 83, 87: n = A,T,C or G
tntgccctttttagcaagaaagagcaggcctcagagccttctgnctagatagaangaatgatatagtgntgtggcatggtatntatntaattaattacctt

SEQ ID NO: 8638 - DNA, 104 bp, Homo sapiens
  misc_feature 24, 26, 59, 75: n = A,T,C or G
cactagtggatccaaagaattctntncgaggaatttatcaatgtgcctgtcccacagtnagcagatagggatccngccaacagttgctcatgactttaacaaga

SEQ ID NO: 8639 - DNA, 156 bp, Homo sapiens
  misc_feature 33, 110: n = A,T,C or G
caaacgggccctcaaatttatcaagaaaagggnggggacgcacatccgcgccaagaggaagcgggaggagctgagcaacgtactggccgccatgaggaaagctgctgccnagaaagactgagcccctcccctgccctctccctgaaataaagaaca

SEQ ID NO: 8640 - DNA, 491 bp, Homo sapiens
  misc_feature 33, 35, 37, 53, 64, 175, 232, 245, 260, 308, 432, 441, 470: n = A,T,C or G
cttgggaaaaaaacccggattttgggcgcttgnangncccacactagtggatncaaagaattcntttcgagggcgagagcatgaccgatggattccagttcgagtatggcggccagggctccgaccctgccgatgtggccatccagctgaccttcctgcgcctgatgtccaccgnggcctcccagaacatcacctaccactgcaagaacagcgtggcctacatggaccagcngactggcaacctnaagaaggccctgctnctccagggctccaacgagatcgagatccgcgccgagggcaacagccgnttcacctacagcgtcactgtcgatggctgcacgagtcacaccggagcctggggcaagacagtgattgaatacaaaaccaccaaagacctcccgcctgcccatcattcgatgtggccccctttgnacgtttggngccccagaccaggaattcggcttcgacgnttggccctgtctgcttcctgg

SEQ ID NO: 8641 - DNA, 118 bp, Homo sapiens
  misc_feature 21, 29, 32: n = A,T,C or G
caagcaatgtgtctgtcaagnatgttcgncgnggcaaccgttgctggtgacagcaaaaatgacccaccaatggaagcagctggcttcactgctcaggtgattatcctgaaccatcagc

SEQ ID NO: 8642 - DNA, 374 bp, Homo sapiens
  misc_feature 26, 32, 45, 71, 73, 109, 114, 154, 315, 348, 362: n = A,T,C or G
acttttttggggaaaaaaacccctgntttttngggcgcttgaggnccgacactagtggatccaaagaattntncacgagtaaggaacaaatgaaaactctgggctgggnggagnggctcatacctgtaatcccagcactttgggaggctacggngggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggnggaggttgcattcaactgagatcataccacttnattccagcctgggngacagagcaaga

SEQ ID NO: 8643 - DNA, 500 bp, Homo sapiens
  misc_feature 5, 11, 30, 41, 44, 50, 109, 483: n = A,T,C or G
tgggngcttgnagggccccactagtggatncaaagaattcnttncgaggnttatttttgtaaatcaagttacaccagaacacaggcacatccatttctttgcatattgnctatgggtgttttcaaacttcgatggcagagttgagttgttacaaaagagaatgtttgaagcccagtctatttactattttttataaactaggaaaagtttgcaagacccctgataatccaactttttctatatcgtacaggggagaaagcaaagcccagagagggaaaatgactcaaaggcacgtgaacattccacaatggggcagggcttcaccccttacctgctccttgcagtacattgcacctcagtttactcaatggggtgagacggtaaaagggattctacctatcagcatggactcagcttccatttcacaatgagtcactcatctccatcaagggcacaggaaggccctgaagagagggcaaggcncaaggaaaaagatcaca

SEQ ID NO: 8644 - DNA, 156 bp, Homo sapiens
  misc_feature 39, 60, 94, 144, 149, 154: n = A,T,C or G
actgcaaaataaaatctcggagttctatttatttattgncttcctgtaagaccttcgggncaaggcagaggcagggaaactaactggtgtgagncaaatgccccctgagtgactgcccccagcccggcaaaaaaaaaacctctnttttngtccngg

SEQ ID NO: 8645 - DNA, 500 bp, Homo sapiens
  misc_feature 25, 50, 66, 85, 148, 270: n = A,T,C or G
cttcttggggacaaaaacccggatnttgggggcttgaggaccccactagnggatccaaagaattcnttcgagcccgatatggcgnttccccgcataaacaacataagcttctgactcttacctccctctctcctactcctgctcgcantgtgctatagtggaggccggagcaggaacaggttgaacagtctaccctcccttagcagggaactactcccaccctggagcctccgtagacctaaccatcttctccttacacctagcaggtgnctcctctatcttaggggccatcaatttcatcacaacaattatcaatataaaaccccctgccataacccaataccaaacgcccctcttcgtctgatccgtcctaatcacagcagtcctacttctcctatctctcccagtcctagctgctggcatcactatactactaacagaccgcaacctcaacaccaccttcttcgaccccgccggaggaggagaccccattctatacc

SEQ ID NO: 8646 - DNA, 262 bp, Homo sapiens
  misc_feature 20, 24, 28, 38, 57, 67, 70, 206, 247: n = A,T,C or G
cttcttgggaaaaaaccccnggtntttngggcgcttgnaggtccacactagtggatncaaagaattnttncgagaatttttcttctgtaccatttagcactcccactaagcacttgataattctagttgctctacattctgaccaaaatttggagccaggtgaggtgcttcacgcctgtaatccctgcactttgggaggcccaggngggagaatcagctgaggccaggagttcaagaccggcctggncaacatagccagacc

SEQ ID NO: 8647 - DNA, 215 bp, Homo sapiens
  misc_feature 7, 9, 38, 51, 57, 104, 111, 114: n = A,T,C or G
cgcttgnangtcccacactagtggatccaaagaattcntttcgagcttggntttagntatgtggaactttagcatgggcgacttcatttctgtgtgttttttgntgttgtngtnttgagacagtttctctctgtcacccaagttagaatgcagtggcgcgatcatagcctcacttgcagtctggcctgccaggttcaacacattctcatgcttta

SEQ ID NO: 8648 - DNA, 424 bp, Homo sapiens
  misc_feature 17, 29, 67, 144, 172, 227, 315: n = A,T,C or G
gggcgcttgaaggtccncactagtggatncaaagaattcgtttcgagaaaacttccaaggccctgcnttttttcttaaaagtactttaaaaaggaaatttggttgtattttttatttacattttatatttttgtacatattgtnagggtcagccatttttaatgatctcggntgaccaaaccagccttcggagcgttctctgtcctacttctgactttacttgtggngtgaccatgttcattataatctcaaaggagaaaaaaaaccttgtaaaaaaagcaaaaatgacaacagaaaaacaatctattccgagcnttccagtaacttttttgtgtatgtacttagctgtactataagtagttggtttgtatgagatggttaaaaaggccaaagataaaaggtttctttttttttccttttttgc

SEQ ID NO: 8649 - DNA, 228 bp, Homo sapiens
  misc_feature 26, 37, 40, 66, 131, 158: n = A,T,C or G
cgcttgcaggtcgacactagtggatncaaagaattcnttncgagcaggaaactaactggtgtgagncaaatgccccctgagtgactgcccccagcccaggccagaagacctcccttcaggtgccgggcgcnggaactgtgtgtgtcctacacaatggngctattctgtgtcaaacacctctgtattttttaaaacatcaattgatattaaaaatgaaaagattattgg

SEQ ID NO: 8650 - DNA, 416 bp, Homo sapiens
  misc_feature 7, 11, 27, 33, 38, 40, 41, 293, 302, 329, 374, 393, 395, 411: n = A,T,C or G
cgcttgnaggnccgacactagtggatncaaagnaattntnncacgagggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcnccccatgcngttgattgctaaatgtaacagtctgancgtgacgctgaataaatgtcttttttttaaaaaaaagagtacttntagagcggccgggggcccntngattttccacccgggnggggt

SEQ ID NO: 8651 - DNA, 496 bp, Homo sapiens
  misc_feature 5, 20, 65, 96, 99, 129, 212, 256, 291: n = A,T,C or G
ggtgntcgatgagtatctgnagaccacagggaagccgattgaagccagcatccgaggggagctgnctggggactttgagaagctaatgctggccgnagngaagtgtatccggagcaccccggaatattntgctgaaaggctcttcaaggctatgaagggcctggggactcgggacaacaccctgatccgcatcatggtctcccgtagtgagntggacatgctcgacattcgggagatcttccggaccaagtatganaagtccctctacagcatgatcaagaatgacacctntggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcactgcggaaagccatgaaggga

SEQ ID NO: 8652 - DNA, 328 bp, Homo sapiens
  misc_feature 11, 31, 45, 92, 95, 101, 172, 221: n = A,T,C or G
cgggcgcttgnaggtccgacactagtggatncaaagaattctttncgagattccatcagggtgggaatcacatactcattgttggctagcgngtntgcagngcctaggacagaacctggcacttgataggcatttactgaatattttttgaataaaagaagaacgaaatggntgacagtaaataagtcttttaaaaacgttgaatcaaggctgggcatagnggctcatacctgtaatcccaacactttggaaggcagaggtgggagggttgcatgtgcttaggagttcaaaaccatcctgagcaatgtagtgagacctcgtctccacc

SEQ ID NO: 8653 - DNA, 310 bp, Homo sapiens
  misc_feature 11, 14, 39, 42, 77, 144, 236: n = A,T,C or G
ggggcgcttgnggnccacactagtggatccaaagaattnttncgagcttgtctgtggctgaaacacttacctgctgnggaaagccgagcaaggaggaggtaaacattggagatgtttgtgaaaatattactcttgctgtgaggntttagtttgttttgaatgagaaaagactaagtaacttaatccatctcaatgtagtgttttaataaaaaaggaacctaatatttgaaatgggnctcagacatgtctacaaatatgggtactatttttatgcccgtgtattttcacatttaataaaaatatttatggt

SEQ ID NO: 8654 - DNA, 397 bp, Homo sapiens
  misc_feature 122, 235, 327, 334, 350, 364, 368, 383: n = A,T,C or G
cgaaggtgaggagcctgagaacttcttctgggtgggcattggggcacagaagccctatgatgacgatgccgagtacatgaaacacacacgtctcttccggtgctccaacgagaagggctacntttgcagtgactgagaaatgctccgacttttgccaagatgacctggcagatgatgacatcatgttgctagacaatggccaagaggtctacatgtgggtggggacccagactanccaggtggagatcaagctgagcctgaaggcctgccaggtatatatccagcacatgcggtccaaggaacatgagcggccgcgccggctgcccntggtccncaaggccaatgagcancacgcctttacccnttgntccatgcttggagcnccttttgcaaggcc

SEQ ID NO: 8655 - DNA, 206 bp, Homo sapiens
  misc_feature 3, 36, 91, 94, 116, 168: n = A,T,C or G
acnctttggggaaaaaaaccctggttttcgggcgcntgcaggtcgacactagtggatccaaagtttttttttttaccattttactcttttnatnctgctcattaatgatctgaaanaagaagatggggaaaaggggattccaccacaaggctccaaagaaccaagagngcaaatcagcccatttcactttcactgtctgagatagg

SEQ ID NO: 8656 - DNA, 282 bp, Homo sapiens
  misc_feature 8, 16, 255, 265: n = A,T,C or G
gcagcagnagagaganagagaaagagacagacagagatggacagagagacagagacagagagagaaacagacagacagggagggagggacggagacaggcagagagagagagacaggcagacagccagagaaagagagtaagacagaagataggcacagaaagagagacagacacagagagagacagagagacagagaaaaagaaagagagagacagacagacagagaaagagacagacagagagagagagaggnagagagaganacagacagacagggaga

SEQ ID NO: 8657 - DNA, 430 bp, Homo sapiens
  misc_feature 27, 33, 38, 51, 64, 86, 147, 277, 346: n = A,T,C or G
tgggaacaaaaacccaggttttcgggngcttgnggtcnacactagtggatncaaagaattcttncgagtgaaatcatgactgaccnaggcagtcggcaagaaaaggggctttgcctttgtaacctttgatgatcatgactccgtggntaagactgtcattcagaaataccatactgtgaatggccacaactgtgaaattaggaaaggcctgtcaaagcaagagatggtgagtgcttcatccagccaaagaggtcaaagtacttctggaaactttggnggtggtcgtggaggtggtttcggtaggaatgacaactttggttgtgaaggaaatttcagtggtcatggnggctttggtggcagctgtggtggtggtggatatcgtgcagtggggatggctataatggatttggtaatgatggaagcaattttg

SEQ ID NO: 8658 - DNA, 417 bp, Homo sapiens
  misc_feature 18, 64, 70, 119, 193, 263, 280, 290, 306: n = A,T,C or G
tacgagcgcggccgcggnttcagccctggaggagctcagggtggccggcattcacaagaaaggnggcccnggaccatcggcatttctgtggatccgaggaggcggaacaagtccacggngcccctgcaggccaacgtgcagcgggttgaaggagtaccggttccaaactcatcctcttccccaggaagccctnggcccccaagaagggagacagttctgctgaagaactgaaactggccacccagctgaccggaccggcattncccgtccggaacgtctntaagaagganaaagctcgagtcctcnctgaggaagagagaatttcaaagccttcgctagtctccgtatggcccgtgccaccgcccggtttttgggtttcgggcaaaaaggacccagggagcccgagaacaggatgtt

SEQ ID NO: 8659 - DNA, 201 bp, Homo sapiens
  misc_feature 15, 128, 156, 192: n = A,T,C or G
cccccctgggccccnaggacccccaggctccattggtcaccctggcgctcgaggaccccccggataccgcggtcccactggggagctgggagaccccgggcccagaggaaaccagggtgacagagganacaaaggcgcggcaaggagcagggctgnacgggcctgaaggagaccaggggcccaaggaccccnaaggcgtgc

SEQ ID NO: 8660 - DNA, 313 bp, Homo sapiens
  misc_feature 36, 214, 255, 256: n = A,T,C or G
atttattcaagtgtctattgcttaattgttaattgngagcagatttattgaatgcctattctattttctgcagtttacaatacaataactctttgagtaagttgaagtttaattgtgcaacaaatttgtattaggagtacaatttaaagtgtttttctctatagccttttttgactggggaagcaaggggtaatgttaattagtacactttgtncttgtactagctatgtttctataagatatggagccctgtgnntcccagagatgctagaaaactgttctttgctcctatttgtgggttctgtttttgtgg

SEQ ID NO: 8661 - DNA, 495 bp, Homo sapiens
  misc_feature 8, 31, 41, 43, 144, 186, 281, 288, 303, 427, 449, 481: n = A,T,C or G
cgggcgcntgcaggtccgacactagtggatncaaagaattntncacgagtcactgtgttagccaggatggtctcgatttcctgacctcgtgatccgcccacctcggcctcccaaagtgctgggattacaggcgtgagccaccgngcccgaccttattccagttttgaaatgatcacactggtagtncctcactgttcgctgatgagggccacagttctaaggagactggggaaggaatcaggagtccttctggcagtcaggatcagtttctacctggctgngtatggngccagcaagtgtggncacctataggccccagtctcccagtgggtcaggcagcagggcaaggtgagctgtgaggaacccttagctccccaagagcctctgacctaagggaagtgtttctctggtgaaactgcctggcttnggtctcaactcccacccttgtngctgcaaacaaaccactcctctctgagctctnataatactgcactt

SEQ ID NO: 8662 - DNA, 399 bp, Homo sapiens
  misc_feature 5, 18, 29, 32, 53, 151, 229, 260, 271, 278, 313, 314, 330,362, 382, 393: n = A,T,C or G
gtccnacactagtggatncaaagaattcnttncgagggattccagttcgagtntggcggccaggggtccgaccctgccgatgtggccatccagctgaccttcctgcgcctgatgtccaccgaggcctcccagaacatcacctaccactgcnagaacagcgtggcctacatggaccagcagactggcaacctcaagaaggccctgctgctccagggctccaacgagatcnagatccgcgccgagggcaacaagccggtttnacctacagcgncactgtngatggctgcacgagtcacaccggagcctggggcannaaagtgattgaatacnaaacaccaagacctcccgcctgcccattattnaatgtggcccccttggacgntggggccccanaacaag

SEQ ID NO: 8663 - DNA, 384 bp, Homo sapiens
  misc_feature 4, 11, 33: n = A,T,C or G
aatnttttggnaaaaaaaaccctggtttttcgngcgcttgcaggtcgacactagtggatccaaagattcggtacgagtcttactgggttggtgaagattccacatacaaattttttgaggttatcctcattgatccattccataaagctatcagaagaaatcctgacacccagtggatcaccaaaccagtccacaagcacagggagatgcgtgggctcgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaattta

SEQ ID NO: 8664 - DNA, 245 bp, Homo sapiens
  misc_feature 11, 41, 123, 142, 206: n = A,T,C or G
ggggcgcttgnaggccgacactagtggatccaaagaatttngcacgagtcttgggtcccctcctctgccatcacctgaagacccccacgccaaacactgaatgtcacctgtgcctgccgcctnggtccaccttgcggcccgngtttgactcaactcagctcctttaacgctaatatttccggcaaaatcccatgcttgggttttgnctttagccttgtaacgcttgcaatcccaataaagcatta

SEQ ID NO: 8665 - DNA, 323 bp, Homo sapiens
  misc_feature 55, 62, 89, 95, 120, 176, 201, 284: n = A,T,C or G
gaactagtctcgagttttttttttatcagaatggcaacagacagaagtactttgnagagatngacttcctaagctacttaagacaactngccccnctaagaaaaaaatgtagaaccattnggaaaaatgaaatttagtagttccaagtttcaaagaaatgtcaacattttattccnttcaataaagaacaaaaccaatagngtttttattactttcatctgaaacattccatgttttaatctgagccttgcagactttcatttggagtttgaacccgttttggntgcatttcatttttggagaacttaattaacgtgagattg

SEQ ID NO: 8666 - DNA, 428 bp, Homo sapiens
  misc_feature 20, 23, 28, 73, 174, 312: n = A,T,C or G
cgcgagataaaatataggantanccttnggaaacatatcaagaagacatgcgtggtggagaaaacaagccagnctccacctttggcaaccttggtgaaaaaatgaatggaataatcatggtgtctgggatggagggatggcccctacatgtatcacgtaggggccgtgtatcangttccttgcatgggctatcaacagcaaggactgatgccaagtcctacttttggcaccatcaattgaagaccagtgaatcagtttttggtaagttggaggagagactattcatcctcactggaatagatacataatttnttatgagtttgccttccctgctgacagccttttggcaagcaacagcgtggaagaatcagggaatatctagattatcagcatgggatattacagatattatactggaccaggggagc

SEQ ID NO: 8667 - DNA, 360 bp, Homo sapiens
  misc_feature 112, 174, 206, 235, 344, 353, 356: n = A,T,C or G
cctactggaaaaagagtggaaatttattaaaatctgaaagtatgagatcctgttatgttaagggaaatccaaattcccaattttttttggtctttttaggaaagattgttgnggtaaaaagtgttagtataaaaatgataatttacttgtagtcttttatgattacaccaatgnattctagaaatagttatgtcttaggaaattgnggtttaatttttgacttttacaggtaagngcaaaggagaagtggtttcatgaaatgttctaatgtataataacatttaccttcagcctccatcagaatggaacgagttttgagtaatcaggaagtatatctatatgancttgatatngtnttat

SEQ ID NO: 8668 - DNA, 289 bp, Homo sapiens
  misc_feature 121, 143, 210, 247, 257: n = A,T,C or G
tacaagcattgcttttggcaaattaaagtgcatgtcatttcttaatacactagaaaggggaaataaattaaagtacacaagtccaagtctaaaactttagtacttttccatgcagatttgngcacatgtgagagggtgtccangtttgtctagtgattgttatttagagagttggaccactattgtgtgttgctaatcattgactgtagncccaaaaaagccttgtgaaaatgttatgccctatgtnacagcagagnaacataaaataaaagtacattttataaaccat

SEQ ID NO: 8669 - DNA, 110 bp, Homo sapiens
  misc_feature 77, 104, 108: n = A,T,C or G
tacttctagagcggccgagggcccatcgattttccacccgggtggggtaccagggtaagtgtacccaattcgccctntagtgagtcgtattacaattcactggnccgnca

SEQ ID NO: 8670 - DNA, 427 bp, Homo sapiens
  misc_feature 13, 19, 98, 326, 410: n = A,T,C or G
ctgtgaaaatggntcgctnttcacttgacccggagaaccccacgaaatcatgcaaatcaagaggttccaatcttcgtgttcactttaagaacactcgngaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgttgcacatgcttaaaaacgcagagagtaatgctgaacttaagggnttagatgtagattctctggtcattgagcatatccaagtgaacaaagcacctaagatgcgccgccggacctacagagctcatggncggattaacccatacat

SEQ ID NO: 8671 - DNA, 359 bp, Homo sapiens
  misc_feature 56, 81, 176, 206, 233: n = A,T,C or G
cagatcagcacattaagcaggtttgcatgagagtcatacaagaacattttgctganatggctgccagtcttaagcgtccanactcaggtgccactgggcttcctggaaggcctggccctcctggtccccccggccctcctggagagaatggtttcccaggccagatgggaattcgnggccttccgggcattaaggggccccctggngctcttggtttgaggggacctaaaggngacttgggagaaaagggggagcgtggccctccaggaagaggtcccaacggtttgcctggagctataggtctcccaggtgacccaggccctgccagctatggcagaaatggccgagacggtgagcga

SEQ ID NO: 8672 - DNA, 449 bp, Homo sapiens
  misc_feature 86, 131, 352, 439: n = A,T,C or G
ggttatcaataagctcctagtccagacgccatgggtcatttcacagaggaggacaaggctactatcacaagcctgtggggcaaggngaatgtggaagatgctggaggagaaaccctgggaaggctcctggntgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgngaaatgtgctggtgaccgttttggcaatccatttcggcaaagaattcacccctgaggtgcaggcttcctggcagaagatggtgactngcagtggcca

SEQ ID NO: 8673 - DNA, 500 bp, Homo sapiens
  misc_feature 3, 5, 32, 58, 64, 113, 139, 175, 194, 223, 241, 333, 338,362, 377, 407, 409, 411, 450, 470, 480: n = A,T,C or G
gtntnacattactgcccgctggcggatccaangaattttttcgagagaaagcttaggntattgntgtaaaacctgcagaggaagaacatttggatcacaaattataaattttntgtcttgctgattaattgctaccttngtaaagcactcttcccttttgctttgaggagcctgnattatatatacataggctngtaactccatgcgtgatacaatacctggnaccttctgggcgttcagntaatgttgatgtagccaagtcatagagtccatatttgtattttcataagtccagaataacacacttacctatttaaagaattccaactgagngtggncaaaaaccctgacaggtataaatngtgaaaaggtctagncttcatttttctccccatatgaactccttngngngctaatgataagcatgttcattgtaaatatggattttgnggcattcactatgtatcgtnccatggcagntagttgtaagtattctctta

SEQ ID NO: 8674 - DNA, 424 bp, Homo sapiens
tctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttcttt

SEQ ID NO: 8675 - DNA, 258 bp, Homo sapiens
  misc_feature 164, 171, 197, 199: n = A,T,C or G
atcaattccctggtgcggtaccagtgcacagaggggtttgtccagcgccacatgcccaccatccggtgccagcccagcgggcacatgggaggagcctcagatcacctgcacagaccccaccacctacaaacgcagactacagaagcggagctcacggcaccctnggagganccgccccagcacagcccactgagaanancttccaggacgcacccaggacgctgagcccaggagcctgccaggctgacgtgcatccca

SEQ ID NO: 8676 - DNA, 469 bp, Homo sapiens
  misc_feature 2, 5, 29, 30, 32, 205, 226, 424, 453: n = A,T,C or G
angcnacactagtggatccaaagaattcnntncgagccggcgccggagggggcccggggtacccagcccccagcccgacgtgaccatgctgtcccgcctcctaaaagaacaccaggccaagcaggaatgaacgcaaggagcttgcagggaaaagaggaggcgagaggctatcacttgcagcgaccctgcctgacagaagctttgnaggatcacctcaatgtggggngtggcccaggcctacatgaaccagagaaagctggaccatgaggtgaagaccctacaggtccaggctgcccaatttgccaagcagacaggccagtggatcggaatggtggagaacttcaaccaggcactcaaggaaattggggatgtggagaactgggctcggagcatcgagctggacatgcgcaccattgccactganctggaatatgtctacaaagggcagctggngtcttgccctttccta

SEQ ID NO: 8677 - DNA, 116 bp, Homo sapiens
  misc_feature 85, 108: n = A,T,C or G
ggggcgccaaggagctaaagaacatccacgtgtgcctgggtggcctgttcgtgcctgaggcgtacatcactgccaccaggcagtntggggcccaggccaacagctggnccctggag

SEQ ID NO: 8678 - DNA, 402 bp, Homo sapiens
  misc_feature 3, 6, 27, 51, 54, 86, 91, 118, 195, 227: n = A,T,C or G
ccnggnccttgggcgcttgcaggtccnacactagtggatccaaagaattcngtncgagcataaaatcatatattcctgttgaagtnctttngaagtcctatctctatttattatattngaaagttggcaagccaccagtcatccagaatttccttcctgaatctccatgctcatatgcaatgtctacatcaaggncttcttaatgactattattctcagggtttagntttctaccttctgcctactattttggtctgacatttttgtagccttctgttattattggaaataggctcttacataagctgatttcgagaactttcaaaatctcacatagctaatggaagttgctttctgctttcttatgactgtttttataaataaactgtttcataaataatg

SEQ ID NO: 8679 - DNA, 496 bp, Homo sapiens
  misc_feature 9, 13, 28, 77, 386, 412, 461: n = A,T,C or G
tctttgggnaaanaacccctgttttttngggcgcttgaaggccgacactagtggatccaaagaattttgcacgaggncatccccactcccagcccctattcctctatgtgacagctggctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctttccctaaggaaccatagaagagaggaagaaaacaaagggcatgtgtgagggaagctgcttgggtgggtgttagggctatnaaatcttggatttggggctgaggggngggagggagggcagagctctgcacactcaaaggctaaactggtgtcagnccttttttcctttgttccaaataaaagattaaacc

SEQ ID NO: 8680 - DNA, 320 bp, Homo sapiens
  misc_feature 2, 30, 36, 42, 124, 138, 148, 201: n = A,T,C or G
tngggcgcttgaggccgacactagtggatncaaagnaatttngcacgaggggttggaaagtccaagccgtaggacccagtttcctttcttagctgatgtctttggccagaacaccgtgggctgntacttgctttgagntggaagcggnttgactttacgcctgtaaatgtattcattcttaatttatgtaaggtttttttngtacgcaattctcgattctttgaagagatgacaacaaattttggttttctactgttatgtgagaacattaggccccagcaacacgtcattgtgtaaggaaaaataaaagtgctgccgta

SEQ ID NO: 8681 - DNA, 415 bp, Homo sapiens
  misc_feature 67, 130, 158, 189, 255, 351: n = A,T,C or G
tcgagcaggcactcagaatggtccagcgtttgacataccgacgtaggctttcctacaatacagcctntaacaaaactaggctgtcccgaacccctggtaatagaattgtttacctttataccaagaaggntgggaaagcaccaaaatctgcatgtggngtgtgcccaggcagacttcgaggggttcggngctgtaagacctaaagttcttatgagattgtccaaaacaaagaaacatgtcagcagggcctatggnggttccatgtgtgctaaatgtgttcgtgacaggatcaagcgtgctttccttatcgaggagcagaaaatcgttgtgaaagtgttgaaggcacaagcncagagtcagaaagctaaataaaaaaatgaaacttttttgagtaataaaaatgaaaagacgctgt

SEQ ID NO: 8682 - DNA, 178 bp, Homo sapiens
  misc_feature 3, 7, 159: n = A,T,C or G
tgngagncttgaagatgcgacactagtggatccaaagattcgtttcgagctccttcaaagaagttttatttttggtccagagtacttgttttcccgatgtgtccagccagctccgcagcagcttttcaaaatgcactatgcctgattgctgatcgggtnttaactttttcttttcctg

SEQ ID NO: 8683 - DNA, 103 bp, Homo sapiens
tacttctagagcggccgagggcccatcgattttccacccgggtggggtaccagggtaagtgtacccaattcgccctatagtgagtcgtattacaattcactgg

SEQ ID NO: 8684 - DNA, 420 bp, Homo sapiens
  misc_feature 169, 220, 314, 373, 399: n = A,T,C or G
cccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtntttgaagccgtgtacagcccaccgcctgccgacttgtgtaatgccctacgntggtataatcacatcaagtcttacgaaaaggaaaaggccagcctgccaggagtgaagaaagctttgggcaaatatggtcctgccgatgtggaanacactacaggaagtggagctacagatagtaaaagatgatgatgacattgacctctttgnatctgatgatgaggaggaaagtgaanaagcaaagaggctaagggaag

SEQ ID NO: 8685 - DNA, 483 bp, Homo sapiens
  misc_feature 4, 20, 66, 233, 339, 405, 454, 461, 481: n = A,T,C or G
gggnaaaaaaacccaggatntttcgggcgcttgcaggtccgacactagtggatccaaagaattcgntacgaggaatatatcatcactaactgtagtcaccatgctatacagtagagctcttgaacttattcctgtctaactgtaattatgtatcctttagacccacatctccccattccccctcccctaaccacttcagcctatggaaagaaaattctgctttccacttccgngagatcaccttttacagattccacaaatgagtgagatcatgtagtatttgtctgtgtctggcttatttcagttaacatagtctcttccaggttcatccattttgtngcaaatgataggattttattcatttttatggctgaatagtattccattgtgtatatacactatatntcctttatccattaatggacatttgttgattccatatcttggctgttgnaaatagngctgcaataaacatgtgagngc

SEQ ID NO: 8686 - DNA, 293 bp, Homo sapiens
  misc_feature 4, 22, 37, 73, 74, 80, 134, 256, 265, 286: n = A,T,C or G
cttntttgggaaaaaaaacccnggattttcgggcgcntgcaggtccgacactagtggatccaaagaattcgtnncgaggntgcatcagtaccccattctatcatcaacgggtacaaacgagtcctggccttgtntgtggagacggattacaccttcccacttgctgaaaaggtcaaggccttcttggctgatccatctgcctttgtggctgctgcccctgtggctgctgccaccacagctgctcctgctgctgtgnggccccagnttaaggttgaagcaagaaaanatcggag

SEQ ID NO: 8687 - DNA, 436 bp, Homo sapiens
  misc_feature 9, 17, 56, 66, 69, 167, 222, 398: n = A,T,C or G
cttgggganaaaacccnaggtttttttgggcgcttgaaggtccacactagtggatncaaagaattnttncgagcatggttaacgtccctaaaacccgccggactttctgtaagaagtgtggcaagcaccaaccccataaagtgacacaagtacaagaagggcaaggnttctctgtacgcccagggaaagcggcgttatgacaggaagcagagtggctatggngggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagngtcatcttttattatgaagacaataaaatcttgagttt

SEQ ID NO: 8688 - DNA, 500 bp, Homo sapiens
  misc_feature 22, 43, 95, 189, 463, 472, 474: n = A,T,C or G
ctttttggggaacaaaaacccnggattttgggcgcttgcaggnccacactagtggatccaaagaattcgttcgaggcggacgggttgtgcctggnggtggaggggaagatggtcagtaggacagaaggtaacattgatgactcgctcattggtggaaatgcctccgctgaaggccccgagggcgaaggnaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcaggaacaaatcaagcacatccttgctaatttcaaaaactaccagttctttattggtgaaaacatgaatccagatggcatggttgctctattggactaccgngaggatggngngaccccatatatgattttctttaagg

SEQ ID NO: 8689 - DNA, 500 bp, Homo sapiens
  misc_feature 14, 19, 49, 60, 62, 63, 86, 146, 204: n = A,T,C or G
aaaaaaacccaggnttttngggcgcttgcaggtccgacactagtggatncaaagaattcntnncgagccagtgtttaccgaggttngcccaaatccaagatctagtgggaggggaaagagcaaatgtctgctccgaggagggcggngtgttgatctttggaggaaaaatatgttctgttgttcagctggatttgccgtggcagnaaatgaaactaggtgtgtgaaatacccgcagacatttgggattggcttttcacctcgccccagtggtagtaaatccatgtgaaattgcagaggggacaaggacagcaagtaggatggaacttgcaactcaaccctgttgttaagaagcaccaatgggccgggcacagtagctcccacctgtaatcccagcacttcgggaggctgaggtgggcggatcatttgaggtcaggagttcgagaccagcctggccaacatggtgaaaccccatctctactaaaaatacaaaaattagccgg

SEQ ID NO: 8690 - DNA, 497 bp, Homo sapiens
  misc_feature 16, 41, 43, 83, 156, 165, 307, 412, 448: n = A,T,C or G
gggcgcttgcaggtcnacactagtggatccaaagaattcgntncgagcttgattcatgtattgggaagctacagggactacgnaatacctgcttatcacataggaaaattatgtccatgattctgagctcccttcttcaaaagtttcctcctgggngttctatgntctctctttatcctgaaatacatttattaggttgtgaggtatgttgaagaagtagaagccaggggtatgctttcagcatttattgcaaccaaaagttaaccccatcacggttaacgagcatctttggtctcttgtggaattngaactaaaactatgagccttattcaatatctataattctatgatttttttaaattatgggaaattaatgaaagatgtttacatgaataatgtttgcccttactgngttatgaatgagttttttgtagtgtgtctgggtgcntgatgcaagagagtaggaaaaatgtttctgaaacaaaacttgacaaata

SEQ ID NO: 8691 - DNA, 396 bp, Homo sapiens
  misc_feature 4, 72, 98, 135, 310: n = A,T,C or G
cttntttggggaacaaaaaccctggttttcgggcgcttgcaggtcgacactagtggatccaaagaattcttnacgagcaccaattgaatgctggttgntgtacacaatagaagctaaaagtaacatgtgcagcgnggccatgttaatattgctaaagaaacctttagttgaatagtatgattttagagctttagttcaaagtcgtaatatcgcaatagcattacttttgcaaaatacacaaatctttcttctatatgaaaaatgtggattaaaaaagacttgcttgttcaagctttaactacagtagttncttacatgccttcagagctttgggggaagcatatgctctttgtgactatacctgtaattttagaatcatgtagcccaaatggatag

SEQ ID NO: 8692 - DNA, 388 bp, Homo sapiens
  misc_feature 5, 14, 27, 38, 41, 382: n = A,T,C or G
gcgcntgcaggtcnacactagtggatncaaagaattcnttncgagcacgggttaggatgagttgaagtgaatgcaaagatgattgaaagagaaatatgtagcaaacagtggttttggtaggcgaggctgggggaaccggctgaagatggctctcaggggctgcagggtggaccagcatctcagtccatgcctgccctggcaggtggctcagatccactcagccatttacacactgtaccacctttacaagctgcaccaccactgacgtccccatccccgagagggggagggtagagcctcgcagctgcatctttgggtcatcgggaagtccttgagtcagtgcaggcaaagacctgtgatgtctgaggctagccaccatgancaccgc

SEQ ID NO: 8693 - DNA, 396 bp, Homo sapiens
  misc_feature 27, 133, 135, 184, 220, 264, 277, 295, 301, 372: n = A,T,C or G
aaaaattcttgggccctaccccagggntactgaatcagaaacttggttggggcctagcagtgttttcatgagccctccattgatcttgatgcagctgaagtgccgggcaccagtgaaagggaagggctgcggnancgattccattgattcctgctttgatggaagttatggcctcacaggttanacgttgcaagttgagttggccctcttgcctaggtgngcctccttgccttgggattctgacatgaacaggtgaagtctctncatgatttttttngttgttgtggttaatggnatgctngctattatggccaatatgtaaatgttactctgaatacatatttatataccatgttacttagtgacattatncaaacatttgtatgcgtatttggg

SEQ ID NO: 8694 - DNA, 411 bp, Homo sapiens
  misc_feature 41, 221, 234, 253, 278, 316, 385: n = A,T,C or G
tggcggcgaacgcggagagcacgccatgaaggcctcgggcncgctacgagagtacaaggtagtgggtcgctgcctgcccacccccaaatgccacacgccgcccctctaccgcatgcgaatctttgcgcctaatcatgtcgtcgccaagtcccgctttctggtacttttgtatctcagttaaagaagatgaaagaagtcttcaggggagattgtctacttgngggcagggtgttngagaagtcccccctgcggntgaagaacttcgggatctggctgcnctatgactcccggagcggcacccacaacatgtaccggnaataccgggacctgaccaccggaggcgctgtcacccagtgctaccgagacatgggtgcccgggacccgngcccgagccccttcattcagatatga

SEQ ID NO: 8695 - DNA, 114 bp, Homo sapiens
  misc_feature 1, 18, 56: n = A,T,C or G
ntaagatggtatctcatngtgatttgatttgcatttctctaacaattggagatgtngagcattttttcatatacttgttggccacatgtatgtcttcttttaagaagtgtctgt

SEQ ID NO: 8696 - DNA, 270 bp, Homo sapiens
  misc_feature 3, 16, 27, 30, 222: n = A,T,C or G
ccnacactagtggatncaaagaattcnttncgaggccaaagaagaggttgcaggtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcaggncctgaaagcagcggacctgggctgttctgtgttgaaggagtgtgccca

SEQ ID NO: 8697 - DNA, 193 bp, Homo sapiens
  misc_feature 2, 17, 27, 30, 48, 183, 184: n = A,T,C or G
gncgacactagtggatncaaagaattnttnacgaggctgagggcaggngggaagcaaacccggacgcatcgcagcagcagcagcagcagcagaagcagcagcagcagcctccgagtccctccagagacatggatccccagacagcaccttcccgggcgctcctgctcctgctcttcttgcatnntggctttcc

SEQ ID NO: 8698 - DNA, 495 bp, Homo sapiens
  misc_feature 12, 215, 372, 451, 467: n = A,T,C or G
tcgaggttttgngtggaaaaacgccttggagtgtgacatttctgcgagaatgcttaaataccgatttcccgcaggaacaatggcgctgtcttcagtggcacagtggagcagctctgaagatgcaaagatacacgaaaaaacttccagaacatctgggagaatatttaatggaaaatcgcttggttaaaacctgacacttttaacaggtatgtgtngttttagtactttatgattgagcatagcatttaatccacacctagactaaatcaaattttttttgtcagtgaacagcgttctgagtgtggacgagtagccagtgaagataatgaatgtcgaatgtgactgactagcagcttcattttgaatgagggncgctgtctgcccattgatagaggccagattgtcttggaagttccaaagttgcaacgatttctggctagtgccacgaggnttaccttgactgttgngtgaaaagctgataagaaaaccatccag

SEQ ID NO: 8699 - DNA, 395 bp, Homo sapiens
  misc_feature 2, 9, 31, 42, 175, 196, 229, 321: n = A,T,C or G
tngggcgcntgaaggccgacactagtggatncaaagaatttngcacgaggctgacctgacctgatgtccattcatcccaccctctcacagttcggacttttctcccctctctttctaagagacctgaactgggcagactgcaaaataaaatctcggagttctatttatttattgncttcctgtaagaccttcgggncaaggcagaggcaggaaactaactggtgtgagncaaatgccccctgagtgactgcccccagcccaggccagaagacctcccttcaggtgccgggcgcaggaactgtgtgtgtcctacacaatggngctattctgtgtcaaacacctctgtattttttaaaacatcaattgatattaaaaatgaaaagattattggaaag

SEQ ID NO: 8700 - DNA, 498 bp, Homo sapiens
  misc_feature 1, 32, 54, 65, 67, 119, 172, 245, 293, 392, 401, 438, 469: n = A,T,C or G
nttgggaaaaaaaaccctggttttcgggcgcntgcaggtcgacactagtggatncaaagaattcntnacgagctcgtgccggtggaaatgcctccgctgaaggccccgagggcgaaggnaccgaaagcacagtaatcactggtgtcgatattgtcatgaaccatcacctgcnggaaacaagtttcacaaaagaagcctacaagaagtacatcaaagattacatgaaatcaatcaaagggaaactngaagaacagagaccagaaagagtaaaaccttttatgacaggggctgcngaacaaatcaagcacatccttgctaatttcaaaaactaccagttctttattggtgaaaacatgaatccagatggcatggttgctctattggactaccgngaggatggngtgaccccatatatgattttctttaaggatggtttanaaatggaaaaatgttaacaaatgtggcaatnattttggatctatcacctgtcatcataac

SEQ ID NO: 8701 - DNA, 500 bp, Homo sapiens
  misc_feature 33, 37, 63, 65, 84, 93, 105, 123, 138, 179, 276, 279: n = A,T,C or G
tgggaaaaaaaaccctggttttcgggcgcttgnaggnccgacactagtggatccaaagaattntncacgagctacaaaattggnggtattggnactgttcctgtnggccgagtggagactggngttctcaaacccggnatggtggtcacctttgctccagtcaacgttacaacggaagnaaaatctgtcgaaatgcaccatgaagctttgagtgaagctcttcctggggacaatgtgggcttcaatgtcaagaatgtgtctgtcaaggatgttcgncgnggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtc

SEQ ID NO: 8702 - DNA, 425 bp, Homo sapiens
  misc_feature 13, 27, 40, 55, 65, 90: n = A,T,C or G
actttttgggaanaaaccctgtttttngggcgcttgaggncgacactagtggatncaaagaattntgcacgagcacatcatgggccagantgttgcaagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatg

SEQ ID NO: 8703 - DNA, 244 bp, Homo sapiens
  misc_feature 30, 41, 43, 44: n = A,T,C or G
cgggcgcttgcaggtcgacactagtggatncaaagaattcntnncgaggagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacacttttgtgagaaccaatgggaaggagcctgagctgctgga

SEQ ID NO: 8704 - DNA, 359 bp, Homo sapiens
  misc_feature 6, 133, 186, 239, 258, 303, 318, 320, 353: n = A,T,C or G
cccagngcctccttgtgcctagaccttcttctcccacccccttctgcccctgggtccccggccatccagcggggctgccagagaaccccagacctgcccttacagtagtgtagcgccccctccctctttcggntggtgtagaatagccagtagtgtagtgcggtgtgcttttacgtgatggcgggngggcagcgggcggcgggctccgggcagccgtctgtccttgatctgcccgcggngccccgtgttgtgttttgngctgtgtccacgcgctaaggcgaccccctcccccgtactgacttntcctataagcgcttntnttcgcatagtcacgtagctcccaccccaccctnttcctg

SEQ ID NO: 8705 - DNA, 446 bp, Homo sapiens
  misc_feature 19, 225: n = A,T,C or G
ctcctccccaccgatcgcnggtccccacatctggggcgcttttgggttggaaaaccaccccacactgggaatagccaccttgcccttgtagaatccatccgcccatccgtccattcatccatccgtccgtccatccatgtccccagttgaccgcccggcaccactagctggctgggtgcacccaccatcaacctggttgacctgtcatggccgcctgtgccctgnctccacccccatcctacactcccccagggcgtgcggggcttgtgcagactggggtgccaggcatctcctccccacccggggtgtccccacatgcagtactgtataccccccatccctccctcggtccacttgaacttcagagcagttcccattcctgccccgcccatctttttgtgtctcgctgtgatagatcaataaatattttattttttttggcctgg

SEQ ID NO: 8706 - DNA, 139 bp, Homo sapiens
  misc_feature 54, 92: n = A,T,C or G
gggagacaagcccagcccgcacgcgctcatctttcttcgttttttgatcagttnattcagaattgctctataatttaccaattgtatgtatntaacctattcttgtggaaaaaaaaggtctttcattatatctttattt

SEQ ID NO: 8707 - DNA, 316 bp, Homo sapiens
  misc_feature 16, 53, 196, 259, 268: n = A,T,C or G
atgtatacatctgaangaaaagcaagagctagaatatgtttacagaccaaagngtgatttcacactgtttttaaatctagcattattcattttgcttcaatcaaaagtggtttcaatattttttttagttggttagaatactttcttcatagtcacattctctcaacctataatttggaatattggtgtggtcttntgttttttctcttagtatagcatttttaaaaaaatataaaagctaccaatctttgtacaattngtaaatgtnaagaattttttttatatctgttaaataaaaattatttccaacaacctt

SEQ ID NO: 8708 - DNA, 304 bp, Homo sapiens
  misc_feature 5, 10, 34, 37, 48, 109, 139, 176, 178, 190, 236, 241, 296,303: n = A,T,C or G
tgcangtccnacactagtggatccaaagaattcnttncgagccgaagncttcgccaccatgccgccctacaccgtggtctatttcccagttcgaggccgctgggcggcnctgcgcatgttgttggcagatcagggccanagctggaaggaggaggtggtgaccgtggagacgtggnangagggctcactnaaagcctcctgcctatacgggcagctccccaagttccaggacgganacctncccctgtaccagtccaataccatcctgcgtcacctgggccgcacccttgggcctntatgggna

SEQ ID NO: 8709 - DNA, 500 bp, Homo sapiens
  misc_feature 13, 32, 43, 46, 72, 474: n = A,T,C or G
actttcttggggnaaaaaacccctggtttttngggcgcttganggnccgacactagtggatccaaagaattntgcacgagctgaaacgctctctccctaagtgatccatgtccctgcggtaataccataaccactaagctaacacactcactgtaaaagtgttgcttctccatgaagcaccaagacttgatgaccatttgcagttctcattaactccactaagaccctaaaggctaaatgacaaccaagcctctgtcactctgcctgagtggatttaccacaaatatcaaatctgttcaatctattataagagctaaaaaggagaagcacatgaaatcacatttcattcttagctcttttatcttcccatttttcatttagacattgaatacatgaaccaaagtttagttctctgtattagtcaatttgccaatagctgtcaaccctttaaaagtctttaagatgctacaaggntcccaaagctatacttctagtaatgc

SEQ ID NO: 8710 - DNA, 500 bp, Homo sapiens
  misc_feature 3, 9, 30, 252, 424, 457, 495: n = A,T,C or G
aantgcccnctagtggatccaaagaattcntttcgagggctggagcagtgcctactcaatagaatcggtcatcatgcaaataaatgccaccttagtcaaaggcaaagccggagtgcagtttggagcaaataagaatcaatataatctagcaagagcccaacaatcctataattccattgtacagatacatgagaaaaatggctggtacacccctccaaaggaagatggctaaatatgttgactgttgtatgnttggactaatgttgctttaaagaaaatctttccaacatgcagacaaaagctttgagtgcccctattacagcagtaccgaagatgttagttaatagatattttagtggataatctgtcatctgacatccagtataagttacagcctttgcattttgctcattttagatatctnggactgagcagcggggcctttactgtatttttnctgataaatacacatactggccactccttatctctttntcttg

SEQ ID NO: 8711 - DNA, 500 bp, Homo sapiens
  misc_feature 18, 22, 37, 66, 68, 92, 200, 246, 336: n = A,T,C or G
cttcttgggaaaaaaccnggtncttgggcgcttgcangtccccactagtggatccaaagaattctntncgaggttatgttgctcaaacatangtggctcctttggcaatttctatatttgtggaaatttggaaaggcagtagtttcaacatgcaagaatgtaattatattgcttcatctaataatatctcacatatctgnctatcttcagattttagattttctttattaaaaaaaccatcatggnagctccatctcgtttgtaacttctccctctcaaatactcagaagaatgaagaggccaaattcagaaaatcatggcttcactgggaaatgntttaaatctacatgtagctaggatatgtgatttcatattttttaaaaatgtggagtaaataagtgtaaaaaattaccacttgcaaagtggctttattacagcgttaaagaaaatgactagaattctgatagattgtgctgatgaacctgggtgcgggcaattga

SEQ ID NO: 8712 - DNA, 265 bp, Homo sapiens
  misc_feature 18, 39, 40, 42, 57, 106, 130, 134: n = A,T,C or G
acatggcatgttagcagntctagaatttcaggtgttggnngncatcaaatcactggngacacttcgggagaatgggatttcaaactaagaagcctttgaccactgnatactttctttcttaacctgtggntttntagcactctcttttatcacctttacagcctctctacctctcagctagcaaaagaaaaatctgcctgaggcagaaaggttttatttttcagtttttcctgccctttaaaactgtagcagaaatttattattt

SEQ ID NO: 8713 - DNA, 395 bp, Homo sapiens
  misc_feature 54, 60, 266, 267, 286, 324, 394: n = A,T,C or G
atttaaaataaaatataccatacctatatgaatttgaattagaatgttcctggngatggnaatctgatgctaaaacatcatcatcatcatcattgtcatcatcatcacttcccagactctcctctgaatcatattcggctctactttgagaagagggtagaaaaggctaaaataaagaaatcatgaaatttagcagccacatatctaatttaatacattcaaacatacagtctaatagtaataattcatctcatttgcagatactnngttataagagagttaaggnaactattatcttaccatcctatgccctttgacatcaantgatactatgccattatttattcatccattcagcaaaaatttattaagtatccactgtgcggcaagaatnc

SEQ ID NO: 8714 - DNA, 422 bp, Homo sapiens
  misc_feature 1, 21, 26, 43, 56, 67, 70, 94, 120: n = A,T,C or G
ntttggaacaaaaacccaggnttttngggcgcttgcaggtccnacactagtggatncaaagaattcnttncgagtccatgcccatccgaaaggntgatgaagttcaggttgtaccgtggncactataaaggtcatgcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcagggaataaagtaatcttatatacaagctttgattaaaacttgaaacatag

SEQ ID NO: 8715 - DNA, 382 bp, Homo sapiens
  misc_feature 32, 37, 41, 65, 68, 238, 306: n = A,T,C or G
ctttggaaaaaaaacccaggttttcgggcgcntgcangtcnacactagtggatccaaagaattcnttncgagcagaggtgcggggcgctgagattgagtacgccatggcctactctaaagccgcatttgaaagggaaagtgatgtccctctgaaaactgaggaatttgaagtgaccaaaacagcagtggctcacaggcccggggcattcaaagctgagctgtccaagctggtgatcgnggccaaggcatcgcgcactgagctgtgaccagcagccctgttgcgggtggcaccttctcatctccggngaagctgaaggggcctgtggccctgaaagggccaacacatcactggttttctaggagggactcttaagttttctac

SEQ ID NO: 8716 - DNA, 401 bp, Homo sapiens
  misc_feature 13, 41, 42, 146, 147, 376, 390: n = A,T,C or G
cgggcgcctgcangtccacactagtggatccaaagaattcnnttcgaggatgcctgtgacactttggcgttgccgagttagtcaacaattattctgggaaaaagcagaattgaattcttctctagatgtcctaccagggttggccnngggccacaaagcaggctaataaattcccacaggatccagacaccaggcaaaattgctctaagaagccagttactgtcatccctctatggttctagaaaaaatagtacaaaaatgacaggtcatcctatgagcgtcatgccaatgaaaccccatcttctggagaagcccttgaatcagaattatcttttttcttgatgtcgtcagatgcagccagtttcttaattttttnaaaaactgtatgtntctgtggtatg

SEQ ID NO: 8717 - DNA, 445 bp, Homo sapiens
  misc_feature 2, 4, 30, 53, 62, 109, 329, 367, 397: n = A,T,C or G
gncnacactagtggatccaaagaattcttnacgaggtcccgcccttgtgtganatgggccangatccttcggcaaggggcgcctggggctggggctgattgtgggcggnggagcgccagacagaaaaggattccaatgagaacttcaggttaaagtcagatgccacctaccagggtctacagtcaaaatgttggctttttcttattttttaatgtatgggagaaaaatgtaaaattccagttcttttctaattgtgtttctgaaattaggagtcagctgccagcgtttttgtgtggctgcagtgtgcctgggcccagctcacgggcagngggtggacctaactgcccaggcaggcgagagctacttncagagccttccagtgcatgggagggcaggnctaggtgtagcggtgtctcctctttgaaattaagaactatctttcttg

SEQ ID NO: 8718 - DNA, 417 bp, Homo sapiens
  misc_feature 204: n = A,T,C or G
gaaactgttacaatacattgcaatcattcatttgaataaagcattcctattttccttctcaacaccgtcacagcttggatgggcaatgaactggccaactgaaatatggaaagttctgcctttgtatacaatatatttgtaattctaagaacctactcaaaatttattacatttatgcgacctcaaaatgaggaaggattttgncttagtccattttgtgttgatataaaggaatacttgaggctgggtaatttataaataaaagaggtttatttggctcacagttctgcaggctgtacaagaagcatggagccagcatctgctgtgagggcctcaactgtttccactcatggcagaagaggaaggggaatcaagcatgtgcagagatcacatgataagatgggaagtgagagagag

SEQ ID NO: 8719 - DNA, 216 bp, Homo sapiens
  misc_feature 37, 149, 152, 206, 209: n = A,T,C or G
gccgcgccgccatcatggacaccagccgtgtgcagcnctatcaagctggccagggtcaccaaggtcctgggcaggaccggttctcagggacagtgcacgcaggtgcgcgtggaattcatggacgacacgagccgatccatcattccganatntaaaaggccccgtgcccgagggcgacgtgctcacccttttggagtcaaagcganaancccggga

SEQ ID NO: 8720 - DNA, 285 bp, Homo sapiens
  misc_feature 40, 41, 67, 195, 209, 284: n = A,T,C or G
gggcgcttgcaggtccacactagtggatccaaagaattcnnttcgagattaccctctataatatggntgggccttagccaatcagttaaaggccttaagagagaaaagactgacgtcccctgaagaagaaagaactgtctccagactgccttgggacttgagctgcaacaactcttccctgggcctgcagcctgntggcctgccctgcngaatttggacttgccagccaccagcccacacaagcatgtaaccaattccttaaaataaaatcaatgtgtatcatnt

SEQ ID NO: 8721 - DNA, 498 bp, Homo sapiens
  misc_feature 7, 16, 33, 35, 40, 53, 64, 67, 91, 122, 184, 221, 482: n = A,T,C or G
tgggaanaaaaacccnggttttcgggcgcttgnangtccnacactagtggatncaaagaattcnttncgagccagttggaaagaagacagntgagcacttcaggatggtttttaaatttggnatgagattctctgccaacaccaagctctgagttaactgtgctttcttctcctggccctgacngagcactacagcatcaaagtaaatctttggggacagngtagcccatctgcatcctatttaatttcttcccttctccccaccagtgttgtcacagggctatgttgcttaaaggtagtctggctgctgaatccctttctcagctcagagcagttttaagatttaattgggaatacagagaaacaggattgtttgagaaccaaaatcaagaggaacagaaatcttaacttgatttcatgtgttagaacattgtaccatgcctcttctgtatctgtggaagtttcctgtttgacacagggantctaggaggggcgggg

SEQ ID NO: 8722 - DNA, 405 bp, Homo sapiens
  misc_feature 7, 19, 69, 85, 299: n = A,T,C or G
ctttagngtgctatacctntgtgtcttatcgtgggccactgtgccaataaacaaaaacaactgtttggnttacctcagttgcagnagttattttcatttagaagttgttctcagattattgtttcagttatatagaggattactagactagttatgaagaaaccccactacattcaatggaattggggcttaaaatctcatcgatgtgctgtctctggagtgataagaaagggctacatctcccgaaatgatttctttacgtcatgtattggtttccttcttcaccttgaacttttgtngaactgtatgtactttaccccaaacctgttaatattttgagcgcttctatgtgaaagcaaagaaataattttaatactctggcattcataaattttattgatgaga

SEQ ID NO: 8723 - DNA, 495 bp, Homo sapiens
  misc_feature 10, 27, 37, 41, 67, 247: n = A,T,C or G
cttggggaanaaaacccctggtttttngggcgcttgnaggnccgacactagtggatccaaagaattntttacgaggagaagtcgcaaatcttgcgacctctagccacatgattcctgagcagtaagggattatagaatcttcacttacgttttagcagaattcaggctcttcccatgatcctaatcttgtggcctttcattagttttacaaaggcagcttcagcccctgaaaaaggaggggagcagntttagggaggggctgttattatccctgtttcaaagttaaattacaaactaaattcctcccatcgttagcttggcctacacctaggaatgagtgaagacagccagcctgtgaggctagaagcaagatggagtcagccatgctagacttttctgcctgtcttaatctttgcaaagacagtttcaatgagagtgtgaaagctgcatttcggtaatccagggtatggagaacatgttaaacagttagtcttg

SEQ ID NO: 8724 - DNA, 324 bp, Homo sapiens
  misc_feature 11, 31, 41, 202, 248, 312: n = A,T,C or G
cgggcgcttgnaggtccgacactagtggatncaaagaattntttacgagacattgcccaccccaagcttgggaagcgtgctcgtgcccgtattgccaaggggctcaggctgtgccggccaaaggccaaggccaaggccaaggccaaggccaaggatcaaaccaaggcccaggctgcagccccagctttcagttccagcttanggctcccaaacgtacccaggcccctacaaaggcttaagagtagatntctctgccaacatgaggacagaaggactggggcgacccccccaccccccgcccctgggctacantttgcatggggc

SEQ ID NO: 8725 - DNA, 500 bp, Homo sapiens
  misc_feature 15, 56, 62, 135, 220, 240, 305, 312, 316, 356, 357, 490: n = A,T,C or G
ggggaacaaaacccnggttttggggcgcttgaggtcgacactagtggatccaaagnaattcnttacgagaaactggggaaacaaaggatatatcctcatggctcgaaataagaacaacgcctgtggctttgccgncctggccagcttccccaagatgtgactccagccagccaaatccatcctgctcttccatttcttccacgatggggcaggtgtaacnatgcactttggaagggagtnggggtgctatttttgaagcagaggtggggatactgagattgtctgttcagtttccccatttgttngtgcttnaaangatccttcctactttgcttctctccacccatgaccttttnnactgtggccatcaggactttccctgacagctgggtactcttaaggctaagagatgagactacggcctgcccctgactgtgttgtcccagggctgatgctgtacaggtacaggctggagattttcacataggtnagattctcat

SEQ ID NO: 8726 - DNA, 104 bp, Homo sapiens
  misc_feature 7, 78: n = A,T,C or G
ctggagnctcgcgcgcctgcaggtcgacactagtggatccaaaaaattcggcacgagggagctgcggagccgcctggnctcccgcgtccatcggtccattcctg

SEQ ID NO: 8727 - DNA, 281 bp, Homo sapiens
ttccaggtcgacactagtggatccaaagaattcggcacgaggcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaac

SEQ ID NO: 8728 - DNA, 292 bp, Homo sapiens
gctggagctcgcgcgcctgcaggtcgacactagtggatccaaagaattcggcacgagggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaaccct

SEQ ID NO: 8729 - DNA, 140 bp, Homo sapiens
  misc_feature 2, 8, 28: n = A,T,C or G
tncagtgngacactagtggatccaaagnaattcggcacgagcttgaacaccaccactgaagagtttcatatacaccaaataatgtctcatctctatagtacagggaatataaaattggtttcctgtggtcatgatcaaga

SEQ ID NO: 8730 - DNA, 123 bp, Homo sapiens
  misc_feature 45, 62, 121: n = A,T,C or G
ctggagcctcgcgcgcctgcaggtcgacactagtggatccaaagnaattcggcacgaggccngctgacggacaactgagtctccggcccacctaccaccgccgcccgggtcccccaggtgngc

SEQ ID NO: 8731 - DNA, 132 bp, Homo sapiens
  misc_feature 10, 24: n = A,T,C or G
ctgggacgcnagtggatccaaagnaattcggcacgagcttagcacagttcctggtgctcaaagagttccaacacctgaaagcaccatggccctgtttgtttttcagtcaagatttctaaaagccgttattac

SEQ ID NO: 8732 - DNA, 171 bp, Homo sapiens
  misc_feature 2, 13, 112, 156: n = A,T,C or G
antggagtctgtnttacaattaactgggacactagtggatccaaagaattcggcacgagggccgcagaccccgtctgggaggtgaggagcatctctgcccggccgccccgtntgagaagtgaggagaccctccgcctggcaaccgccccgtctganaagtgaggagcccct

SEQ ID NO: 8733 - DNA, 102 bp, Homo sapiens
  misc_feature 6, 39, 45, 90: n = A,T,C or G
ctggangctcgcgcgcctgcaggtcgacactagtggatncaaagnaattaacccatcgttgagtcaaatttacccaattttattcaatangtcaatatcatg

SEQ ID NO: 8734 - DNA, 277 bp, Homo sapiens
  misc_feature 4, 8: n = A,T,C or G
gtgngacnctagtggatccaaagaattcggcacgagctcgtgccgaattcggcacgagcaagagcagtagccctgtcagagcctcggagcaatacctttctgtacccgtggtgagacaagacccagagctactggaaaacaagcactttggaagatttgttttgttttcatggaataataatatgtcagggtataatttaacgtgagtttcttatgtgcccttaaagactgttagacaagaaaagcattcactggctaataatccataggtcgacct

SEQ ID NO: 8735 - DNA, 397 bp, Homo sapiens
agctggagctcgcgcgcctgcaggtcgacactagtggatccaaagaattcggcacgagagaaatccttgaaatgccatagtttctggcagcatgattccaatctctgactctgtcttcaaatggctgtcttccttctctgtgtgtgtgtatctgtatctctgttgtgtcttcttttaaggatgtcagtcactggatgatggcctagccaattccggcatgacctcgtctttactagttacatctgcacagaccgtattttcaaacaatgtcacattccaagtttctaggtaggtatgaatattttggagggcattattctacccagtaaagattattttcaatattgttataagttcattgagaatagggaccgtgcatttctgctcattcttgcat

SEQ ID NO: 8736 - DNA, 360 bp, Homo sapiens
ctggaacctcgcgcgcctgcaggtcgacactagtggatccaaagaattcggcacgagcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaacccccccaaaagccaaaaaatgggagacaatttcacatggactttggaaaatatttttttcctttgcattcatctctcaaacttagtttttatctttgaccaaccgaacatgaccaaaaaccaaaagtgcattcaaccttac

SEQ ID NO: 8737 - DNA, 242 bp, Homo sapiens
  misc_feature 21: n = A,T,C or G
aagctggagctcgcgcgcctncaggtcgacactagtggatccaaagaattcggcacgagggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataa

SEQ ID NO: 8738 - DNA, 280 bp, Homo sapiens
tgcaggtcgacactagtggatccaaagaattcggcacgagcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcagctcctttaacgctaatatttccggcaaaatcccatgcttgggttttgtctttaaccttgtaacgcttgcaatcccaataaagcat

SEQ ID NO: 8739 - DNA, 164 bp, Homo sapiens
  misc_feature 6, 45: n = A,T,C or G
tctggngctcgcgccgcctgcaggtcgacactagtggatccaaanaattcggcacgagggaggactgtgagaattgttgctctggatcgaagttttcacattggctgttacaagtgcgaggagtgtgggctgctgctctcctctgagggcgagtgtcagggctg

SEQ ID NO: 8740 - DNA, 400 bp, Homo sapiens
  misc_feature 88, 205, 337: n = A,T,C or G
gaacaataagctggagctcgcgcgcctgcaggtcgacactagtggatccaaagaattcggcacgagctcgtgccgaattcggcacganaaaaaaacaaaaatctgatatttatttcaaaacgtattgaagcaacaaaatattaatattgtgccatatgacaacaaagtctttcctaaatactccatctgtttagtactgtattgnggaatattttgagttctatttccatacttgaaaacatggaggattttagagatgcctgaacaatattatttaagtagtatgtgaccgagctataaatttttgtttttgttctaagtagatttaatttggganctgacaggacaatgtttttaggtttagcattttgtttaaaaacctttaaagaaacctttagaa

SEQ ID NO: 8741 - DNA, 328 bp, Homo sapiens
  misc_feature 2, 247, 288: n = A,T,C or G
ancgaacaataagctggagcctcgcgcgcctgcaggtcgacactagtggatccaaagaattcggcacgagcaacaccaccttcttcgaccccgccggaggaggagaccccattctataccaacacctattctgatttttcggtcaccctgaagtttatattcttatcctaccaggcttcggaataatctcccatattgtaacttactactccggaaaaaaagaaccatttggatacataggtatggnctgagctatgatatcaattggcttcctagggtttatcgggngagcacaccatatatttacagtaggaatagacgtagacac

SEQ ID NO: 8742 - DNA, 396 bp, Homo sapiens
  misc_feature 3, 9, 223, 232, 326, 328, 339, 343, 374: n = A,T,C or G
tantctggngcctcgcgcgcctgcaggtcgacactagtggatccaaagaattcggcacgagtaaaactgaactgcaatttttaagtacttaaaatattagatacagagtaatatacacacatgtaatcaacaaatattaatatatttaccagttagaattaataaatgatttacattggcttcaagtcttgttttatgtattaaaaaaaaaaagaagaaaaangactgggcncaatggcttatgcttataatccgaacactttgggaggctgaggcaggaggatcacttaaggccaggagttcgagaccagcctgggcaacatagngngaggccatctntacncaaagaaaacaaattagccagggggggtagncctagtttctcccgagactgaa

SEQ ID NO: 8743 - DNA, 400 bp, Homo sapiens
  misc_feature 16: n = A,T,C or G
gaacaataatgtctgnagctcgcgcgcctgcaggttcgacactagtggatccaaagaattcggcacgagtagacccgtccggtcgcagactgtctccgagacgcttcctgtccgaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttc

SEQ ID NO: 8744 - DNA, 400 bp, Homo sapiens
  misc_feature 6, 221, 223, 298, 370, 388: n = A,T,C or G
gacaanaagctggagctcgcgcgcctgcaggtcgacactagtggatccaaagaattcggcacgagattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttncnagaactaccactggcaataaagtttttggtgccctgaagggagctgtggatggaggcttgtctatccctcacagnaccaaacgattccctggttatgattctgaaagcaaggaatttaatgcagaagtacatcgggaagcacatcantgggccagaatgttgcangattacatgcgc

SEQ ID NO: 8745 - DNA, 284 bp, Homo sapiens
gaacaataagctggagctcgcgcgcctgcaggtcgacactagtggatccaaagaattcggcacgagattgtatctttgctagtcaacaacttatgaaatatactcaatgcgtctgatgtgtcattaagtgcagaaataactaagacacaaataacctttgcaaaccttcaagctgtgtaatattccaatgttgtttttttctttgtatatatacttatatcacgtaggatgtaaaaccagtatgaccttgtctagtctccaaacttaaaataaacttttgaaaa

SEQ ID NO: 8746 - DNA, 338 bp, Homo sapiens
  misc_feature 3, 308, 330: n = A,T,C or G
ganaataagctggagctcgcgcgcctgcaggtcgacactagtggatccaaagaattcggcacgagaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaactnggttctgcttcaataaatcttnggaaaaac

SEQ ID NO: 8747 - DNA, 400 bp, Homo sapiens
  misc_feature 2, 3: n = A,T,C or G
tnngctggagctcgcgcgccctgcaggtcgacactagtggatccaaagaattcggcacgagctcgtgccgaattcggcacgagggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaaga

SEQ ID NO: 8748 - DNA, 400 bp, Homo sapiens
gaacaataagctggagctcgcgcgcctgcaggtcgacactagtggatccaaagaattcggcacgagcggcacgagccaccctgcacctggtgctccgtctcagaggtgggatgcaaatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagcttggaagatggacgcaccctgtctgactacaacatccagaaagagtccactctgcacttggtcctgcgcttgagggggggggtgtcctaaagtttccccttttaaggtttcaacaaatttcattgcactttcctttcaataa

SEQ ID NO: 8749 - DNA, 400 bp, Homo sapiens
  misc_feature 376: n = A,T,C or G
gctggagctcgcgcgccctgcaggtcgacactagtggatccaaagaattcggcacgagctcgtgccgaattcggcacgagtgataatttactgtcaacagacctactctaaaagaagtgctaaaagaaattctttagacagaaggaaaatgataccacaaggaaatgtggaagattaagaatgaagaaagagcaacagaaatgttaaatatctggttaagtataatagacaaatctcctcttgaggtctttaaaatatgtgtgacaaccaaaagcaaaagttacaacaatatctgatgaggtttttattgtatgtaaatgtattaagataagacgactatgacatagattgtggaaaataaagagatgcatatggnggcaagattctacatttcactttg

SEQ ID NO: 8750 - DNA, 208 bp, Homo sapiens
  misc_feature 3: n = A,T,C or G
ganaataagctggagctcgcgcgcctgcaggtcgacactagtggatccaaagaattcggcacgagtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgc

SEQ ID NO: 8751 - DNA, 400 bp, Homo sapiens
  misc_feature 29, 163, 164, 170, 349: n = A,T,C or G
gacaataagctggagcctcgcgcgcctgnaggtcgacactagtggatccaaagaattcggcacgaggggatgtctgcctggccttattttatttatggaccatcccaaccctccagtcgtccactccgctttgcttgctcttcgatacttggcagaatgccgnncaaacnagagaaaagatgaaaggagaactgggtatgatgttgagcttacaaaatgttatacagaagtaagtacaatagacagtgtctcatttatttatatacttacttatattacttacttacagggcctcactatgttgcccatgctgggttcaagcgatccttccaccttggctttccaaagngctggaattataggcaatttttttattgaaatactgaaaggcaatttcagg

SEQ ID NO: 8752 - DNA, 236 bp, Homo sapiens
  misc_feature 6, 7, 113, 143, 149, 186, 195, 220: n = A,T,C or G
tctggnncctcgcgccgcctgcaggtcgacactagtggatccaaagaattcggcacgagctcgtgccgaattcggcacgagtatgaactcctttttaaggagggagtcatggnggccaagaaggatgtccacatgcctaagcncccggngctggcgggacaagaatgtgcccaaccttcatgtcantgaaggccntgcggtctctcaagtcccgaggctncgtgagggaacagttt

SEQ ID NO: 8753 - DNA, 159 bp, Homo sapiens
cgacaaaagctggagctcgcgcgcctgcaggtcgacactagtggatccaaagaattcggcacgagataaaatgaaatatatgtttcattttagagaaataactattactttagatctttccaaatctgaggaaagggaggcctagcatgtgttccaagg

SEQ ID NO: 8754 - DNA, 400 bp, Homo sapiens
  misc_feature 8: n = A,T,C or G
gaacaatntgctggagctcgcgcgcctgcaggtcgacactagtggatccaaagaattcggcacgagcggcacgagccgtcatggggggcggagacctgaatctgaagaagagctggcacccgcagaccctcaggaatgtggagaaagtgtggaaggccgagcagaagcatgaggctgagcggaagaagattgaggagcttcagcgggagctgcgagaagagagagcccgggaagagatgcagcgctatgcggaggatgttggggccgtcaagaaaaaagaagaaaagttggactggatgtaccagggtcctggtgggatggtgaaccgtgacgagtacctgctggggcgccccattgacaaatatgtttttgagaagatggaggagaaaggaggcaggct

SEQ ID NO: 8755 - DNA, 400 bp, Homo sapiens
  misc_feature 4: n = A,T,C or G
aacnaacaatattgcctggagcctcgcgcgccctgcaggtcgacactagtggatccaaagaattcggcacgagtgcacatctctgccttgcatctttgttaatgctgtgttctcttcaatcccacaagcttctcttgatccattgatagtgaatattgttcacctctgtaagctggcaatgctttctctttccctggtatgcttgccagtattattcatgtggaaagctcagttacagtgtaagcttccgaagacaaggactgtatcttataatagtggctactgactgagctctttctatgggccagactaccacacaaggttatgcatgttgtgccgatgttcagctgtaggtggggcgatactcaaatcgtagcctaggctgctagtctttacatgc

SEQ ID NO: 8756 - DNA, 340 bp, Homo sapiens
  misc_feature 249, 273, 283, 318, 323: n = A,T,C or G
attctggaagctccgcgcgccctgcaggtcgacactagtggatccaaagtaattcggcacgagggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttttcttgtntataaagcatttaacccccctgtncacaactcantccttttaaagaaaaaaattgaaatgtaaggctgngtaanatttgtttttaaactgt

SEQ ID NO: 8757 - DNA, 307 bp, Homo sapiens
gctggagctcgcgcgcctgcaggtcgacactagtggatccaaagaattcggcacgagaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttctttaaaaaaaaaaaaaaaaa

SEQ ID NO: 8758 - DNA, 155 bp, Homo sapiens
  misc_feature 2, 6, 96, 152: n = A,T,C or G
gngacnctagtggatccaaagaattcggcacgagacaattgattcaaaagtgtcgttattagctaattttgaaatttttatgctattttcttttgnttatatttaaatataaataaaatattttaataatactgacttttctcacacaattnatg

SEQ ID NO: 8759 - DNA, 400 bp, Homo sapiens
  misc_feature 350: n = A,T,C or G
gaacaaaagctggagctcgcgcgcctgcaggtcgacactagtggatccaaagaattcggcacgagtgaggttctaccactctggaaaattcatgcctgcaggtttaattgcaggtgccagtttgctgatggtcgccaaagttggagttagtatgttcaacagaccccattagcagaagtcatgttccagcttagactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggnggcgagtatgtaacacaagagcttaataagaccctcatagagcttgattc

SEQ ID NO: 8760 - DNA, 167 bp, Homo sapiens
  misc_feature 67, 79, 95, 123, 148, 166: n = A,T,C or G
ctggggcctcgcgcgcctgcaggtcgacactagtggatccaaagaattcggcacgagctcgtgccgnattcggcacgangcccagaagatgcagntgggctttcggctccagcagattgcagnctgctggggcacccttggtcccagntctttaggaacccagganc

SEQ ID NO: 8761 - DNA, 327 bp, Homo sapiens
  misc_feature 252, 285: n = A,T,C or G
ctggagctcgcgcgcctgcaggtcgacactagtggatccaaagaattcggcacgaggccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatcttgatgaagcgaattcagagnaggcccagtaagaggtatctccatcaagctgcnggaggaggagagagaaaggagagacaattatgttccctgagg

SEQ ID NO: 8762 - DNA, 171 bp, Homo sapiens
  misc_feature 8: n = A,T,C or G
gaacaatnagctggagctcgcgcgcctgcaggtcgacactagtggatccaaagaattcggcacgagggtacgagatctagcctgccctgcctgcctgccctgggcgatgaggtacggtggggaaggtgcctattttagagaactttgtcacagtattaaagttcccagaac

SEQ ID NO: 8763 - DNA, 352 bp, Homo sapiens
  misc_feature 22, 128, 282, 292, 299, 324, 336, 339: n = A,T,C or G
gacaaaagctggagctcgcgcncctgcggtcgacactagtggatccaaagaattcggcacgagctcgtgccgaattcggcacgagaaatctcggcgactcggccccgtctcctgagggtcctgctggngaccggcctggaccttggccctacagccctggaggccgctgctgaccagcactgaccccgacctcagagagtactcgcaggggccctgggctgcactcaagaccctcgagattaacggggctaaccccgtctgctccttccctcccgcagaggnctggggcctnggactgnacatgagagcccctttggggccccnagaggggctggngtncttactagaaaca

SEQ ID NO: 8764 - DNA, 400 bp, Homo sapiens
  misc_feature 10: n = A,T,C or G
aacgacaaangctggagctcgcgcgcctgcaggtcgacactagtggatccaaagaattcggcacgagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaaagaatgccaaaatcagcagtctcctggagga

SEQ ID NO: 8765 - DNA, 230 bp, Homo sapiens
  misc_feature 192, 203: n = A,T,C or G
gaaaatgctggagctcgcgcgcctgcaggtcgacactagtggatccaaagaattcggcacgagctcgtgccgaattcggcacgagttgcttaggtgaggcgcagacggggaagcggagccaacatgccagtggcccgggagctgggtttgtcgaaaaacttatgtgaccccgcggaggaccctttcgagaantctcgtctcgnccaagaacctgaagctgatcggcgagt

SEQ ID NO: 8766 - DNA, 400 bp, Homo sapiens
gaacaataagctggagctcgcgcgcctgcaggtcgacactagtggatccaaagttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttatttg

SEQ ID NO: 8767 - DNA, 182 bp, Homo sapiens
  misc_feature 7: n = A,T,C or G
tctgggnctcgcgcgcctgcaggtcgacactagtggatccaaagaattcggcacgagctcgtgccgctcgtgccgaattcggcacgaggttggatcaagtttaaatgactgtgctgcccctttcacatcaaagaactactgacaacgaaggccgcgcctgcctttcccatctgtctatctat

SEQ ID NO: 8768 - DNA, 400 bp, Homo sapiens
gaacaataagctggagctcgcgcgcctgcaggtcgacactagtggatccaaagaattcggcacgagagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaagaccaagcgtaccatccagtttgtgggattggtgccccactggcttcaaggttggcatcaactaccagcctcccactgtggtgcctggtggagacctggccaaggtacagagagctgtgtgcatgctgagcaacaccacagccattgctgaggcctgggctc

SEQ ID NO: 8769 - DNA, 400 bp, Homo sapiens
  misc_feature 15, 26, 32, 35: n = A,T,C or G
cgaccataatgctgnagcctgtgtgncccttnagntgggacactagtggatccaaagaattcggcacgagtaaaggagagaaagacttagaacatacacagatcctaagtagaaccaggtaattgtctctttttctaataaggaatttgggtaatttttaattttttgttttttaaaaaataacctagactatgcaaaacatcagagtgaattttccatgaatgtttttaatattctcatctcaacattgtgatatatgctactaaaaaccttttcatatacatcttacctcatttcaagtgaattattttaatcttttcctctctttccaaaaatttacaggaatgtttagtgtaattggatttcgctatcagttcccatccttaagttttgatattca

SEQ ID NO: 8770 - DNA, 400 bp, Homo sapiens
  misc_feature 367: n = A,T,C or G
gaacaataatgctggagctcgcgcgcctgcaggtcgacactagtggatccaaagaattcggcacgagtgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagagatccccgaggggaatgagaaagccctgaagaggggcagnggccccgagtgggaccctgtctctgtggccatt

SEQ ID NO: 8771 - DNA, 302 bp, Homo sapiens
gaaaataagctggagctcgcgcgcctgcaggtcgacactagtggatccaaagaattcggcacgagccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggccccccctgaaccgcaccccatcccaccagc

SEQ ID NO: 8772 - DNA, 400 bp, Homo sapiens
  misc_feature 3: n = A,T,C or G
ganaataagctggagctcgcgcgcctgcaggtcgacactagtggatccaaagaattcggcacgaggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattcta

SEQ ID NO: 8773 - DNA, 400 bp, Homo sapiens
  misc_feature 3, 6: n = A,T,C or G
ganaanagctggagctcgcgcgcctgcaggtcgacactagtggatccaaagaattcggcacgagggagagcagagcgcggcggctggaagctgctaagtcagagccgcgatgttccggattgagggcctcgcgccgaagctggacccggaggagatgaaacggaagatgcgcgaggatgtgatctcctccatacggaactttctcatctacgtggccctcctgcgagtcactccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaag

SEQ ID NO: 8774 - DNA, 306 bp, Homo sapiens
gacaataagctggagctcgcgcgcctgcaggtcgacactagtggatccaaagaattcggcacgagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattaggtgaagttcgcaactaaactaaacctgtaaaattatgatgattgtattcaaaagattaatgaaaaataaacatttctgtccccctg

SEQ ID NO: 8775 - DNA, 303 bp, Homo sapiens
  misc_feature 10: n = A,T,C or G
aacgaacaantagctggagctcgcgcgcctgcaggtcgacactagtggatccaaagaattcggcacgagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagacttattgcggcctggtttctctgttacaataaaattactgtag

SEQ ID NO: 8776 - DNA, 397 bp, Homo sapiens
  misc_feature 102, 325, 359, 371, 389: n = A,T,C or G
gaacaataagctggagctcgcgcgcctgcaggtcgacactagtggatccaaagaattcggcacgaggcccgcgggggcagagcggggggccgtgcccttgcnaccggagggccggccagcaccccctcgcctgccgaggtcgcgggagcccagttaaaggaggcggtgtgtaagatgtgcaatgttcctgcatgggggttttgtagactttcatagccaaagaaaccggtttcgggtttctttaaaatccccgacgactcacctgattaacctgctgcagttctgaccctgccaaggtaactggtccaaattccttatcatcaanatctggagacagacatttgcatctggggcatttntttatttgcagnccctggttgaaatctaanattgctac

SEQ ID NO: 8777 - DNA, 400 bp, Homo sapiens
  misc_feature 384: n = A,T,C or G
gaacaataagctggagctcgcgcgcctgcaggtcgacactagtggatccaaagaattcggcacgagtgcccttgagactgcagactttcatctacaacagtggttaatgtaaaagagtagttatggtgtaaactggtgaatttcttcttccctttgtatttctaattgacctttcctccctgtaaagaaaagaattttcaagcaggtaggatatcctctcttcttctgtacatgtgctatgttgctagtcggaactttccattataaagtttcctgtcagcttttcacctaatggttttggggtagtattgatgattattcctcaaatccgttgtttaagagctgtataatggtgatattattccttctgtacttatttttttngagacagagtctcact

SEQ ID NO: 8778 - DNA, 400 bp, Homo sapiens
  misc_feature 24, 26, 31, 33, 35, 42: n = A,T,C or G
cgcccataatacgtgaagtctgtntnacaantnangcgtggnacgtctagtggatccaaagaattcggcacgaggatgaatctgaggcagcccccatgtggattctgtgctattcgtgctgtttatcttttaaaaatagggcagtggttacacagctgaggccctgagcctgcccagctccctgcacgaccctgcccgctccaaggctgatagcacttccttcctggcctcgcgtggcttcctgcacctggccttatcgccacacaaaacttgacactgtactggaatgcgctcagggtctgtaaatggaaatctcttgctttctacatttacaaacaactgtcatctataaaatgctttctttatttccagacttacactttctttacactagttggaa

SEQ ID NO: 8779 - DNA, 281 bp, Homo sapiens
  misc_feature 213: n = A,T,C or G
ctggggctcgcgcgcctgcaggtcgacactagtggatccaaagaattcggcacgaggtttattttatatttgaataagagtcaagactttaccttattgaaaattatcttttaacaggggaaacaattgtagaagcaagagaaatacaaaaccacatatatagtgggcaataaaggattatagaattatatgctttgaaaatcttagttttgntgcctcctctgtacctggaaacatgaacaataatttggttgtgaaagttctaaaaaaaaaaaaaaaaa

SEQ ID NO: 8780 - DNA, 399 bp, Homo sapiens
  misc_feature 8, 57: n = A,T,C or G
aaaacganatagtctggggctcgcgcgcctgcaggtcgacactagtggatccaaagnaattcggcacgagtgatcctgtgaccagaactgaaatattcagaagcggaaatggcactgatgaaacattggaagtgcacgactttaaaaacggatacactggcatctacttcgtgggtcttcaaaaatgttttatcaaaactcagattaaagtgattcctgaattttctgaaccagaagaggaaatagatgagaatgaagaaattaccacaactttctttgaacagtcagtgatttgggtcccagcagaaaagcctattgaaaaccgagattttcttaaaaattccaaaattctggagatttgtgataacgtgaccatgtattggatcaatcccactctaa

SEQ ID NO: 8781 - DNA, 242 bp, Homo sapiens
  misc_feature 3: n = A,T,C or G
ganaataagctggagctcgcgcgcctgcaggtcgacactagtggatccaaagaattcggcacgagctagtctgtcctgcgtcctctgtccccgggtttcagagacaacttcccaaagcacaaagcagtttttccccctaggggtgggaggaagcaaaagactctgtacctattttgtatgtgtataataatttgagatgtttttaattattttgattgctggaataaagcatgtggaaatga

SEQ ID NO: 8782 - DNA, 400 bp, Homo sapiens
gaacaataagctggagctcgcgcgcctgcaggtcgacactagtggatccaaagaattcggcacgagcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacct

SEQ ID NO: 8783 - DNA, 400 bp, Homo sapiens
accgacaataagctggagctcgcgcgcctgcaggtcgacactagtggatccaaagaattcggcacgagaatttttccaggaaggtttgagggcgaattccgtgagaagtttttcaccagggatctcaggtactgtcattcctctggacaggaattgagtaggtgctgagatactcaccagttaattgcctttgggttagtggaagaagtaagtcacctagccagatcttatgcatttgcacaagtagagaatggaaacttccaatctgagtgagtttaattaaagattctagaatatttttaaaacagttcacactaattacttttagtttagggaataactcaaagttgggttaattgtgttgtcagttagtgaaaaccaacaactgacttgagaatgg

SEQ ID NO: 8784 - DNA, 241 bp, Homo sapiens
  misc_feature 8, 13, 58, 118, 124, 181: n = A,T,C or G
aaaacganattantctggagctcgcgcgcctgcaggtcgacactagtggatccaaagnaattcggcacgagtgccgccatcttggttccgcgttccctgcacaaaatgcccggcgaanccacanaaaccgtccctgctacagagcaggagttgccgcagccccaggctgagacagggtctnggaacagaatctgacagtgatgaatcagtaccagagcttgaagaacaggattccacccag

SEQ ID NO: 8785 - DNA, 399 bp, Homo sapiens
  misc_feature 5, 38, 41, 391: n = A,T,C or G
aaccntaatatgtgaagtctgtattaccatttactggnacnctagtggatccaaagaattcggcacgagtgatggtcctgctggtgctcctggtactcccgggcctcaaggtattgctggacagcgtggtgtggtcggcctgcctggtcagagaggagagagaggcttccctggtcttcctggcccctctggtgaacctggcaaacaaggtccctctggagcaagtggtgaacgtggtccccctggtcccatgggcccccctggattggctggaccccctggtgaatctggacgtgagggggctcctggtgccgaaggttcccctggacgagacggttctcctggcgccaagggtgaccgtggtgagaccggccccgctggaccccctggngctcctgg

SEQ ID NO: 8786 - DNA, 184 bp, Homo sapiens
  misc_feature 18, 155, 178: n = A,T,C or G
gacaaaagctggagctcncgcgcctgcaggtcgacactagtggatccaaagaattcggcacgagcggcacgagagtacttctagagcggccgcgggcccatcgattttccacccgggtggggtaccaggtaagtgtacccaattcgccctatagngagtcgtattacaattcactggnccgtaa

SEQ ID NO: 8787 - DNA, 321 bp, Homo sapiens
  misc_feature 165, 266, 271, 310: n = A,T,C or G
tctggggctcgcgcgcctgcaggtcgacactagtggatccaaagaaattcggcacgagctcgtgccgaattcggcacgagcgagaatgaagactattctcagcaatcagactgtcgacattccagaaaatgtcgacattactctgaagggacgcacagttatcgngaagggccccagaggaaccctgcggagggacttcaatcacatcaatgtagaactcagccttcttggaaagaaaaaaaagaggctccgggttgacaaatggnggggnaacagaaaggaactggctaccgttcggactatttgtagncatgtacagaa

SEQ ID NO: 8788 - DNA, 355 bp, Homo sapiens
  misc_feature 248, 333, 336, 339: n = A,T,C or G
acgaaaataagctggagctcgcgcgcctgcaggtcgacactagtggatccaaagaattcggcacgagggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagcttgctgcttggggtcaagggacacgcctttntgaacgtccccctgcccctttacggacacccccctcgcttggacggctgggcacacgcctcccactggggtccagggagcaggcnggnggncacccacccttgggac

SEQ ID NO: 8789 - DNA, 400 bp, Homo sapiens
  misc_feature 13, 16: n = A,T,C or G
aaaaacgaaacantanctggggctcgcgcgcctgcaggtcgacactagtggatccaaagtaattcggcacgagctcgtgccgaattcggcacgaggaatgacattgccatcaacgaactcatgaaaagatactgtcctaattccgtattggtcatcattgatgtgaagccgaaggacctagggctgcctacagaagcgtacatttcagtggaagaagtccatgatgatggaactccaacctcgaaaacatttgaacacgtgaccagtgaaattggagcagaggaagctgaggaagttggagttgaacacttgttacgagatatcaaagacacgacggtgggcactctgtcccagcggatcacaaaccaggtccatggtttgaagggactgaactccaagc

SEQ ID NO: 8790 - DNA, 303 bp, Homo sapiens
  misc_feature 8: n = A,T,C or G
aaaacganaatagctggggctcgcgcgcctgcaggtcgacactagtggatccaaagaattcggcacgagtcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctca

SEQ ID NO: 8791 - DNA, 206 bp, Homo sapiens
gtcgacactagtggatccaaagaattcggcacgagctcgtgccgaattcggcacgagaaaatagaaaaattagctgggcgtggtgccacgtgcccatagtcccagctacttgggaggctgaggcaggagaatcacttgaacccaggaggcagagattgccatgagccaacatcatgctattgtactccagagcgagactccatctc

SEQ ID NO: 8792 - DNA, 170 bp, Homo sapiens
gacaataagctggagctcgcgcgcctgcaggtcgacactagtggatccaaagaattcggcacgagacttcgcaaagcatacacaagtatcaatagccaaattgatcaagtggaagaaaggatatcagaggttaaagatcaactcaatgaaataaagcatgaaggcaagat

SEQ ID NO: 8793 - DNA, 400 bp, Homo sapiens
  misc_feature 206: n = A,T,C or G
gaacaataagctggagctcgcgcgcctgcaggtcgacactagtggatccaaagaattcggcacgagatctcagtcactctaggactctgcactgaatggctgacctgacctgatgtccattcatcccaccctctcacagttcggacttttctcccctctctttctaagagacctgaactgggcagactgcaaaataaaatctcggngttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtatttt

SEQ ID NO: 8794 - DNA, 400 bp, Homo sapiens
  misc_feature 2, 20, 310: n = A,T,C or G
gngactagtggatccaaagnaattcggcacgaggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcngcgcctccgtcctagtgggtgttcctgtttctcctggccctgggtgggctagggcctgattcgggaagatgcctttgcagggaggggagg

SEQ ID NO: 8795 - DNA, 400 bp, Homo sapiens
gacaataagctggagctcgcgcgcctgcaggtcgacactagtggatccaaagaattcggcacgaggccaaaccaaagagcagctgcagtacattcgttattttaaatgaacaagtttacaaagtttattttcatctatacgtaaggatgatttttttaaaactttttacatattagtggttatgatccaatgtgtcatgagtgaatttaactgtaaggtggtttaaatcaaatatgcaatgtttacttgaattgtatttctattagcagattttgactatgtttacaggacggtttaaattaaggattatcaggcatgtgagatctttcagttatctttaaagtagatgtatattaagggcttagatttaggatctacatattctgggcattgaataggc

SEQ ID NO: 8796 - DNA, 261 bp, Homo sapiens
  misc_feature 12, 13, 60: n = A,T,C or G
aaaacgaaacannaatctggggctcgcgcgcctgcaggtcgacactagtggatccaaagnaattcggcacgagctggaacagtatatggaggcttaatgtatatttcaggaggaattacccatgacactttccaaaatgagctcatgtgttttgacccagaaaaaaaaaaaaaaaaaaaaaaaaaaaaaaaaaaaaaaaaaaaaaaaaaaaaaaaaaaaaaaaaaaaaaaaaaaaaaaaaaaaattttttttttttttttt

SEQ ID NO: 8797 - DNA, 400 bp, Homo sapiens
  misc_feature 8, 18: n = A,T,C or G
aaaacganataatctggngctcgcgcgcctgcaggtcgacactagtggatccaaagaattcggcacgaggtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtc

SEQ ID NO: 8798 - DNA, 399 bp, Homo sapiens
  misc_feature 3, 37, 38, 51: n = A,T,C or G
gcncctatagtgagtcgtattacaattaactggccgnnaagtggatccaangaattcggcacgagtggtggaagagaatcagatgacgcccatgaacctggcagtgtgtctggccccctccctctttcatcttaatttattgaagaaagaaagctctccacgagtcatacagaagaaatatgccactgggaagccagatcaaaaggacctcaacgagaatctggcagcagctcaggggctagcgcacatgatcatggaatgcgacagactttttgaggttccacacgagttggtggcccagtctcgtaactcgtatgtggaggctgagatccacgtgccaaccctggaagaattggggacacagctggaggagagtggggcaactttccacacttacct

SEQ ID NO: 8799 - DNA, 400 bp, Homo sapiens
  misc_feature 326, 349: n = A,T,C or G
gaaaataagctggagctcgcgcgcctgcaggtcgacactagtggatccaaagaattcggcacgaggtggccctccaggaagaggtcccaacggtttgcctggagctataggtctcccaggtgacccaggccctgccagctatggcagaaatggccgagacggtgagcgaggccccccaggggtggcaggaattcctggagtgcctggacccccgggacctcctgggcttcccggtttctgtgagccagcctcctgcaccatgcaggcttggtcagcgagcatttaacaaagggcctgacccttgaaaaggcttactgctgcatggntgtctgcatgaaccacgcctggngaaggagcctgggtgaaaaaaaccatccaaaagctgggcaaagatgattac

SEQ ID NO: 8800 - DNA, 400 bp, Homo sapiens
  misc_feature 105: n = A,T,C or G
gacaataagctggagctcgcgcgcctgcaggtcgacactagtggatccaaagaattcggcacgagaaacttacttgtattgagagcacacgcaattcctactggngaaattactgtttctgtttctaataaaatagaagggattccaaataaacacttgcacacatttttgaagtgcggctagattctcagattcacctttcttccagggaagataactttcaatctatataaaaatctctgtcctaaaactacctttctttattttgaagagacttactaacttacatataatctaaattagatgatagatttgtttttagcccttttgtttggtctatcagtataagaagaatattttaggtttatagctgaagttatcaaggtttaataaagtaaat

SEQ ID NO: 8801 - DNA, 201 bp, Homo sapiens
  misc_feature 18: n = A,T,C or G
agctggagctcgcgcgcntgcaggtcgacactagtggatccaaagaattcggcacgagcgcaccccctggatctggctgagggctcaggacacaggcccagccacccccaggggcctccacaggccgctgcatgacagcgatacagtacttaagtgtctgtgtagacaaccaaagaataaatgattcatggttttttttaa

SEQ ID NO: 8802 - DNA, 400 bp, Homo sapiens
  misc_feature 3, 293: n = A,T,C or G
gancaataagctggagctcgcgcgcctgcaggtcgacactagtggatccaaagaattcggcacgagtctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcngtctgcagtgccagcacgcaaatcccttcaccacagggtttcgttttgctggcttgaagacaaatggtcttagaattcattgagacccatagcttcatatggctgct

SEQ ID NO: 8803 - DNA, 168 bp, Homo sapiens
  misc_feature 19, 26, 123, 167: n = A,T,C or G
agtgagtcgtattacaatncactggncgactagtggatccaaagaattcggcacgagatctggttaggctggtgttagggttctttgtttttggggtttggcagagatgtgtttaagtgctgnggccagaagcggggggaggggggggggtttgggggaaatttttng

SEQ ID NO: 8804 - DNA, 400 bp, Homo sapiens
cgacaaaagctggagctcgcgcgcctgcaggtcgacactagtggatccaaagaattcggcacgaggccatatatgaaagcacattgagtttatggagtaaaaatgccttggtaaaacccaaggtgaagggctgggcgcggtggctcacgcctgtaatcccagcactttgggaggcttaggcgggtggatcacgaggtcaggagatcgagaccatcctggctaacacggtgaaaccccgtctctactaaaaatacaaaaaaattagccgagcctggtggcaggcatctatagtcccagctactcgggaggctgaggcaggagaatggcgtgaacccgggaggcggagcttgcagtgagccgagatggcgccacttgcactccagcccaggcgacagagcca

SEQ ID NO: 8805 - DNA, 400 bp, Homo sapiens
gaacaataagctggagctcgcgcgcctgcaggtcgacactagtggatccaaagaattcggcacgagcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatga

SEQ ID NO: 8806 - DNA, 360 bp, Homo sapiens
  misc_feature 3: n = A,T,C or G
ganaataagctggagctcgcgcgcctgcaggtcgacactagtggatccaaagaattcggcacgagaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttg

SEQ ID NO: 8807 - DNA, 400 bp, Homo sapiens
  misc_feature 3, 6, 388: n = A,T,C or G
agnctntgtgcccttgaaggtgcgacactagtggatccaaagaattcggcacgagggttcgatcaagaggaccaggtggaaactctgcaccgttccagttacagatgtttgatattgtttgctccacatcatgggccaatacagacaaatgctgtgaacttccaggcctgagagatgatgagtcttgcccagaccttccccattcctgctcctgttctgaaaccaatgaagtggctctgggaccagcggcccaccaggtggtccaggactccgaggaccaaagggccagcaaggtgaaccgggtccaaagggaccagatggccctcggggtgaaattggtctgccaggacctcagggtccaccttggacctcaaggaccaagtggtcntgtccattcaaa

SEQ ID NO: 8808 - DNA, 191 bp, Homo sapiens
  misc_feature 49: n = A,T,C or G
gctggagctcgcgcgcctgaggtcgcactgtggatccaagtttcaaatnataggtcttttattgcctcatttaaatatcacaagtaggtcttaagtgtatctggcatcttctttctgtagccaggtaactcttagatcttattcatcagcctgctgaacagttcctttttcagagacatagataccatcca

SEQ ID NO: 8809 - DNA, 386 bp, Homo sapiens
  misc_feature 29, 40: n = A,T,C or G
aacgaacaataagtctggagctccgcgcncctgcaggtcngacactagtggatccaaagaattcggcacgaggttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttaaaaaaaaaaaaaaaaaa

SEQ ID NO: 8810 - DNA, 400 bp, Homo sapiens
  misc_feature 23, 134: n = A,T,C or G
gacaataagctggagctcgcgcncctgcaggtcgacactagtggatccaaagaattcggcacgagattttaactacaactcttgtcctctcggtgatggtattgctttggatttgttgtgcaactgttgctacngctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatat

SEQ ID NO: 8811 - DNA, 205 bp, Homo sapiens
  misc_feature 23, 139, 143: n = A,T,C or G
gaacaataagctggagcctcgcncgcctgcaggtcgacactagtggatccaaagaattcggcacgagggggggagtggggaggggtagcattgggagatatacctaatactagatgacgagttagtgggtgcacgtgcnccancatggcacatgtatacatatgtaactaacctgcacaatgtgcccatgtacccctaaaactta

SEQ ID NO: 8812 - DNA, 201 bp, Homo sapiens
tccaggtcgacactagtggatccaaagaattcggcacgagctcgtgccgaattcggcacgagcagttaaaagaaaaaaagaaactagtcccagatttgaaaacttgtaataaaattgaaactcactggttttctatgtctttttgaactcttgtaatcgagttttgatcatattttctattaaagtggctaacacctggct

SEQ ID NO: 8813 - DNA, 204 bp, Homo sapiens
  misc_feature 7, 190: n = A,T,C or G
gaacaanttagctggagctcgcgcgcctgcaggtcgacactagtggatccaaagaattcggcacgagctgatattagttctgatttctttttaacaaatgttatcatgattaagaaaatttccagcactttaatggccaattaactgagaatgtaagaaaattgatgctgtacaaggcaaataaagctgnttattaaccttgaa

SEQ ID NO: 8814 - DNA, 161 bp, Homo sapiens
  misc_feature 9, 102, 139: n = A,T,C or G
tgcaggtcngacactagtggatccaaagaattcggcacgaggagaactagtctcgagagtacttctagagcggccgcgggcccatcgattttccacccgggnggggtaccaggtaagtgtacccaattcgccctatagngagtcgtattacaattcactgg

SEQ ID NO: 8815 - DNA, 400 bp, Homo sapiens
  misc_feature 148: n = A,T,C or G
gaacaataagctggagctcgcgcgccttgcaggtcgacactagtggatccaaagtaattcggcacgaggctgcatatagaaaacctgaaaaataccatcaaccaatttgatatagttgacattcaagaaactccaccaaataactgcnggtgatccgcccacttcaccatcccaagtgctgggattacattttttttcaagcacacatagaacattagccaagctagattatatctgggccataagataagtctcaatatatttctaaagattaaaatcattgcttaaggccagaaattcaagaccaacctgggcaacatattaaatagatagaccccatctccataaaaagtaaaaaacttagctgagcatggtagcaccgtgcctatagtcccagcta

SEQ ID NO: 8816 - DNA, 267 bp, Homo sapiens
  misc_feature 6, 8, 194: n = A,T,C or G
ctcccncnccttgacggtcgacactagtggatccaaagtaattcggcacgagaaacgcccctcttcgtctgatccgtcctaatcacagcagtcctacttctcctatctctcccagtcctagctgctggcatcactattctactaacagaccgcaacctcaacaccaccttcttcgaccccgccggagggggagnaccccattctataccaacacctattctgatttttcggtcaccctgaaggttatattcttatcctaccagggct

SEQ ID NO: 8817 - DNA, 350 bp, Homo sapiens
  misc_feature 12, 15, 165, 167, 220, 226, 232: n = A,T,C or G
agctggagctcngcngccttcggggtcgacacctagtggatccaaagaattcggcacgaggcactatgtgtacggccccctcccgcaaagttttgacaaagagtgggtggccaagcaagaccaagaggatgctggacatgaaggtgaaccccatccagggcttancntccaagtgggactacgaaaagaacgagtggaagaagtgagagatgctggcctncgcctnaccttncgcctggctctgtcaccgccatgcaactccatgcctatttactggaaacctgttatgccaaacagttgtaccactgctaataaatgaccagtttacctgaaaaaaaaaaaaaaaaaaa

SEQ ID NO: 8818 - DNA, 322 bp, Homo sapiens
  misc_feature 3, 7, 272: n = A,T,C or G
tgnggtncgacactagtggatccaaagaattcggcacgagcttctggaaagccttcaaagtcaaaaatagctctactctttacatgactgcacagtatatatgactgcacagtatatcatgcagtaaatgaatctacagcaatttatgcagccattttcttgtttataattatttacttcgctttcactttttcatcactgcaaaaagaatccccatcccttttaactgtcactgtcttagtcctcaacccccatctcccaaggcctaaggnatcttctttctgtctctatagatttgcctattctggatatttcatattaa

SEQ ID NO: 8819 - DNA, 341 bp, Homo sapiens
  misc_feature 6, 16, 63, 224, 259, 305, 319, 335: n = A,T,C or G
aaaaancgaaacttantctggagctcgccgcgccctgcaggtcgacactagtggatccaaagnaattcggcacgagtccgccagctgaagtccgattcccacgggccgaaggaggacggaggcttcagacactcggaagcctttgaggcactccagcaaaagagtcagggactggactccaggctccagcacgtggaggatggggtgctctccatgcaggtggnttctgcgcgccaagaccgagagccttggagtcccntcctgtccaagagccaggagcacgagcagcgccttgcccgccctgnaggggccccttggnaaagccctcgggtccntaaaaa

SEQ ID NO: 8820 - DNA, 154 bp, Homo sapiens
  misc_feature 16, 18, 52: n = A,T,C or G
atctggaagctccgcncnccttcgacgggttcgacactagtggatccaaagnaattcggcacgagcttctgccgctcctggtgctgcttgtgtgctcgtttggtgcggacctggtacctcttttgtgaagcggcaggttgaggagactccggcg

SEQ ID NO: 8821 - DNA, 280 bp, Homo sapiens
  misc_feature 12, 17, 129, 131, 134: n = A,T,C or G
agctggagctcngcccnccttcgaaggtccgacactagtggatccaaagtaattcggcacgaggcgtggacacgtcctgaagcaggcgtgtggggctctttcagggaccacagaggagggagcagtttnangtnccagccaccctgaaatccccaataatggtgcctcagtgggccccagagttccagtgggagagtaccggttccctcctgtctccctcttcttttccgcacctccatctttgtggataataaataaatatgcacaggttctgagactg

SEQ ID NO: 8822 - DNA, 400 bp, Homo sapiens
  misc_feature 22, 31, 242: n = A,T,C or G
gacaataagctggagctccgcncgcctcgcnggtcgacacctagtggatccaaagtaattcggcacgagatgaaatgtctttaaaggatgaattagcatggtcttaaaatacatttctgaggttactagctgtattttgaattgtgggcaaaatgccgagaaacccagttggcatttatacaaaatgttgacctcaggtctatagttcttaaatgtggctaattctgtaacatagtcttggnattttttaattatgaatgcatatcctatttccaggcaggctctcttacttgaacacaaatccaaaaactaatttagagtcttttttgcccagatcttttaagacttacaccccagagatttaagaagaaaacctctaaatttcaaaattatgaagaat

SEQ ID NO: 8823 - DNA, 309 bp, Homo sapiens
  misc_feature 3, 8, 33: n = A,T,C or G
ganaatangctggagctccgccgccgccttgcnggtcgacactagtggatccaaagaattcggcacgaggtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaa

SEQ ID NO: 8824 - DNA, 400 bp, Homo sapiens
  misc_feature 398: n = A,T,C or G
gaacaataagctggagctccgcgcgcctgcaggtcgacactagtggatccaaagaattcggcacgaggtctaagttggtctggtgtcaaatgagactggggcctaataaaaaggagcgtctatacaggagcttaaatgggctgtaccttgtagcattctgaggacaggcctgaattctgagaagcaaaagtggtaaaagtattgtccagtcctttttaagttggtggctgagcttggtgaggtgtgtttttaaaagacctttagtccgttctacttttcttgaagacggaggaccgtaagggatataaaaggtttcactgaaacctactaagaacctgaaaaactgcttggctgatttgactaataaaggctggtctgttatcagactatatagaggngg

SEQ ID NO: 8825 - DNA, 400 bp, Homo sapiens
  misc_feature 24, 30, 31, 37, 313, 326, 342: n = A,T,C or G
gaacacataatgctgaagctcgcncccttnnaggtgngacactagtggatccaaagaattcggcacgagccatcgtcttatgcggatggcggggaaaggcctccattcgaacttttgtgcccaagaatgaacggcttctcgtgccgaattcggcacgagtggaataggtgtggtgctgaaaaaaatgtatattctgttgatttggggggagagttctgtagatgtctattaggtccgcttagtgcagagctgagttcaattcctgggtatccttgttaactttctgtctcgcaatctgtctaatgttgacagnggggtgttaaagnctgccattattattgngggggagtctaagtctctttgtaggtcactcaggacttgctttatgaatctgggcgct

SEQ ID NO: 8826 - DNA, 400 bp, Homo sapiens
  misc_feature 3, 379: n = A,T,C or G
gancaaaagctggagctcgcgcgcctgcaggtcgacactagtggatccaaagaattcggcacgaggtcattcttgacatctatgtgaaagatcttgagactgaaatcttgctatacaataagattattttcatttttcagtgatcaaccctcttgaatgagagtccagcctgttttctagcaatgaagtcttctctgtaatagatccagttacttatagtaaatctggaagagggagaaatctcaattgactgaagaaagttttctaggtctcttgctttcagtagggccaatagtgaggagttaagctctgcttgaaacgtctccataggacacaatttccctgtgaactttgtatcttctctgcataacaagggggngttcttggtttaagagttcgt

SEQ ID NO: 8827 - DNA, 120 bp, Homo sapiens
  misc_feature 22, 24, 107, 109: n = A,T,C or G
gaaaaaagctggagctcgcgcncntgaggtcgacactagtggatccaaagaattcggcacgagcttcggggacgtggccccgctacagctcaaggtccgcgtgagcnanagggagttgag

SEQ ID NO: 8828 - DNA, 400 bp, Homo sapiens
  misc_feature 21, 23, 214: n = A,T,C or G
gacaaaagctggagcttcgcncncctgcaggtcgacactagtggatccaaagaattcggcacgaggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggnggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtg

SEQ ID NO: 8829 - DNA, 304 bp, Homo sapiens
  misc_feature 132: n = A,T,C or G
gaaaaagctggagctcgcgcgcctgaggtcgaactagtggatccaaagaattcggcacgagctcgagttttttttatttattgtcttcctgtaagaccttcgggtcaaggcagaggcaggaaactaactggngtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaag

SEQ ID NO: 8830 - DNA, 276 bp, Homo sapiens
gacaaaaagctggagctcgcgcgcctgcaggtcgacactagtggatccaaagaattcggcacgagaaaatactgtagatggcatctgtatgattaaacatataaagtaaaacaggtctgagggctttgtagatgattaaagtctccaccttcatgaagcattgtgtgtctgttctactctatgcagaatggtttacaggacatttgactggagtgtatatgtgtgaggtagaatgaacagaataaattagaggctacttaattccctaccttggaa

SEQ ID NO: 8831 - DNA, 400 bp, Homo sapiens
  misc_feature 303: n = A,T,C or G
gaaaaaagctggagctcgcgcgcctgaggtcgacactagtggatcaaagaattcggcacgagcagaaatcagctctattgacgaattctgccgcaagttccgcctggactgcccgctggccatggagcggatcaaggaggaccggcccatcaccatcaaggacgacaagggcaaccctcaaccgctgcatcgcagacgtggtctcgctcttcatcacggtcatggacaagctgcgcctggagatccgcgccattggatgagatccagcccgacctgcgagagctgatggagaccatgcaccgnatgagccacctcccacccgacttttgagggccgccagaacggtcagccagtgggctgcagaccctgagcggcatggtcggccgtcagatgagcttgg

SEQ ID NO: 8832 - DNA, 384 bp, Homo sapiens
gaacaataagctggagctcgcgcgcctgcggtcgacactagtggatccaaagaattcggcacgagggtatatgttccaggatctcccagtgaatgcctgaaaccatggaattgaaccctgtatgtactatgttttttcctatacatacatgcctccgataaagttttaatttataaattaggcacagtgatagattaataactaatgatagaacaatgataacaatatactgtaagaaaagttacaggaatgtggtctctcaaaatattgtacattggcctggcacagtggctcacgcctgtgatcccaacactttgggacacagagatgggagaatcgcttgaggccagtagtttgagagcagccttgggcaacataacaaga

SEQ ID NO: 8833 - DNA, 400 bp, Homo sapiens
gaacaataagctggagcctcgcgcgcctgcaggtccgacactagtggatccaaagaattcggcacgagaattctcctttgatttgactttgttgagaaggaggttggacagtagattagcaaagttccaagtgcaaaattacagtgtgttagagtgtggggggaaaattagtcttatttttccctacatgggatacaacactgtgaattcaatcttcaactgaaggccctgcagttctcctaaaacatagttgtttgtttttctttaacaaagtttaagctagtgttaataaattaaaaaaaattgcttgtctgtctacttcagctttgttttatgcccatttcatatttgttgtctgtgttgtaattcataacttttgataccatttctgatgtgtaaa

SEQ ID NO: 8834 - DNA, 357 bp, Homo sapiens
  misc_feature 3, 6, 32, 239, 255, 257, 284, 307, 318, 346: n = A,T,C or G
ganacntaagctggagctcgcgcgcctgaggncgacactagtggatccaaagaattcggcacgagaatcatttgaagaaaatggctctctctacatagtaatggattactgtgagggaggggatctgtttaagcgaataaatgctcagaaaggcgttttgtttcaagaggatcagattttggactggtttgtacagatatgtttggccctgaaacatgtacatgatagaaaaattcttnatcgagacattaaatntnagaacatatttttaactaaggatggancagtacaacttggagattttggnattgctagagntcttaatagtactgtagagctggctcgnacttgcatagg

SEQ ID NO: 8835 - DNA, 400 bp, Homo sapiens
  misc_feature 309: n = A,T,C or G
gaacaaaagctggagctcgcgcgcctgcaggtcgacactagtggatccaaagaattcggcacgaggctggacgttcacttccatgtgctcctctgagaaccatctgttggtctgatggtgctagatctgaagctggtgagcctcttggggcggcctcaagggctaacaagatctcaaatgcccttctctccatcatttgtggtatcctggattattgtgaaaatgtatagggattcctggggaagagttaaggattaaaatataaaggtttaaatataaataactttatatatatatgttttttcttgnaaaccaatatgttatatagtaggaagtttaattccttaactttggtttttctccctagcctttttatagccaacaagagcaaaagcacact

SEQ ID NO: 8836 - DNA, 118 bp, Homo sapiens
  misc_feature 2, 6, 53, 55, 58, 64, 69, 87: n = A,T,C or G
cncttncaggtcagacactagtggatccaaagaattcggcacgagctcgtgcngngtngcaacntgggnggacacggatctgctggnctctgcttttaaacacacattgcagcttcaa

SEQ ID NO: 8837 - DNA, 100 bp, Homo sapiens
  misc_feature 69, 70, 75, 76, 84, 85, 90: n = A,T,C or G
gacaaaagctggagctcgcgcgcctgaggtcgacactagtggatccaaagaattcggcacgagcggggnnaagcnnaccacacnnagtanacttatcttc

SEQ ID NO: 8838 - DNA, 400 bp, Homo sapiens
gaacaaaaagctggagctccgcgcgcctcgaaggtcgacactagtggatccaaagaattcggcacgagctaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttc

SEQ ID NO: 8839 - DNA, 398 bp, Homo sapiens
  misc_feature 255: n = A,T,C or G
gacaaaaagctggagctcgcgcgcctgcaggtcgacactagtggatccaaagaattcggcacgaggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggngtggacgttggccctgtttgctttttataaaccaaactctatctgaaatcccaacaaaaaaaatttaactccatatgtgttcctcttgttctaatccttgtcaaccagtgcaagtgaccgacaaaaattccagttatttattt

SEQ ID NO: 8840 - DNA, 115 bp, Homo sapiens
gaaaaagctggagctcgcgcgcctgaggtcgaactagtggatccaagaattcggacgagctcgtgccgaattcggcacgagataaatccttgttttgtcttcacccatgtgaaat

SEQ ID NO: 8841 - DNA, 221 bp, Homo sapiens
  misc_feature 21, 23, 29, 199, 206, 208: n = A,T,C or G
gacaataagctggagctcgcncncctcgnggtccgacactagtggatccaaagaattcggcacgagctcagttctttgttggatttcttgtttgtgttcttaaaaaaataaaaaaaactgatttccacgggaaaaacaaaaaaaaaaaaaaaaaaaaaaaaaaaaaaaaaaaaaaaaaaaaaaaaaaaaaaaaaaaaanaaaaaananaaaaaaacaaata

SEQ ID NO: 8842 - DNA, 400 bp, Homo sapiens
  misc_feature 3, 5, 165, 275, 312, 362, 389: n = A,T,C or G
tgngncccttgaggtgcgacactagtggatccaaagaattcggcacgaggccaaagaagccttgccatctggcgctcccatggctcttgaacatctccccttcgtttttgagggggtcatgccgggggagccaccagcccctcactgggttcggaggagagtcanggaagggccaagcacgacaaagcagaaacatcggatttggggaacgcgtgtcaatcccttgtgccgcaggggctgggcgggagagactgttctgttccttgtgtaactgngttgctgaaagactacctcgttcttgtcttgatgtgncaccgggggcaacttgcctgggggcgggggatggggggcagggtggaaancggctcccccatttttataccaaaggngctacatctat

SEQ ID NO: 8843 - DNA, 400 bp, Homo sapiens
  misc_feature 26, 29: n = A,T,C or G
gaacaataatgctggagctccgcccnccntgcaggtcgacactagtggatccaaagtattcggcacgagggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaaaacctaattgtcggtgttaacaaaatggattccactgagc

SEQ ID NO: 8844 - DNA, 218 bp, Homo sapiens
  misc_feature 8, 26: n = A,T,C or G
aacaatangcctggagctccgcgccncttgcaggtcgacactagtggatccaaagtaattcggcacgagctggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttc

SEQ ID NO: 8845 - DNA, 268 bp, Homo sapiens
  misc_feature 22: n = A,T,C or G
gacaaaagctggagctcgcgcncctgcaggtcgacactagtggatccaaagaattcggcacgagagagccgccggcttctgggctccaccacgcttttcatctgtcccgctgcgtgttttcctcttgatcgggaactcctgcttctccttgcctcgaaatggaccccaactgctcctgctcgccttgttggctcctgtgcctgtgccggctcctgcaaatgcaaaagagtgcaaatgccccctcctgcaagaagagctgctgctcctg

SEQ ID NO: 8846 - DNA, 400 bp, Homo sapiens
  misc_feature 6, 23, 378: n = A,T,C or G
gaaaangctggagctcgcgcgcntgcggtcgacactagtggatccaaagaattcggcacgagaaaaaacgaaagaagccagtttcccaatcccttgagtttccaacaagatacagtccttacagaccttatcgatgtgttcaccagggatgctttgttgcctttacgatacagcaaaacttgattctccattaccaggctgtacacaaatcagatctacctgcattttcagcagaggtcgaagaggaaagtgaagctggtaaagaaagtgaagaaactgaaactaaacaaactttgaaagaatttcgatgtcaggtaagtgactgttctcgaattttccaagcaattactggcctaatacaacactacatgaaacttnatgaaatgactcctgaagaaat

SEQ ID NO: 8847 - DNA, 100 bp, Homo sapiens
  misc_feature 19, 26, 31, 32, 77, 88, 91, 94: n = A,T,C or G
gacaataatgctggagctngtgcgcntgagnncgacactagtggatccaaagaattcggcacgagctcgtgcagaantacgtcaggtntgnctntgctgg

SEQ ID NO: 8848 - DNA, 335 bp, Homo sapiens
  misc_feature 12, 30, 38, 46, 47, 48, 54, 70, 96, 117: n = A,T,C or G
tattacaattcnctggccgaatgtatgatncaaagatncggcacgnnncttgtntcagattttaatcttntgaaaacattatattccttggatganggctcttgcttctgagaactnatttgtgaatacaacacagcttaaaatcacagggataagaaatacgtattttaaaagtcaagatgtaatgttatcagagacactaactctatcttcacatcctgatttggtggctcagtattctagcaagggaggaacagtctcctttatcatggatcatattatattattattatttactaattttttgagacagagtctcgcctctatttgcccag

SEQ ID NO: 8849 - DNA, 313 bp, Homo sapiens
  misc_feature 20, 85, 146, 152, 183, 204, 221, 246, 249, 267, 282, 290,300: n = A,T,C or G
gaaaaagctggagctcggcnctcgaggtcgacactagtggatccaaagaattcggcacgaggtgttttctgccgccgaagagggncccggtcccctccaggctcagtgtggctttctcccctgaccccccgccctagaactttttncaggtncctttttcttggaacttcctgggccccgggncccccaaggcgggagaagggntttgcccggatttcttncctggggctggggcctcttagggangancccaaattttgacacccnccaggaaaggcatanttaaaacnctttgaaaanaacgcaaaaaaaa

SEQ ID NO: 8850 - DNA, 279 bp, Homo sapiens
  misc_feature 6, 216: n = A,T,C or G
gaaaangctggagctcgccgcttgcggtcgacactagtggatccaaagtaattcggcacgagggaaaatacagccaggtcctagccaatggtctggacaacaagctccgtgaagacctggagcgactgaagaagattcgggcccatagagggctgcgtcaccttctggggccttcgtgtcccgaggccagcacaccaagaccactggccgccgtgnccgcacccgtgggtgtgtccaagaagaaataagtctgtaggccttgtcttgttaataaatagt

SEQ ID NO: 8851 - DNA, 108 bp, Homo sapiens
  misc_feature 108: n = A,T,C or G
gaaaaagctggagctcgcgcgctcgcggtcgcactagtggatccaaagaattcggacgaggcggcctatcctgatccttggaggaggaggaagaggaggccactgtgn

SEQ ID NO: 8852 - DNA, 242 bp, Homo sapiens
gacaataagctggagctcgcgcgccttgcggtcgacactagtggatccaaagaattcggcacgagctccaaagctgctgataaaacccaagaaaccaacaaggaaacgaaaacagaggctaaagaagtaacaaatgcatctgcagcaggcaacaaggcaccagggaaagggaatatgatgagcaaccttttttggaaaagctgctatgaataaatttaaagtcaatttggactcagaacaaa

SEQ ID NO: 8853 - DNA, 367 bp, Homo sapiens
  misc_feature 107, 150, 167, 181, 225, 273, 274, 319, 333: n = A,T,C or G
gacaaaagctggagctcgcgcgcctgcggtcgacactagtggatccaaagaattcggcacgaggaaatcttcaggtccaccttcttactttattaaaagggaatcgnggggctggacagactttctaatgaacccaatggttatgatgangggtcttcctttattgntatttgggcttctncctaaagggggcaacacaagtgatcctgacatgagacgggaaanggagcagtcaatgaatatgctgaattccaaccatgagttgcctgatgnnttctgagttcatgacaagactcttctcttcaaaatcatctgggcnaatctagcagcggnaggagtaaaacagggcaaaagtggggcttggcaa

SEQ ID NO: 8854 - DNA, 182 bp, Homo sapiens
  misc_feature 87, 160, 172: n = A,T,C or G
aaaaagctggagctcgcgcgcctgcaggtcgacactagtggatccaaagaattcggcacgagaaccctgtcccaagtggccgacccnttctggatcacatcaaggaggtggcaggagccagagccgtggggttttggtgggggaacttttgaatgggtgnttccaaggggtncccttgaagg

SEQ ID NO: 8855 - DNA, 195 bp, Homo sapiens
  misc_feature 123, 168: n = A,T,C or G
agaaataagctggagctcgcgcgcctgcaggtcgacactagtggatccaaagaattcggcacgagctcgtgccgaattcggcacgagcagcctcccgctggcctggggcagcctccgtccgtncatctgtctggcctgaggaccaggggccggtggtgggcgggcggnacacagcgccttgctcagaaccgcctt

SEQ ID NO: 8856 - DNA, 400 bp, Homo sapiens
gaacaataagctggagctcgcgcgcctgcaggtcgacactagtggatccaaagaattcggcacgaggatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgaga

SEQ ID NO: 8857 - DNA, 400 bp, Homo sapiens
gaaaataagctggagctcgcgcgcctgcaggtcgacactagtggatccaaagaattcggcacgaggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaaggaagcttgctgtgtgggcctggaggccggcatcaaccccacagaccatctcatcacagcctaccgggctcacggctttactttcacccggggcctttccgtccgagaaattcttcgcagagcttacaggacgaaaaggaggttgtgctaaaagggaaaggaggatcgatgcacatgt

SEQ ID NO: 8858 - DNA, 400 bp, Homo sapiens
gacaataagctggagctcgcgcgcctgcaggtcgacactagtggatccaaagaattcggcacgaggtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactggggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggg

SEQ ID NO: 8859 - DNA, 400 bp, Homo sapiens
  misc_feature 6, 24: n = A,T,C or G
gacaanagctggagctcgcgcgcntgcggtcgacactagtggatccaaagaattcggcacgaggattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacaggaaaaatcttgtgctagaatactttttaaaaggtattttgaatactattaaaactgcttttt

SEQ ID NO: 8860 - DNA, 400 bp, Homo sapiens
gaacaataagctggagctcgcgcgcctgcaggtcgacactagtggatccaaagaattcggcacgaggaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagtgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgattccttcaggtt

SEQ ID NO: 8861 - DNA, 128 bp, Homo sapiens
  misc_feature 23, 30, 61, 91, 95, 103, 105: n = A,T,C or G
agtgagtcgtattacaattaacnggccganagtggatccaaagaattcggcacgaggagtnttcggggagaaatcacggctctcgaagctnatanaattcaangngaggaagcaagtgacaaggcacg

SEQ ID NO: 8862 - DNA, 400 bp, Homo sapiens
  misc_feature 25: n = A,T,C or G
gaacaataagctggagctccgcgcnctcgcagggtcgacactagtggatccaaagaattcggcacgagtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttccctcgctcccccaaaaatttgaatttttttttcaacactcttacacctgttatggaaaatgtcaacctttgtaagaaaaccaaaataaaaattgaaaaataaaaaaccataa

SEQ ID NO: 8863 - DNA, 400 bp, Homo sapiens
  misc_feature 25, 39, 186: n = A,T,C or G
gaacacataatgctggagctctgcngccccttgaaggtncgacactagtggatccaaagaattcggcacgagtaaatgcggtggatcgacaaaagaaccattgaaaaatttgagaaggaggctgctgagatgggaaagggctccttcaagtatgcctgggtcttggataaactgaaagctgagcgngaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagaccccgagagcatgccctt

SEQ ID NO: 8864 - DNA, 242 bp, Homo sapiens
  misc_feature 20, 22: n = A,T,C or G
gacaataagctggagctcgncnctcgcggtcgacactagtggatccaaagaattcggcacgaggtccgccctcctcactgctgagctcctcacctggacagtctcctggacgaggagtttccagctgctggctggagtctcaggccaaattgcagagggtcctccagggtcctgaagagcactggactaagagtctagtggttccagggccctgaccagtaggtgctcaataaatgtttgtt

SEQ ID NO: 8865 - DNA, 400 bp, Homo sapiens
  misc_feature 30: n = A,T,C or G
gaacaataagctggagctccgcgcgcttgnaggtcgacactagtggatccaaagaattcggcacgagggaatcatgtcttatcctcacaacaaaagtattgcgctgtaatgtcacagagctggtttcagcatggtattgagttgacacttctcagcctcaattcataactatatgaactttaaatgattatatggatttctttaaaaggatatgcccatttgatcctaaccttttagcctgctctctagaaccctacttacagttgaccaagctgcttaaagtagaaggatcaggactggcaggggatatgagggccagtgtagagattaaacagaataatgagtacacaaagtttttgcctatccctttccttaaaatataagaaataaaaggagctct

SEQ ID NO: 8866 - DNA, 348 bp, Homo sapiens
  misc_feature 345, 347: n = A,T,C or G
cgacaaaagctggagctcgcgcgcctgcaggtcgacactagtggatccaaagaattcggcacgagattgaaacatgtcttctcacaagagaaaatgacagttttaatgatgtatttgatgaatttaaactttaagtcaggtgctgcaaattggaaagaagacttgtggtgttttaagttgctgtggacacttttaagaaacttagaacccatggaacccttgtttatcgccatgcaaattacaatcttgaatgagtgttttttaaaaataaagtattagaaaaatgtgtagtaaagatgtaaaattaaaaaatggaattctccattaactgtggattttactaantng

SEQ ID NO: 8867 - DNA, 400 bp, Homo sapiens
  misc_feature 2, 17, 27, 33: n = A,T,C or G
gncctttagtgagtcgntacatttagntgggcnctagtggatccaaagaattcggcacgagccccattgcactctgtggcagttattctggtaaaaataggcaaaagtgacctgaatctacaatgatgtcccaaagtaaccaagtaagagagattgtaaatgataaaccgagctttaaaggataaagtgttaataaagaaaggaagctggcacatgtcaaaaagggagatcgaaatgttaggtaatcatttagaaaggacagaaaatatttaaagtggctcataggtaatgaatatttctgacttagatgtaaatccatctggaatctttacatcctttgccagctgaaacaagaaagtgaagggacaatgatatttcatggtcagtttattttgtaaga

SEQ ID NO: 8868 - DNA, 398 bp, Homo sapiens
  misc_feature 20, 25, 155, 217: n = A,T,C or G
gaaaaagctggagctcgcgnctcgnggtcgacactagtggatccaaagaattcggacgaggtcggtctgggtgttaagtgctccaaggaggtggccaccgccttccgtggggccatcatcctggccaagctctccatcgtccccgtgcgcagagnctactgggggaacaaggatcggcaagccccacactgtcccttgcaaggtgacaggcccgctncggttcttgtgcttggtaccgccctcatccctgcacccaggggcactggcattcgtctccgcacctgtgcctaagaagctgctcatgatggctggtatcgatgactgctacacctcagcccggggtggcacttgcaccccttggcaacttcgcaaggccacctttgatgccatttctaaga

SEQ ID NO: 8869 - DNA, 400 bp, Homo sapiens
  misc_feature 20, 25, 31, 100: n = A,T,C or G
gaacaataagctggagctcngcccncctcgnggtcgacactagtggatccaaagaattcggcacgagcctcaaggggccatcctgtcccaccatgcagtnccctagcttagagcctccctcaattccccctggccaccaccccccactctgtgcctgaccttgaggagtcttgtgtgcattgttgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttca

SEQ ID NO: 8870 - DNA, 113 bp, Homo sapiens
  misc_feature 29, 33: n = A,T,C or G
gacaataagctggagctccgcgcgcttgnggtngacactagtggatccaaagaattcggcacgagtggagctgggtcaggttgagtgtcaattgaaaaccacactggaagtgc

SEQ ID NO: 8871 - DNA, 400 bp, Homo sapiens
  misc_feature 21, 23, 29: n = A,T,C or G
gacaataagctggagctcgcncncttcgnggtcgacactagtggatccaaagaattcggcacgagccaagcagaagtcagataaggctatactgttagagaatgatctttccactgaaaacaagctaaaagtgttaaagcacgatcgcgaccactttaaaaaagaagagaaacttagcaaaatgaaattaggaagaaaaagaatggctctttaaagatgaaaaatcactgaagagaatcaaagacacaaacaaagacatcagcaggtctttcccgagaagagaaagaccgttcgaataaagcagaaaaggagagatcgctgaaggaaaagtctccgaaagaagaaaaactgagactgtacaaagaggagagaaagaagaaatcaaaagaccggccctcaa

SEQ ID NO: 8872 - DNA, 309 bp, Homo sapiens
  misc_feature 102, 181, 183, 235, 245, 257: n = A,T,C or G
gacaataagctggagctccgcgcgcttcgcggtcgacactagtggatccaaagaattcggcacgagctcgtgccgctcagaactgtttgtttcaattggccntttaagtttagtagtaaaagactggttaatgataacaatgcctcgtaaaaaccttcagaaggaaaggagaatgttttgngnaccacttttggttttctttttggcggggggaggttttaagttattagttttnaaaatcagtnctttttaatggnaacaacttgaccaaaaatttgtcacagaatttttgagacccattaaaaaagt

SEQ ID NO: 8873 - DNA, 129 bp, Homo sapiens
  misc_feature 19, 22, 62: n = A,T,C or G
acaataagctggagctccnccnctcgaaggtcgacactagtggatccaaagaattcggcacnagattatttgagtgttgttggaccatgtgtgatcacgactgctatctgaataaaataaggatttgtc

SEQ ID NO: 8874 - DNA, 100 bp, Homo sapiens
  misc_feature 4, 10, 54, 69, 84, 86, 87, 89: n = A,T,C or G
tgancatttngctgggcgctagtggatccaaagaattcggcacgaggagacctnatgagcacagaagancacttatgcttctananngnccgatgaagag

SEQ ID NO: 8875 - DNA, 207 bp, Homo sapiens
  misc_feature 110, 134, 141, 181, 188: n = A,T,C or G
gaacaattagctggagctcgcgcgcttgcaggtcgacactagtggatccaaagaattcggcacgagctggatccactgggaccgcccagcaagagggaaccgcagccgtnaatatggagcgggagaggccgagntttcaancccgagctaagatcgaggaagctccatccctcctgtcctnatcacanggggacatggttcggggga

SEQ ID NO: 8876 - DNA, 325 bp, Homo sapiens
  misc_feature 22, 86, 87, 137, 148, 169, 315: n = A,T,C or G
tggagctcagagcgccttcganggtcgacactagtggatccaaagaattcggcacgagccccctccccccgagcgccgttccggtnngcaccgggcttcggttccgagtttcaaggctcgtgctaagctagcgccgncgtccgtcttncccttcagtcgccatcatgantatctaccggggacctcatcagccacgatgagatgttctccgaaatctacaagatccgggagatcgcggacggttgtgcctggaggtggagggggaagatggcagtaggaaagaaggtgaacccgatctaccagaaaattttcctnaccgatggca

SEQ ID NO: 8877 - DNA, 400 bp, Homo sapiens
  misc_feature 6, 28, 273: n = A,T,C or G
gacaanagctggagctccgcgcgcctgnggtcgacactagtggatccaaagaattcggcacgagaggcagtcatggatcaggtaatgcagtttgttgagccaagtcggcagtttgtaaaggactccattcggctggttaaaagatgcactaaacctgatagaaaagaattccagaagattgccatggcaccagcaataggatttgctataatgggattcattggcttctttgtgaaattgatccatattcctattaataacatcattgttggnggctgaatacattttggaagagagtttttcatcttagagattggtgaacaagtgtgagggtgtgagaaactcacagaatacaaatttgcctgtatgttttgtgggtttttttttttcctttcaagat

SEQ ID NO: 8878 - DNA, 219 bp, Homo sapiens
  misc_feature 5, 7, 75: n = A,T,C or G
gacantnagctggagctcgcgcgctcgaggtcgacactagtggatccaaagaattcggcacgaggtactactgtnaacatagtgtaaatggttctcaaaagcttaccagtgtggacttggtgttacgccaccgctgtttacctcatacagtacgtgtcctgtttttaaaatatacaattattcttaaaaataaattaaaatctgtatacttacatttca

SEQ ID NO: 8879 - DNA, 400 bp, Homo sapiens
  misc_feature 19, 29, 66: n = A,T,C or G
gacaataagctggagctcngcgcgctcgnggtcgacactagtggatccaaagaatattcttaaagnattaactttgaattttctccatatttttatgtttttaaatattatgatgtaaaattatttggaggatccaatacatatcattaagaattatgtttgtcaggcaataacaaagaatgttaccccaacaaataacagcagtttaaaaacttggattgttattttctcataaaaatcttgagtttggcagtctaagggctcattatgctgtctctgttccaagacattctcaaagattgaaactcttgctacctttctgctcaaatatatgcctcaaagatggtctccattctcaagatcaactcgtgttccagtaggtgcttcaggtctggtcatc

SEQ ID NO: 8880 - DNA, 227 bp, Homo sapiens
  misc_feature 6, 95, 167: n = A,T,C or G
gaacantaagctggagctccgtgcgcctcgaaggtcgacactagtggatccaaagaattcggcacgaggttaaattgaacactgttttggatgcntgttgaaagacatgcttttatttttttgtaaaacaatataggagctgtgtctacctattaaaagtgaaacanttttggcatgtttgttaattctagtttcatttaataacctgtaaggcaccgtaagtttaa

SEQ ID NO: 8881 - DNA, 485 bp, Homo sapiens
  misc_feature 10, 19, 28, 44, 62, 69, 72, 73, 85, 87, 96, 97, 100, 101,104, 105, 112, 119, 127, 133, 134, 136, 138, 140, 144, 145,156, 157, 158, 159, 162, 172, 173, 174, 179, 182, 193, 194,202, 205, 213, 218, 225, 227, 229, 241, 256, 257, 277: n = A,T,C or G
  misc_feature 294, 359, 457: n = A,T,C or G
gtgagccgtnttacctttngctgggacnctagtggatccaaagnaattcggcacgagcgtgntcttganganntatcttggcctncncgttgattnntanngcnngcacggngaatgcnctcagagnacattnntngnanaganntttgcacatcnnnnaanagtgaagttnnnggcgnggntgctggatttnnctgggctnacnactttatnggaancaaaagntngnaaatatcaactnacagcctttaccagnntactacagggaaactttttnccctatttaaaacatgntcttaggcaacaattttatttataattatcagctaaattacatttagtataatactcaaatggantaatcagtagtttatacctttataaatacagtttagtaagccaaggaatcagggaaataatcctttaaaataatgtactaatagttaagatgcctcanggggttttttctgattaaatttgctctt

SEQ ID NO: 8882 - DNA, 400 bp, Homo sapiens
  misc_feature 2, 7, 32: n = A,T,C or G
cnctcgngggtcgacactagtggatccaaagnaattcggcacgagcggctctcctgcacgctgggcttccacacccatgccgaggagctctactacctgaacaagtctgtctccatcatgctgggcaccacagacctgctccgggagcgcttcagcctgctcagtgcccggctggacctcaacgtccggaacctctccatgatcgtggaggagatgaaggcagtggacacacagcatggagaaatccttcgcaatgtcaccatcctacgaggtcacactttgttttcacataatcggatatgatatgaagccagccataaagcccaggatgaccaagaatataatttgaaaatgaatttgtttactatccttaatggtaagcatcaccttaagcacatat

SEQ ID NO: 8883 - DNA, 133 bp, Homo sapiens
  misc_feature 11, 14, 32, 55, 62, 69, 76, 85, 93, 95, 116, 119: n = A,T,C or G
cccccttcganggntccgacactagtggtatncaaataattcggcacgagggcangctgccntacactnagcggantgccttggngcctaccngnaaaaggacgtgaaccagcagntanttctggcaggagct

SEQ ID NO: 8884 - DNA, 224 bp, Homo sapiens
  misc_feature 30, 97, 103: n = A,T,C or G
gacaataagctggagctccgcgcgcttcgnggtcgacactagtggatccaaagaattcggcacgagctctgaagcccctgtgcgggttctgcccctnctgcancggaaggagaagaaagatgagaagaaggaggagtctgaagagtcaagatgatgacatggggatttggccttttttgattaaaattccctgctcccctgcaaataaagcctttttacacatc

SEQ ID NO: 8885 - DNA, 297 bp, Homo sapiens
gaaataagctggagctcgcgcgcctgcaggtcgacactagtggatccaaagaattcggcacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacagtctgctccttttttttgtccgccacacgtaactgagatgctcctttaaataaagcgtttgtgtttcaagtt

SEQ ID NO: 8886 - DNA, 109 bp, Homo sapiens
  misc_feature 13, 33, 46, 54, 105: n = A,T,C or G
cccctcagggtcngacactagtggatccaaagnaattcggacaggnctggcatnaccctgccaaaggtgatggggtcgcctacacatgtgtatgtcactgtgagnggat

SEQ ID NO: 8887 - DNA, 100 bp, Homo sapiens
  misc_feature 10, 21, 29, 40, 42, 45, 53, 56, 68, 74, 80, 92, 97: n = A,T,C or G
ctgtcgtttngcccgctcgtnacagtcanaacgcatttcncnatntgttgtgngantttacgcattgncagacnagtcgnaatgggcgatcnttcgntca

SEQ ID NO: 8888 - DNA, 100 bp, Homo sapiens
  misc_feature 3, 14, 34, 39, 46, 49, 51, 54, 73, 82, 92, 93, 95: n = A,T,C or G
ttntgccgctcgtnacagtcaccaacgcatttcnccatntggtggngantntangattgccagccgagtgaangggcgatcnttcgctcacnngngaaag

SEQ ID NO: 8889 - DNA, 131 bp, Homo sapiens
  misc_feature 13, 15, 25, 42, 58, 62, 64, 68, 73, 84, 92, 94, 95, 110, 111: n = A,T,C or G
acaacgaatttcncnctgtgttggngaatataccatggagcnagtgaacgcgcgatcnttcnanaacntgaanacagcccgtcncatcactnannctcctaaacaaagtnngagaatatgtctatacgaga

SEQ ID NO: 8890 - DNA, 100 bp, Homo sapiens
  misc_feature 8, 32, 39, 40, 41, 42, 43, 47, 51, 58, 62, 69, 88, 89, 93,94: n = A,T,C or G
cgcccttntgcccgctggtcacaggaagaacncatttcnnnnnttgntgtnggctatnccancggcagncgagttgcaatgccgatcnntcanngaacac

SEQ ID NO: 8891 - DNA, 101 bp, Homo sapiens
  misc_feature 4, 18, 28, 39, 41, 45, 46, 53, 61, 62, 63, 67, 77, 79, 86: n = A,T,C or G
tatnacgatcggcagacnagtgcaatgngcgatcattcnanaacnngcatagngcccggtnnnactnaggtggtgcncnctacaanaaagaagggagaaaa

SEQ ID NO: 8892 - DNA, 100 bp, Homo sapiens
  misc_feature 2, 3, 20, 22, 24, 36, 38, 40, 41, 50, 66, 71, 84, 85, 97: n = A,T,C or G
gnnaccaacgcatttacacncntnctgttagtgagnantnntaccgcatngacagaccgagtgganatggncgcatcattttcnntaacgtgggtanagc

SEQ ID NO: 8893 - DNA, 100 bp, Homo sapiens
  misc_feature 8, 13, 44, 46, 52, 61, 62, 73, 79, 84, 85, 88, 98: n = A,T,C or G
tttcacgncgcangcaacgcctttacagtctattacgatgctcnanacagtnccggatttnncgcgtgtggtngaaaanttagnnttncagcctgtgnca

SEQ ID NO: 8894 - DNA, 100 bp, Homo sapiens
  misc_feature 2, 15, 29, 41, 43, 48, 52, 59, 61, 62, 64, 65, 66, 69, 70,71, 73, 74, 78, 79, 80, 85, 87, 89, 95: n = A,T,C or G
cncctttaccagtcnttacgatgacgcanagagagtaccangnatttntccntgtggtngnnannntannntnncagnnngtggnantngccatnttcga

SEQ ID NO: 8895 - DNA, 100 bp, Homo sapiens
  misc_feature 14, 16, 34, 53, 58, 73, 75, 88, 90, 93, 94: n = A,T,C or G
ttttgccgctggtnanaggacgacgcatttcacnatttgtgtggcgaatatangcatnggcagacgagtgaangngcgatcatttcgntnacnngcataa

SEQ ID NO: 8896 - DNA, 100 bp, Homo sapiens
  misc_feature 5, 7, 27, 41, 44, 55, 60, 69, 72, 73, 78, 79, 82, 92, 96: n = A,T,C or G
cggcncnagggacccctttacctgtcnttacgatgcgcaantantaccggatttngtccngatggtcgnaannttagnnttncagcctgtgncacngcca

SEQ ID NO: 8897 - DNA, 100 bp, Homo sapiens
  misc_feature 12, 26, 46, 49, 55, 60, 63, 69, 70, 73, 79, 92, 96: n = A,T,C or G
tcgggcgggganccctttacctgtcnttacgatgcgcaagtagatnccngatttngtccnganggtcgnnaanttaggnttccagcctgcgncacngcca

SEQ ID NO: 8898 - DNA, 100 bp, Homo sapiens
  misc_feature 4, 17, 29, 40, 42, 43, 45, 48, 52, 58, 60, 61, 66, 87, 95: n = A,T,C or G
gccngttttgcccgctngtcacaggcacnaacgcatttcncnntntgntgtncggctntnncgcancgccagaccgagttgcaatgnccgattcnatttc

SEQ ID NO: 8899 - DNA, 121 bp, Homo sapiens
  misc_feature 5, 7, 27, 41, 42, 43, 44, 51, 60, 83, 92, 96, 104, 109: n = A,T,C or G
gcccntnttgcccgctggtcacagganaacgcaatttcacnnnntggtagncggcttatncgcatcggcagacgagtgcaatngccgatcanttcncagaacgngacanctacacctcgtc

SEQ ID NO: 8900 - DNA, 108 bp, Homo sapiens
  misc_feature 6, 11, 31, 46, 47, 50, 53, 54, 58, 65, 66, 68, 76, 80, 85,88, 93, 96: n = A,T,C or G
ctatancgatngacagccgagttggaatggncgattcttttcgctnntcntgnntaancaccganngncacttcantgangctcnctncaacnccnagtagggaggaa

SEQ ID NO: 8901 - DNA, 100 bp, Homo sapiens
  misc_feature 11, 13, 16, 26, 29, 32, 36, 48, 53, 56, 58, 61, 66, 68, 75,84, 87, 91, 98: n = A,T,C or G
aaaattagggntncanacactgtcgntantgncatnttcgccaaaccngcganacncngtnatatnanaacgatncctgaaccnatngggngatgganat

SEQ ID NO: 8902 - DNA, 100 bp, Homo sapiens
  misc_feature 2, 22, 27, 34, 37, 48, 51, 53, 54, 57, 63, 78, 81, 82, 83,99: n = A,T,C or G
cngtctattacgatgacgcaantagtnccgtganttnagtcgctgctngtngnnaanttaggnttccagaagtgtcgnctnnncgccattttcgttcgnc

SEQ ID NO: 8903 - DNA, 100 bp, Homo sapiens
  misc_feature 17, 22, 28, 35, 38, 45, 48, 50, 53, 55, 56, 58, 64, 65, 68,72, 74, 76, 77, 78, 80, 81, 82, 96: n = A,T,C or G
gtctattacagatgccncaagntagatnccgtganttnagtcgcngcncngtngnnantgtagnnttncagncngnnncnnncgccattatttcgntcta

SEQ ID NO: 8904 - DNA, 104 bp, Homo sapiens
  misc_feature 2, 7, 27, 34, 57, 63, 64, 67, 73, 75, 76, 77, 78, 80, 90,96, 97, 98: n = A,T,C or G
cntgctnttacgatgcgcaaggtagtnccgtgantttagtccgtgatgtgtcgaaanattagnnttncagccngnnnnantgccattttngctctnnngagaaa

SEQ ID NO: 8905 - DNA, 100 bp, Homo sapiens
  misc_feature 8, 16, 28, 42, 48, 53, 56, 64, 69, 70, 72, 73, 79, 96: n = A,T,C or G
ttactggntcaggganccctttaccgcnttacgatgcgcaangtagtnccggnttngccggacngtcgnnannttaggnttccagccgtgcgcacngcca

SEQ ID NO: 8906 - DNA, 101 bp, Homo sapiens
  misc_feature 11, 16, 30, 36, 42, 55, 60, 63, 69, 73, 77, 83, 86, 87, 88: n = A,T,C or G
acccctttacntgctnttacgatgcgcaangtagtnccgganttagtcgcgtgtngtcgnaanattagntttncagncgtgtngcnnngccacttttcgct

SEQ ID NO: 8907 - DNA, 127 bp, Homo sapiens
  misc_feature 7, 29, 33, 35, 40, 49, 53, 55, 65, 67, 70, 73, 74, 113, 114: n = A,T,C or G
ttcccgnatcgattcaacgcagggctggngccntnttccngctggtcanaggnanacgcatttcncnctntgnngttcggctgtccgagtgtgcagcgagtgagtgcccgttnntcaagaacacgca

SEQ ID NO: 8908 - DNA, 100 bp, Homo sapiens
  misc_feature 6, 15, 35, 39, 40, 48, 61, 63, 68, 71, 72, 76, 77, 82, 84,86, 88, 91, 94, 95, 97: n = A,T,C or G
aggganccctttacngtctattacgatgcgcaagntagnnccagtgantttagtccgtgancngtcgnaanntagnnttccngncntncgncanngncat

SEQ ID NO: 8909 - DNA, 103 bp, Homo sapiens
  misc_feature 9, 14, 18, 20, 23, 24, 32, 33, 38, 41, 50, 52, 53, 55, 56,57, 61, 64, 65, 78, 80, 82, 91, 93, 94: n = A,T,C or G
tcctgtggngaaanattngngtnncagccggnngcacngcnttttcgctncnngnnnaagncgnncatacttagcagngntncttaactcngnncgcgattat

SEQ ID NO: 8910 - DNA, 100 bp, Homo sapiens
  misc_feature 27, 33, 43, 47, 52, 61, 87, 93, 95: n = A,T,C or G
ttcacggccccaggaaacgcctttacntgtctnttacgatgcncaanaagtnccggatttntccgtgtggtcgaaaaattagggttncagccngnggcac

SEQ ID NO: 8911 - DNA, 100 bp, Homo sapiens
  misc_feature 9, 11, 31, 41, 55, 57, 62, 72, 73, 76, 78, 89, 97, 99: n = A,T,C or G
ttccggcgnangcaacgcctttacctgtctnttacgatgcncaagacagtaccgngnatttntccgtgtgtnngananattagggttgncagccggngnc

SEQ ID NO: 8912 - DNA, 100 bp, Homo sapiens
  misc_feature 23, 27, 37, 43, 59, 61, 62, 64, 76, 84, 89: n = A,T,C or G
ccgatcgcatcaacgcgttttgngccnttttcccgcnggtcanaggaaaacgcatttcncnntntggtgtcggctntcacgagnggcancgagtgaatgg

SEQ ID NO: 8913 - DNA, 100 bp, Homo sapiens
  misc_feature 4, 29, 37, 40, 52, 57, 60, 67, 76, 81, 83, 84: n = A,T,C or G
accngtctattacgatgacgcaagtagtnccagtganttnagtcgctgctcngtcgnaanattaggnttccagccntgtcncnntcgccatttttcgtta

SEQ ID NO: 8914 - DNA, 102 bp, Homo sapiens
  misc_feature 27, 28, 30, 35, 39, 48, 75, 77, 80, 87, 94: n = A,T,C or G
ttcacgcataggcatccagacggccgnncntaggngccntatttgccngctggtgcacaggacgaacgcatttcncnatntggtgtncggactnatcacgca

SEQ ID NO: 8915 - DNA, 100 bp, Homo sapiens
  misc_feature 22, 24, 28, 32, 34, 37, 64, 66, 69, 81, 87, 88, 93: n = A,T,C or G
ttcacgatcgcatcaacgccgntntggngccntnttnccgctggtcacaggacaacgcatttcncnctntggtgtcggctntccganngccancgagtga

SEQ ID NO: 8916 - DNA, 100 bp, Homo sapiens
  misc_feature 9, 11, 33, 48, 53, 81, 87, 88, 91: n = A,T,C or G
tttcacggngncaggaacgcctttacctgtctnttacgatgcgcaagntagtnccgtgatttgtccgtgctgtgtcgaaanattagnnttncagccggtc

SEQ ID NO: 8917 - DNA, 100 bp, Homo sapiens
  misc_feature 5, 11, 15, 22, 27, 30, 34, 35, 37, 43, 46, 52, 54, 56, 59,70, 72, 74, 87, 88, 96, 97, 99: n = A,T,C or G
caagnacagtnccgngatttgnccgtntgntggnnanttaggnttncagccngngnacngcgattttcgntncntgggcaagccgtnnatattagnngng

SEQ ID NO: 8918 - DNA, 100 bp, Homo sapiens
  misc_feature 13, 27, 33, 52, 53, 59, 61, 68, 71, 77, 79, 80, 81: n = A,T,C or G
cctttaccgtctnttacgatgcgcaangtagtnccgtgatttgtcgcgtgcnngtcgananattaggnttncagccngnnncactgccattttcgctcac

SEQ ID NO: 8919 - DNA, 100 bp, Homo sapiens
  misc_feature 11, 20, 27, 36, 38, 40, 43, 46, 52, 59, 64, 68, 81, 90, 95,96, 99: n = A,T,C or G
gccgttttccngctggtcanaggaaangcatttcanantntgntgncgggtntacgagnggcancgantgaatggccgatnttccaaacncgcanncant

SEQ ID NO: 8920 - DNA, 204 bp, Homo sapiens
  misc_feature 22, 32, 62, 64, 65, 67, 80, 89, 108, 112, 132, 145, 161, 183: n = A,T,C or G
caccgatcgcatcaacgcggcntggtgccctnttcccgctggtcacaggaaaacgcatttcncnntntggtgttcggctntcacgcagnggcgcgagtgaatggccgnttcnttattgaacacgcacacacnctgttgcccctgntgataccccataacanaatgggaaaaggctgtcttccngatcgcccatcgagagcgccc

SEQ ID NO: 8921 - DNA, 100 bp, Homo sapiens
  misc_feature 19, 26, 42, 46, 48, 58, 60, 61, 63, 68, 75, 83: n = A,T,C or G
cgatcgcatcaacgcggcntgtgccnttttcccgctggtcanaggnantcgcatttcncnntntggtntcggctntcacgagnggcagcgagtgaatgcc

SEQ ID NO: 8922 - DNA, 105 bp, Homo sapiens
  misc_feature 15, 24, 34, 56, 67, 68, 70, 83: n = A,T,C or G
cacgatcgcatccancggcgggcntggtgccctnttgcccgctggtcacaggaaancgcatttcacnntntggtgttcggctntcaccagcggcagcgagtgaat

SEQ ID NO: 8923 - DNA, 117 bp, Homo sapiens
  misc_feature 4, 6, 36, 38, 39, 41, 54, 60, 61, 77, 84, 89, 91, 94, 95,96, 98: n = A,T,C or G
gccntnttgccgctggtcacaggacaacgcatttcncnntntggtgttcggctntccgannggcagcgagtgaatgngcgatcnttctntnacnnncncacgccggcgcacctgtga

SEQ ID NO: 8924 - DNA, 100 bp, Homo sapiens
  misc_feature 9, 23, 29, 42, 51, 54, 60, 61, 70, 74, 91, 93, 94, 96, 98: n = A,T,C or G
acctgtctnttacgatgcgcaangtagtnccggatttgtccntgtggtcgnaanattagnnttccagccngtgncactgccattttcgctncnngngnaa

SEQ ID NO: 8925 - DNA, 100 bp, Homo sapiens
  misc_feature 4, 22, 31, 37, 38, 43, 46, 57, 61, 62, 64, 65, 66, 74, 75,80, 83, 89, 99: n = A,T,C or G
tttnacacgtgtgttggagaanataggattncagacnngtgantgngcgattttcgntacnngnnnaagccggnngcatntgngacacnccattaaacng

SEQ ID NO: 8926 - DNA, 100 bp, Homo sapiens
  misc_feature 9, 11, 12, 14, 21, 27, 35, 39, 41, 51, 56, 61, 65, 67, 68,69, 76: n = A,T,C or G
cgcatttcncnntntggtgtncggctntcacgatnggancnagtgaatggncgatnttctntaanannncacgccngtcgcacctgtgataccccataaa

SEQ ID NO: 8927 - DNA, 100 bp, Homo sapiens
  misc_feature 2, 4, 7, 10, 15, 16, 18, 19, 21, 24, 27, 30, 38, 39, 43,48, 49, 53, 54, 56, 69, 71, 72, 73, 74, 76, 77, 78, 86,87, 90, 95, 96: n = A,T,C or G
antnccncgnttttnncnntntgntgnganaaattagnnttgncagcnngtgnnangggccattttcgntnnnngnnnaagccgtnnatnttagnngacg

SEQ ID NO: 8928 - DNA, 103 bp, Homo sapiens
  misc_feature 28, 31, 39, 42, 79, 80, 82, 90: n = A,T,C or G
tttcacgcataggcatccagacggcggngcntggcgccntanttgcccgactggtgcacaggaagaacgcattttcacnntntggtagtncggctgtcacgca

SEQ ID NO: 8929 - DNA, 170 bp, Homo sapiens
  misc_feature 2, 8, 34, 35, 36, 38, 61, 88, 89, 109, 116, 135, 150, 161,166: n = A,T,C or G
tnttgccngctggtcacaggaaaacgcatttcannntntggtagttcggctgtcacgcagngtgcagcgagttgcaatgcccggttcnntattgaacgacgcattcacntgttgcnccctggtgataccccatancacagtgggaaatgntgctgctctcncctgntcgc

SEQ ID NO: 8930 - DNA, 108 bp, Homo sapiens
  misc_feature 8, 14, 30, 32, 33, 35, 47, 76, 79, 80, 81: n = A,T,C or G
ttcccgcnggtcanaggaaaacgcatttcncnntntggtgtcggctntccgacggcagcgagtgaatggccgattnttnnnaacaccacacaccctgcgccctgtgat

SEQ ID NO: 8931 - DNA, 100 bp, Homo sapiens
  misc_feature 2, 3, 29, 37, 50, 60, 72, 74, 77, 80, 85, 92, 99: n = A,T,C or G
gnntttttcacgatagcaatcaacgccgnttagctgncgttttgccgctngtcacaagtncaacgcatttcncnatntgntgtgngaatttncgattgnc

SEQ ID NO: 8932 - DNA, 100 bp, Homo sapiens
  misc_feature 5, 11, 29, 32, 35, 39, 41, 43, 49, 53, 55, 56, 60, 61, 72,74, 75, 83, 84, 87, 93: n = A,T,C or G
ccggncgcagnaacgcctttacctgtctnttncgntgcncnanaaagtnccgngnntttnncgcatgtggtngnnaaattagnnttncagccngtggcac

SEQ ID NO: 8933 - DNA, 133 bp, Homo sapiens
  misc_feature 2, 10, 45, 46, 48, 61, 76, 99, 118, 121, 122: n = A,T,C or G
cntggcgccnttttgcccgctggtcacaggaaaacgcatttcacnntntggtgttcggctntcacgcagcgtgcancgagtgcaatggccgattcattngaaacgacgcacacacccngtnngccctgtgata

SEQ ID NO: 8934 - DNA, 100 bp, Homo sapiens
  misc_feature 2, 10, 11, 17, 24, 26, 27, 30, 34, 35, 36, 40, 46, 51, 52,53, 62, 67, 71, 72, 73, 75, 76, 85, 86, 88, 95, 99: n = A,T,C or G
cncgcatttnncgcgtntgtgtgngnnaanttannnttgncagccngtggnnntgggccatnttcgntaannngnncaagccgtnnanattagcngggnt

SEQ ID NO: 8935 - DNA, 100 bp, Homo sapiens
  misc_feature 10, 12, 13, 23, 37, 44, 61, 66, 68, 71, 74, 76, 80, 94: n = A,T,C or G
acgcatttcncnntttggtgtgngaatatacgcattnccagccnagtggaacgcgcgatcnttcgntnacntgnanaagnccgatcacactcanagagct

SEQ ID NO: 8936 - DNA, 100 bp, Homo sapiens
  misc_feature 3, 5, 7, 21, 38, 40, 59, 73, 82, 83, 89, 91: n = A,T,C or G
canantntggtagtcgggctntcaccagcggcaacgantnaatgcgccgatcagtaatngaacagccattcanccgttgccnngtctgnancccgcacaa

SEQ ID NO: 8937 - DNA, 102 bp, Homo sapiens
  misc_feature 5, 12, 28, 32, 38, 44, 57, 68, 76, 82, 92: n = A,T,C or G
tgggntggcccngcttaacttttgcccncganctcggngttcgnacaggggcgaagnaaaccgccaanttttttcnaacccnacttgttttnggttttagtt

SEQ ID NO: 8938 - DNA, 100 bp, Homo sapiens
  misc_feature 4, 17, 19, 20, 22, 25, 29, 41, 72, 75, 76, 78, 79, 89, 95: n = A,T,C or G
cagnacaacgcatttcncnntntgntggngaatatacgatngccagacgagtgaatgggcgatcattcgatnacnngnntaagcacganaaactnagctg

SEQ ID NO: 8939 - DNA, 112 bp, Homo sapiens
  misc_feature 7, 15, 30, 31, 42, 46, 51, 53, 60, 66, 75, 76, 78, 79, 81,85, 108: n = A,T,C or G
tcatcgnacgcctanccacagcctttttannagtccgtttangcangcctnangaacagncaccancgcatttanncnntnctgngtgagagaaattataggcattgncaga

SEQ ID NO: 8940 - DNA, 101 bp, Homo sapiens
  misc_feature 4, 9, 29, 30, 34, 43, 56, 68, 71, 95: n = A,T,C or G
gccnttacntgtctattacgatgcgcaannagtnccatgattngtccgtgctggtngaaaaattaggnttncagcctgcgtcactgccattttcntcaaat

SEQ ID NO: 8941 - DNA, 100 bp, Homo sapiens
  misc_feature 2, 38, 39, 40, 41, 56, 63, 74, 82: n = A,T,C or G
cngtgcccgactggttcacaggcaagaacgcatttcannnngtggtgtcgggcttntcaccancggcagcgagntgcaatgnccgatcagtccagaacac

SEQ ID NO: 8942 - DNA, 118 bp, Homo sapiens
  misc_feature 10, 13, 14, 16, 18, 20, 28, 43, 59, 80, 82, 84, 89, 94, 104,116: n = A,T,C or G
cgcaatttanacnntntngntagtgagnaatatagcgcattgncagacgagtggaatgngcgcattcatttcgataacgngngnagagnccggntaatattcgntggagcttcctnaa

SEQ ID NO: 8943 - DNA, 100 bp, Homo sapiens
  misc_feature 7, 11, 34, 35, 51, 59, 60, 65, 72, 79, 86: n = A,T,C or G
gtcttantagnccgattcttagcctcgactcagnncacaggcacgaaccgnaatttttnnccccntgtttgngtagtgnagacatnataacgcatctgcg

SEQ ID NO: 8944 - DNA, 100 bp, Homo sapiens
  misc_feature 3, 21, 27, 28, 38, 47, 50, 53, 61, 73, 78, 83, 85, 97: n = A,T,C or G
agnacgcctttacagctttangatgcnngagagagtancggatttgnccntgntggtgganaaattagggttncagcntgtgnantgccattttcgntaa

SEQ ID NO: 8945 - DNA, 100 bp, Homo sapiens
  misc_feature 21, 25, 29, 33, 39, 40, 42, 57, 66, 67, 68, 70, 73, 85, 94,95, 96: n = A,T,C or G
agcctatccagacggcgggcntggncgcnctanttgccnncncggtcacaggaaaangcatttcannntntgntagttcggcgtntcacgcagnnngcag

SEQ ID NO: 8946 - DNA, 106 bp, Homo sapiens
  misc_feature 5, 13, 28, 37, 48, 50, 53, 58, 61, 72, 83, 92, 98, 105: n = A,T,C or G
atttngttgcacnttttgcccgctggtnacaggaaangaatttcacantntgntagtnggngtatcacgcancggcagacaantgcaatgcncgatcnttccatna

SEQ ID NO: 8947 - DNA, 100 bp, Homo sapiens
  misc_feature 37, 39, 52, 95: n = A,T,C or G
gttttgcccgctggtcacaggaaaacgcatttcacantntggtgttcggctntcacgcagcgtgcagacgactgcaatggccgattcatttccanaacgg

SEQ ID NO: 8948 - DNA, 117 bp, Homo sapiens
  misc_feature 12, 34, 41, 44, 49, 70, 72, 78, 81, 95, 104, 108: n = A,T,C or G
tggtgtcggctntccgagcggcagtcgagttgantgcccgnttngtaangatcacacattcactccgttncncgccgnganaccccgcaaaacanacggggaanttgncctcttcct

SEQ ID NO: 8949 - DNA, 100 bp, Homo sapiens
  misc_feature 6, 7, 28, 33, 48, 58, 59, 70, 92, 93, 95: n = A,T,C or G
tttgcnngcccgtatctatgccggactngagtnacaggaagatcgcantttccacacnngttgggtagtncgggcttgttcaccagcgtgcnncnaactg

SEQ ID NO: 8950 - DNA, 110 bp, Homo sapiens
  misc_feature 6, 7, 8, 9, 13, 21, 23, 25, 31, 48, 49, 53, 56, 57, 74, 93,95: n = A,T,C or G
tttccnnnntggngtcggctntncnacgganccagtgaatgccgattnntccnacnnccattcacccgttgccnctctgatgcccctcaaaananaggagaatatgttat

SEQ ID NO: 8951 - DNA, 100 bp, Homo sapiens
  misc_feature 2, 14, 37, 39, 40, 53, 60, 69, 87, 88, 92, 93, 97, 99: n = A,T,C or G
tnttgcccgctggncacaggcacgatcgcatttcacnanntggtgttcggctntccgcancgtgcagcnagtgcaatggccgattcnntccnnaacngnc

SEQ ID NO: 8952 - DNA, 100 bp, Homo sapiens
  misc_feature 8, 21, 34, 35, 38, 51, 66, 81, 84, 85, 87, 89, 95: n = A,T,C or G
ttttgccngctggtcacaggnaaacgcatttcannctntggtagtcggctntcacgcagcgtgcancgagtgaatgcccgnttnntnangacgancattc

SEQ ID NO: 8953 - DNA, 100 bp, Homo sapiens
  misc_feature 4, 25, 27, 62, 65, 66, 71, 72, 74, 75, 76, 94, 98: n = A,T,C or G
actngctcagggaaccctttacctncnttacgatgcgcaaagtagataccgtgattagcgcnganngtcgnnannntaggtttccagcctgcgncacncg

SEQ ID NO: 8954 - DNA, 100 bp, Homo sapiens
  misc_feature 9, 18, 28, 33, 34, 44, 51, 55, 60, 61, 64, 70, 73, 75, 80,85, 87, 88, 96: n = A,T,C or G
cctttaccngtctattangatgcgcaangtagnnccatgaattnagtcgcngctngtcgnnaangtaggnttncngaccntgtcncnntcgccatnttcg

SEQ ID NO: 8955 - DNA, 100 bp, Homo sapiens
  misc_feature 3, 22, 31, 43, 45, 48, 64, 66, 69, 77, 82, 83, 85, 86, 94: n = A,T,C or G
tcncgatcggcatcgacgccgnttagagccnttttgcccgctngnganaggacaacgcatttcncnctntggtgtgngactnntnncgcattgncagcaa

SEQ ID NO: 8956 - DNA, 100 bp, Homo sapiens
  misc_feature 14, 19, 51, 56, 64, 66, 67, 77, 97: n = A,T,C or G
caacgcaggttagntgctnttttgccgctggtcacaggacaacgcatttcnccatntggtgtgngnntatccgattncagccagtgaatgggcgatnttc

SEQ ID NO: 8957 - DNA, 100 bp, Homo sapiens
  misc_feature 6, 11, 46, 47, 49, 62, 69, 74: n = A,T,C or G
cttgcncgccnttttgcccgctggtcacaggacaacgcatttcacnntntggtgttcggctntcacgcngcganagacgagtgcaatggccgatcatttc

SEQ ID NO: 8958 - DNA, 100 bp, Homo sapiens
  misc_feature 13, 24, 30, 46, 50, 51, 64, 65, 67, 79, 87, 91, 95: n = A,T,C or G
ttttccgatcgcntcaacgcggcntgtgcnttttcccgctggtcanaggnnaacgcatttcacnntntggtgtcggctntcacgagnggcncgantgaat

SEQ ID NO: 8959 - DNA, 100 bp, Homo sapiens
  misc_feature 12, 27, 38, 39, 41, 47, 55, 64, 65, 66, 67, 69, 73, 75, 83,92, 97, 99: n = A,T,C or G
gatgggatacancggcgtttttgttgnacgttttgccnncnggttanaggaaaangcaatttcnnnntnttgntnttgggctntcagcagtntgagncna

SEQ ID NO: 8960 - DNA, 100 bp, Homo sapiens
  misc_feature 11, 23, 27, 29, 31, 33, 36, 46, 52, 56, 64, 65, 68, 70, 78,79, 81, 82, 83, 88, 92, 98: n = A,T,C or G
ttttcacggangcagcaacgccnttancngncnttncgacgctcgngacagnaccncgcatttnnccntntgtgtggnnannntaggnttgncagccngt

SEQ ID NO: 8961 - DNA, 100 bp, Homo sapiens
  misc_feature 8, 9, 10, 12, 33, 62, 65, 80, 86, 88, 91, 95, 96, 99: n = A,T,C or G
aatttcannntntggtagtcggctgtcagcagngtgcagacgaactgcaatggccggttcangtnatgaacgacgcatcnccagcncngtngccnngtng

SEQ ID NO: 8962 - DNA, 130 bp, Homo sapiens
  misc_feature 4, 10, 29, 49, 50, 54, 57, 76, 95, 96, 104, 107, 125: n = A,T,C or G
tggncgcccntatttgcccgctcggtgcncaggaagaacgcaatttcannctcntgntagttcggctgtcaccagnggcagacgagttgcaatgnncgattcanttnatgaacgacgcatctccncccgt

SEQ ID NO: 8963 - DNA, 100 bp, Homo sapiens
  misc_feature 4, 8, 36, 56, 60, 70, 71, 72, 73, 74, 96: n = A,T,C or G
cgcnaggnatccagacggcggggctggtcgccctanttgcccgctcggtcacaggnagancgcatttcannnnntggtagttcggctgtcagcagngtgc

SEQ ID NO: 8964 - DNA, 100 bp, Homo sapiens
  misc_feature 2, 8, 31, 43, 45, 47, 55, 56, 57, 67, 73, 75, 97: n = A,T,C or G
gnatcacnggcgttttggtgccctatttgcngctggtcgaggnanangcatttcnnnctgtggtgtncggctntncgagtggcagcgagtgagtggncgg

SEQ ID NO: 8965 - DNA, 117 bp, Homo sapiens
  misc_feature 2, 16, 32, 33, 34, 35, 37, 58, 59, 71, 81, 82, 96, 100, 109: n = A,T,C or G
tnttcccgctggtcanaggaaatcgcatttcnnnntntggtgtcggctgtcacgcagnngcagcgagtgantgcccggttnntaatgaacgaccantcantcgttgccnctgtgata

SEQ ID NO: 8966 - DNA, 100 bp, Homo sapiens
  misc_feature 10, 22, 29, 31, 45, 61, 62, 63, 64, 66, 86: n = A,T,C or G
ctgatcgcantcaacgcaggcntgtgccntnttcccgctggtcanaggaaatcgcatttcnnnntntggtgtcggctgtcacgagnggcagcgagtgaat

SEQ ID NO: 8967 - DNA, 100 bp, Homo sapiens
  misc_feature 13, 28, 32, 46, 47, 49, 61, 67, 75, 82, 88, 93, 94, 97: n = A,T,C or G
cgcggcttgtgcnttttcccgctggtanaggngatcgcatttcacnntntggtgtcggctntccganggagcgantgaatgncgatcnttccnnacncgc

SEQ ID NO: 8968 - DNA, 100 bp, Homo sapiens
  misc_feature 13, 27, 32, 43, 53, 56, 65, 68, 70, 73, 77, 80, 85, 88, 90,97: n = A,T,C or G
ttttcccgatcgnatcaacgcgttagntgccnttttgccgctngtcacaagtncancgcatttcnccntntgntgtncgnctatncgntngacagcnagt

SEQ ID NO: 8969 - DNA, 105 bp, Homo sapiens
  misc_feature 15, 22, 31, 45, 61, 63, 64, 66, 79, 88, 94: n = A,T,C or G
cacgatcgcatcagncgcggcntgtgccctnttcccgctggtcanaggaaaacgcatttcncnntntggtgttcggctntcacgcagngtgcancgagtgaatgg

SEQ ID NO: 8970 - DNA, 100 bp, Homo sapiens
  misc_feature 11, 15, 29, 39, 43, 49, 53, 71, 73, 77, 83, 96, 97: n = A,T,C or G
ctggcccaggnaacncctttacctgtctnttacgatgcncaanggagtnccgngatttgtccgtgctggtngnaaanttaggnttccagcctgtgnnact

SEQ ID NO: 8971 - DNA, 107 bp, Homo sapiens
  misc_feature 13, 31, 33, 43, 49, 62, 73, 77, 85, 93, 95, 98: n = A,T,C or G
caccgcataggcnatccagacgggcggggcntnggtcgccccntatctnttgcccgactcgngtgcacagggnaaanccgcaatntttcaccncntcntttggttag

SEQ ID NO: 8972 - DNA, 100 bp, Homo sapiens
  misc_feature 23, 29, 31, 33, 48, 54, 64, 65, 66, 67, 69, 91: n = A,T,C or G
ctgatcgcattcaacgcagggcntggtgncntnttgcccgctggtcanaggaantcgcatttcnnnntntggtgttcggctgtcacgcagnggcagcgag

SEQ ID NO: 8973 - DNA, 100 bp, Homo sapiens
  misc_feature 21, 22, 28, 32, 65, 67, 68, 70, 77, 83, 92: n = A,T,C or G
cacgatagcatcagacggcgnncttggngccnttttgcccgctggtcacaggacaacgcatttcncnntntggtgtncggctntcacgcatnggcgcgag

SEQ ID NO: 8974 - DNA, 100 bp, Homo sapiens
  misc_feature 3, 20, 29, 37, 43, 47, 49, 59, 61, 62, 64, 77, 85: n = A,T,C or G
ccnatcgattcaacgcggcntgtgccctnttcccgcnggtcanaggnantcgcatttcncnntntggtgttcggctntcacgagnggcagcgagtgaatg

SEQ ID NO: 8975 - DNA, 125 bp, Homo sapiens
  misc_feature 1, 9, 31, 32, 34, 38, 42, 80, 81, 83, 95, 97, 104, 112: n = A,T,C or G
nttttttcncgcataggcatccagacggcgnncntggngccntatttgcccgctggtgcacaggaaaacgcaatttcacnntntggtagttcggntntcacgcngcgtgcancgagttgcaatgg

SEQ ID NO: 8976 - DNA, 111 bp, Homo sapiens
  misc_feature 5, 16, 32, 34, 35, 37, 40, 50, 57, 62, 73, 80, 86, 93, 95,100, 104: n = A,T,C or G
ttttnccgctggtcanaggaaatcgcatttcncnntntgntgttcggctntccgagnggcancgagtgaatgnccgattnttattnaacaccncncgccntgtngccctgt

SEQ ID NO: 8977 - DNA, 108 bp, Homo sapiens
  misc_feature 23, 31, 39, 65, 66, 67, 69, 82, 91: n = A,T,C or G
cacgatagcatcaacggcgggcntggtgccnttttgccngctggtcacaggaaaacgcatttcannntntggtagtcggctntcacgcagngtgcagcgagtgcaatg

SEQ ID NO: 8978 - DNA, 100 bp, Homo sapiens
  misc_feature 23, 24, 31, 33, 35, 43, 54, 57, 75, 83, 95, 98: n = A,T,C or G
cggctaaaggcctaattccccannaggggcngngntctttggngtcggccccgnttntttttgccccggactcgnggtttcgnccagggggaagnaancg

SEQ ID NO: 8979 - DNA, 100 bp, Homo sapiens
  misc_feature 6, 7, 10, 12, 16, 20, 22, 29, 32, 38, 40, 42, 46, 57, 59,60, 61, 62, 64, 70, 73, 74, 75, 85, 87, 89, 99: n = A,T,C or G
gatttnnccntntgtnggananattaggnttncagccngngncacngccgttttcgntnnnngngtaagncgnnnatacttagcngngntccttaatcng

SEQ ID NO: 8980 - DNA, 100 bp, Homo sapiens
  misc_feature 19, 21, 37, 41, 51, 52, 54, 60, 62, 63, 72, 78, 79, 82, 95,96, 97: n = A,T,C or G
ccagaaagaaaagaaaagngnagttttttcaccgagnagcnagcgtttagnngncgttangnngctggaaanaggagnnganttcacaatttgannnaga

SEQ ID NO: 8981 - DNA, 100 bp, Homo sapiens
  misc_feature 13, 18, 31, 34, 38, 50, 65, 69, 72, 77, 93, 99: n = A,T,C or G
aacggttttacgntgtcnttattgaccgctnagngagnacaacgaatttnacaatttgtgtgganaaantangattncagacgagtggaatgngcgatnt

SEQ ID NO: 8982 - DNA, 100 bp, Homo sapiens
  misc_feature 12, 13, 41, 49, 58, 64, 68, 72, 74, 76, 87: n = A,T,C or G
agcatcacacgnnttttagtgcccttttgcccgctggtganaggagaangatttcacnctttgntagncggntntnagcatgccagncagtgaatgccga

SEQ ID NO: 8983 - DNA, 100 bp, Homo sapiens
  misc_feature 4, 5, 10, 18, 25, 27, 31, 36, 37, 56, 58, 60, 61, 62, 64,66, 74, 75, 76, 77, 81, 87: n = A,T,C or G
tttnnccatntgttgtgngaattangnttgncagcnngtgaatgggcgattttcgntnannngngnaagccggnnnnattngtgacnctccttaaacagt

SEQ ID NO: 8984 - DNA, 100 bp, Homo sapiens
  misc_feature 15, 22, 32, 38, 54, 56, 57, 59, 66, 70, 72, 78, 79: n = A,T,C or G
cgcatcgacgcggcntgtgccnttttcccgcnggtcanaggacaacgcatttcncnntntggtgtncggntntccgannggcgcgagtgaatgggcgatc

SEQ ID NO: 8985 - DNA, 153 bp, Homo sapiens
  misc_feature 4, 8, 29, 43, 44, 46, 57, 59, 84, 98, 115, 117, 118: n = A,T,C or G
tggngccnttttgcccgctggtcacaggnaaacgcatttcacnntntggtgttcggntntcacgcacggcagcgagtgcaatgnccgattcattcttnaacgacgcacacacccngnngccctgtgaaacccataaacagtgggaaatggtgc

SEQ ID NO: 8986 - DNA, 100 bp, Homo sapiens
  misc_feature 4, 5, 10, 17, 18, 21, 27, 30, 36, 40, 44, 55, 58, 59, 62,64, 72, 73, 79, 81, 82, 84, 86, 88, 96: n = A,T,C or G
tttnnccatntgttggnnaanttaggnttncagccngtgnatgngccattttcgntanntgngnaagccgtnnatattngnngngntncttaatcngtgt

SEQ ID NO: 8987 - DNA, 256 bp, Homo sapiens
  misc_feature 27: n = A,T,C or G
gaacaataagctggagcctcgcgcgcntgaggtcgacactagtggatccaaagaattcggcacgagtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggcaggcgagccccaccccggc

SEQ ID NO: 8988 - DNA, 400 bp, Homo sapiens
  misc_feature 16, 26, 30, 34, 386: n = A,T,C or G
cgaaccataatgctgnagcctcgccncccntgcnggttcgacactagtggatccaaagaattcggcacgagctaatgtgaggataatcttacagatattataggaatttcttttctatctttatgaaaacaacgtatataaaatatatctagaaaacctttgtttgagactcttatttaatgggcttttgattctaatgataattgtacctttatctttcaaaagctgatatttcctacctaagcatctcccgagaaaaatatctcattaaaaagcccataaataataggggagaagaaagccttaggtatcaattccaaaacagtgattgaaatttcccaaaataattatggcttctgtcatctccagagataatctggcttggnttaccccataatct

SEQ ID NO: 8989 - DNA, 400 bp, Homo sapiens
gaacaataagctggagctccgcgcgcttgcaggtcgacactagtggatccaaagaattcggcacgagatcttatcttgtgaatttttgttaatgtattatacgagctatatttttcatttgcccagaaagacagcttgtataacgcttttggaagtttctgctctgtaatgtctttagagctgacagtctgttaggtttgtttttttcttcatgctaaagtgtcaagttggtggttttgtgaactggtcaaaaattcacaggtcttaaatgttttgggggaaatttatattggacactgctctttgtctagcaaataaaagatgttaatatattcctgttactggcatgtgcaccgactatgttattagaagccactttatcattttcctgctttaaata

SEQ ID NO: 8990 - DNA, 317 bp, Homo sapiens
  misc_feature 146, 161, 215, 239, 305: n = A,T,C or G
tgcaggtcgacactagtggatccaaagaattcggcacgagctcgtgccgaattcggcacgaggaggaacccaagtagctttgtggcttcgtgtccaaccctcttgcccttcgcctgtgtgcctggagccagtcccaccacgctcgngtttcctcctgtagngctcacaggtcccagcaccgatggcattccctttgccctgagtctgcagcgggnccctttttgtgcttccttcccctnaggtagcctctctccccctggcccactcccggggggagggggtacccctttcccagggtttttatncctgggggcctc

SEQ ID NO: 8991 - DNA, 285 bp, Homo sapiens
  misc_feature 21, 23, 280: n = A,T,C or G
gacaataagctggagctcgcncncttgaggtcgacactagtggatccaaagaattcggcacgagtgacagctggtgcgcctgccccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgacttcaaccctcgcttcaacgcccacggggacccaaanaccat

SEQ ID NO: 8992 - DNA, 153 bp, Homo sapiens
  misc_feature 6, 101, 121: n = A,T,C or G
tttagntgggacactagtggatccaaagaattcggcacgagctgtcagggagggccagggaggcagagggggagggagtctcaggaggaggctgccctganggtctggggagggggtaccntcatgaggaccagggtggagcctgagaagagg

SEQ ID NO: 8993 - DNA, 100 bp, Homo sapiens
  misc_feature 3, 26: n = A,T,C or G
ganaataagctggagcctcgcgcgcntgcaggtcgacactagtggatccaaagaattcggcacgagacacagtgaagcaaattaaaaaaaaaaaaaaaaa

SEQ ID NO: 8994 - DNA, 400 bp, Homo sapiens
  misc_feature 3, 124, 129, 140, 215, 224, 282, 353, 377: n = A,T,C or G
ganaataagctggagctccgcgcgcttcgaggtcgacactagtggatccaaagaattcggcacgagccccaatgcagctaggatagtgttgcggctataattttgtgtttttttttttaattgnctagncttaaatttgnacatcttgtataaaatatgaatgtttcccaaataaactatgaatgtttcctgtataatatatgaatgtttctganaagaaactntaaatagttgaaaggctaacctgctcaaaggataccaaataatggtttaactggccancctgaaaattagcatagaaaacaatcctttgttatattttagggatccacaaggattgagaaaatattatntaggttagataataacattcttgnctactttatcctggctgggtaca

SEQ ID NO: 8995 - DNA, 386 bp, Homo sapiens
  misc_feature 24: n = A,T,C or G
gaaaaagctggagctcgcccgccntgaggtcgacactagtggatccaaagaattcggcacgagctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactgcagtggccagtgcccttgtcctccagataccactgagcctcttgcccatgattcagagctttcaaggataggctttattctgcaagcaatacaaataataaatctattctgctgagag

SEQ ID NO: 8996 - DNA, 385 bp, Homo sapiens
  misc_feature 3, 7, 188: n = A,T,C or G
gcncctngaaggtcgacactagtggatccaaagaattcggcacgaggaactatgctgccttcacaaagaaccagaaggaccctggtgtccttgaccgcatgatgaagaaactggacaccaacagtgatggtcagctagatttctcagaatttcttaatctgattggtggcctagctatggcttgcctngactccttcctcaaggctgtcccttcccagaagcggacctgaggaccccttggccctgcccttcaaacccaccccctttccttccagccttttctgtcatcatctccacagccacccatcccctgagcacactaaccacctcatgcaggccccacctgccaatagtaataaagcaatgtcactttttttaaaacatg

SEQ ID NO: 8997 - DNA, 315 bp, Homo sapiens
  misc_feature 3, 5, 60, 64: n = A,T,C or G
tgngncccttgaggtgcgacactagtggatccaaagaattcggcacgaggggagctctgntctnagcttgcacactgctgagagcacccactgtcctgaccagagtctcagtggtcctgacccccaatgtgggcagggcctggcaaggagggtggggtctgctgtgggttcagaggactccacctcctggctggtttacctgctgctgcccattttctctgggactgctggccagaggactttagcctacccctgaagagcctgtccatgtcattttcctactgcatagataccctaagcccagggccccttgag

SEQ ID NO: 8998 - DNA, 216 bp, Homo sapiens
  misc_feature 4, 19, 78, 79, 150, 202: n = A,T,C or G
cganaaaagctggagctcngcgcgccttgaggtccgacactagtggatccaaagaattcggcacgagcggcacgagtnnggaccccagcccctcccctactttttggtcagctacgtctctagaataagatggtatctgaagtccttccnaaaaaaaaaaaaaaaaaaaaaaaaaaaaaaaaaaaaaaaaaaaaaaaaaaanaaaaaaaaaaaaaa

SEQ ID NO: 8999 - DNA, 335 bp, Homo sapiens
  misc_feature 25, 322, 327, 328: n = A,T,C or G
aaaataagctggagcttcgcgcgcntgaaggtcgacactagtggatccaaagaattcggcacgagtccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcagctcctttaacgctaatatttccggcaaaatcccatgcttgggttttgtctttaaccttgtaacgcttgcaatcccaataaagcattaaaagtcaaaaaaaaaaaaaaaaanttggnnagttctt

SEQ ID NO: 9000 - DNA, 311 bp, Homo sapiens
  misc_feature 141, 273: n = A,T,C or G
gacaataagctggagctcgcgcgcttgcaggtcgacactagtggatccaaagaattcggcacgagcagcagtaccaggatgccaccgagaagaggaggaggatttcggtgaggaggccgaagaggaggcctaaggcaggancccccatcacctcaggcttctcagttcccttagccgtcttactcaactgccccttttcctctccctcagaatttgggtttgctgcctctatcttgttttttgttttttcttctggggggggtctagaacagngcctggcacattaggaaggcgctcaataaatactggtt

SEQ ID NO: 9001 - DNA, 400 bp, Homo sapiens
  misc_feature 280: n = A,T,C or G
gaaaataagctggagctcgcgcgcttgagggtcgacactagtggatccaaagaattcggcacgagagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccaccctgcaagatggacacgagccacaagctgcactgtgaacctgggcactccgcgccgatgccacccggcntgtgggtctctgaagggacccccccccaatcggactgccaaattctccggtttgccccgggatattttagaaaattatttgtttgaataatgaaaataaaacacacctcgggcaaaaaaa

SEQ ID NO: 9002 - DNA, 400 bp, Homo sapiens
  misc_feature 2: n = A,T,C or G
angaacaataagctggagctcgcgcgccctgcaggtcgacactagtggatccaaagaattcggcacgagttgaaacatctgcgtctcagcgttgaattcgaagcaaatgatttacaggggggatctgtaggcagtgtccgacttaaatacaagttccaaagacaatgatgagaagattgtgcagaatgctatcatccaaacaataggattttttggaagtaacctaccagattatcagaggtcagaaatcatgatgttcattatgggggaaagtacctgtctttggaacatctacccatactttggatatcagtcaactaggggatttgggaaccaggagaattcagataatgttgctgagatctttgcttatggggacctctggatataaagcgaagac

SEQ ID NO: 9003 - DNA, 100 bp, Homo sapiens
  misc_feature 17, 22, 88, 91, 98: n = A,T,C or G
aataagctggagctccnccgcnccttcgcaggtcgacacctagtggatccaaagtaattcggcacgagctcgtgggcgtatggcgaancantccctcnct

SEQ ID NO: 9004 - DNA, 284 bp, Homo sapiens
acaataagctggagcttcgcgcgcctgaaggtcgacactagtggatccaaagaattcggcacgaggaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtaaaa

SEQ ID NO: 9005 - DNA, 400 bp, Homo sapiens
  misc_feature 4, 24, 28, 185, 266: n = A,T,C or G
gacnaaatgctggagccccgcgcnctgnggtgccgacactagtggatccaaagaattcggcacgaggtaagattgacaagtatgtaaacaaataatttcagtattttggaataagtataatatagaaataagaggtaggtgtggtatgggtgggtcgaaggtggcagtggttaataaactctggngggcccaaagaaggcttcacagagtaggcaatgcttgagctgctaggctatctcaaagattgtgatatatctttgaacagngttaaccagggaaaatgatcaaaatctatgttctaggaagctcaccctgatgtcatgtgaagatgcatttgagaggtgagagacaagtcaaagggagactttaaaagacaaggcaagagatattgaagatgaag

SEQ ID NO: 9006 - DNA, 260 bp, Homo sapiens
  misc_feature 7, 28, 35, 41, 62, 76, 222: n = A,T,C or G
gaacacntaagtctggagcctcgccgcnccctcgnaggtcngacacctagtggatccaaagnaattcggcacgagnagcaaagtttttatgtgctgtccaaaatggtcttcatgtggtctgacaatttatttttgccatcatttttttaattaaagaaaaaatttccagaagaggaaaaaaaaactacaaaaaacaaaacattgaaggttgatattttatgnggaagaacatttgaattgaattcagaatttttctgaag

SEQ ID NO: 9007 - DNA, 400 bp, Homo sapiens
  misc_feature 5, 10, 58: n = A,T,C or G
gcgcncttgnggtcgacactagtggatccaaagtaattcggcacgaggccggtttgtnctgcagcaatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggacgtgtgatcaccattatgcagaatccacgccagtacaagatcccagactggttcttgaacagacagaaggatgtaaaggatggaaaatacagccaggtcctagccaatggtctggacaacaagctccgtgaagacctgga

SEQ ID NO: 9008 - DNA, 400 bp, Homo sapiens
  misc_feature 225, 293, 368: n = A,T,C or G
cgaacaataagctggagctcgcgcgccttgcaggtcgacactagtggatccaaagaattcggcacgagcttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagnggatcaccaaaccagtccacaagcacagggagatgcgtgggctgacatctgcaggccgaaagagccgnggccttggaaagggccacaagttccaccacactattggtggctctcgccgggcagcttggagaaggcgcaatacntctccagctccaccgttaccgctaatataagt

SEQ ID NO: 9009 - DNA, 400 bp, Homo sapiens
  misc_feature 18, 35, 125, 188, 190, 218, 267, 288, 306, 318, 344, 370,374: n = A,T,C or G
gacaatttgctggagctntgtgaccttgaaggtgngacactagtggatccaaagaattcggcacgagctgagcaaggagtgtgccaaaatctatggctcctaccagtgctactgccgccagggtnacccagctggctgaggatgggcacacctgcacagacatcgacgagtgtgctcaaaggcgccgnantcctctgacctttccgctgtctaaacgngcaagggagctacagtgtgcatgccctgagcaggcttcaccatgacggncaacggaggtcctgaagacgnggatgagtgtgccttggnacccacaactgntccgaggctgagacctgcacaacatncaggtagcttccggtgcctggccttngagngtccctccaactttgtccaagctcca

SEQ ID NO: 9010 - DNA, 400 bp, Homo sapiens
  misc_feature 23: n = A,T,C or G
gacaataagctggagctcgcgcncctgcaggtcgacactagtggatccaaagaattcggcacgaggtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccacttccaattgctggcccgcttcactcctggaaccttcactaaccaagatccaggcagccttccgggagccacggcttcttgtgggtta

SEQ ID NO: 9011 - DNA, 400 bp, Homo sapiens
  misc_feature 2: n = A,T,C or G
gnaaaagctggagctcgcgcgcctgcaggtcgacactagtggatccaaagaattcggcacgagcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgacttgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagcccttcagtccgttgcagaggagcga

SEQ ID NO: 9012 - DNA, 181 bp, Homo sapiens
  misc_feature 134, 169: n = A,T,C or G
aggacaaaagctggagctcgcgccgccttgaggtcgacactagtggatccaaagaattcggcacgagctcgtgccggaaactcctgcgggtctttggcctgaaagttgggaatggttgggggagagaagggcancagcttattgggggtcttttcacccattggcaganacagtgagagct

SEQ ID NO: 9013 - DNA, 100 bp, Homo sapiens
  misc_feature 7, 20, 28, 85, 86, 91, 96: n = A,T,C or G
catttantgaggctgtgtgnccctgagntgggacgtctagtggatccaaagaattcggcacgaggtttttttttttttttttttnnggggnaaaantttt

SEQ ID NO: 9014 - DNA, 177 bp, Homo sapiens
acaataagctggagctcgcgcgcctgcggtcgacactagtggatccaaagattcggcacgagcttgggtgatgggtgacaaaaatttcacaaatcaccactaaagaacttattcacgtaaccaaacaccagctgttccccaatatcctatggaaataaaaaattttttttaaaaaaa

SEQ ID NO: 9015 - DNA, 400 bp, Homo sapiens
  misc_feature 24, 33, 84, 88, 209: n = A,T,C or G
gacaataatgctggagctggtgcncctgaggtncgacactagtggatccaaagaattcggcacgaggctgccagtgcagccacntggnttggaacaccttggggtccctccaccccacagaaccttcaacccagtgggtctgggatatggctgcccaggagacagaccacttgccacgcttgtggtaaaaacccaagtccctgtcattngaacctggatccagcacttggtgaacttgagctgggcagggaagggagaacttgaaacagattcaggccagcccagccaggccaacagcacctccccgctgggaagagaagagggcccagcccagagccaccttggatctatcccctgcggcctccacaccttgaacttgcctaacttaactggcaggggg

SEQ ID NO: 9016 - DNA, 400 bp, Homo sapiens
  misc_feature 2, 11: n = A,T,C or G
angttgggacntctagtggatccaaagaattcggcacgagggctgaccagcctcgctcagcaccttctctcagacccaaggactatgaagttgatgctactctgaagtctctcaacaaccagattgagacccttcttactcctgaaggctctagaaagaacccagctcgcacatgccgtgactttgagactcagccacccagagtggagcagtggttactacctggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccag

SEQ ID NO: 9017 - DNA, 400 bp, Homo sapiens
gacaataagctggagctcgcgcgccctgaaggtccgacactagtggatccaaagaattcggcacgagcaaaatcaacgtataaaaaccagtagcatttctatactccaacagtgaactatctgaaaaataatttaagaatgtaatcccatttacaattgctagaaataaaataaaatgcctaagagtaaatttaaccaaagaagtgatagatctctacaataaaaattataaaatattgatgcaagaaattaggagaagacacaataaaatggaaaaatattccacatttatggattggaagactcaatattgttaaaatgctcatgctacccaaagaaatctacagagccaatgcaatctctgtcaaaataccaatgacattcttcacaaaagtagaaa

SEQ ID NO: 9018 - DNA, 398 bp, Homo sapiens
  misc_feature 19, 25, 32: n = A,T,C or G
aaccataatgctggagctntgtgcncctgagntgcgacactagtggatccaaagaattcggcacgagttgactttcaccaatgggtttatttaaaaggaagcaaattaaacaaaactatggtgataacagcagatgtctagttataattcatttctctaatgctgattaatatattcatgaacaaatcaaatgtattgccaaaagaagaatgctaccattaacaccccagcggctactggtttcagttgtgcttctcaatcaggcaaaatgttctttcttaagctcctatttattttacttcctgacagtctcaaaaataattcatcttgggtgttgtttcctcataaacacttcctggtgcttgattgctttgcctatgtgacatttgacttcaaac

SEQ ID NO: 9019 - DNA, 400 bp, Homo sapiens
gaacaataagctggagctcgcgcgcctgcaggtcgacactagtggatccaaagaattcggcacgagctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatccggaagcacatcatgggccagaatgttgcaggattacatgcgctacttaatggg

SEQ ID NO: 9020 - DNA, 356 bp, Homo sapiens
  misc_feature 29, 299, 311, 338: n = A,T,C or G
gacaaaagctggagctcgcgcgccctgcnggtcgacactagtggatccaaagaattcggcacgagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcnccccatgctgtngattgctaaatgtaacagtctgatcgngacgctgaataaatgtct

SEQ ID NO: 9021 - DNA, 400 bp, Homo sapiens
  misc_feature 171, 175, 226, 232, 304, 391: n = A,T,C or G
gaacaaaaagctggagctccgcgccgcctgcaggtccgacactagtggatccaaagaattcggcacgaggcattctctaaagacttgccaagaggtactgttattatttatacagcagataatgtaattttcatgagaatcaggaattatttagtactatttttattatgnctgntggaaaagagtaagttccagaaatgtgaaaaagcgaaactgaattctgggngagggnacagctgatcttattttttttctaaaatatgacaaataggaaattattgggtgatgggttttcttaatatgnagcaataaaaataggagattatttgggggggaaaaaaatatttttgtcaggacagcaggttgttagttaccatggtttggagactgnttttgactc

SEQ ID NO: 9022 - DNA, 257 bp, Homo sapiens
gacaaaagctggagctcgcgcgcctgcggtcgacactagtggatccaaagaattcggcacgagggaaagaggccttttgtatattgaatcaatttatctgccttctcagtgcatctgtcatattctgaaagattctgggttgatcttttgcgataacctctatggctgtgagtgtgtgtgtgtgtttgtgtattttttaacattttgtataatgattggaggttggtaaaaagtaacacaacagtacttttttaata

SEQ ID NO: 9023 - DNA, 400 bp, Homo sapiens
  misc_feature 3: n = A,T,C or G
gancaataagctggagctcgccgcgcctgcaggtcgacactagtggatccaaagaattcggcacgagcctgtatggtgatatcatatgtaacatttactcctgtttctgctgattgtttttttaatgttttggtttgtttttgacatcagctgtaatcattcctgtgctgtgttttttattacccttggtaggtattagacttgcactttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaaggttccggtctgaa

SEQ ID NO: 9024 - DNA, 400 bp, Homo sapiens
gacaataagctggagctcgcgcgcctgcaggtcgacactagtggatccaaagaattcggcacgagctaccttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctg

SEQ ID NO: 9025 - DNA, 400 bp, Homo sapiens
  misc_feature 69: n = A,T,C or G
gaacaataatgctggagctcgcgcgcctgcaggtcgacactagtggatccaaagaattcggcacgaggngcagtataagcacggacgactgctctccaagcagaccatccagaaccacctgggggaggagctgctgcaggacttgatcaacttctgcctcagctacatggccctgctcaggctgcccaagaagcgtggaaccttcatcgagttccggaatggcatgctgaacatctcgcccatcggccggagctgcaccctggaggagaggatcgagttctccgaactggacaagaaagagaagatccgggagaagttcgtggaagccctgaaaacagagttttgctggcaaagggcctgaggttctctcgaggaggcattgatcagcttttggacgtct

SEQ ID NO: 9026 - DNA, 103 bp, Homo sapiens
acaaaagctggagctcgcgcgcctgcaggtcgacactagtggatccaaagaattcggcacgagagagagagagagagagagagagagagagagagagagagag

SEQ ID NO: 9027 - DNA, 400 bp, Homo sapiens
  misc_feature 24, 395: n = A,T,C or G
gacaaaagctggagctcgcgcgcntgcaggtccgacactagtggatccaaagaattcggcacgagcttggacgctgcagaatggctcccgcaaagaagggtggcgagaagaaaaagggccgttctgccatcaacgaaggggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgccagaaaacgtaatgagggatgaagattcaccaaataagctatatactttnggtta

SEQ ID NO: 9028 - DNA, 400 bp, Homo sapiens
  misc_feature 4, 5, 341, 347, 383: n = A,T,C or G
attnntgggacgctagtggatccaaagaattcggcacgagctctggttgctatcctactccatgggatgaagacgtctgacactattatccgggagggcaccctgatgggcacagccattggcacctgcttcggctactggctgggagtctcatccttcatttacttccttgcctacctgtgcaaccgcccagatcaccatgctgcagatgttggcactgctggcctatggcctcttttgggcattgattgtcctgttcatcacctataatatccaccttccacgcccctcttctacctcttctggctgttggggggtggactgtccacactgcgcatggnagcagngttgggggtctcggaccgtgggccccacacagcggntgctccttttggggcac

SEQ ID NO: 9029 - DNA, 398 bp, Homo sapiens
acaaaagctggagctcgcgcgcctgcaggtcgcactagtggatccaaagaattcggcacgaggttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaa

SEQ ID NO: 9030 - DNA, 262 bp, Homo sapiens
  misc_feature 161, 191, 237, 260: n = A,T,C or G
agaaaaaaagctggagctcgcgcgcctgcaggtcgacactagtggatccaaagaattcggcacgagctcgtgccgaattcggcacgagctaaagctgcactcctatgccacctccatccgtaaggttgtcctgggcatccatggacaatgagaaatatgcncactccggacatcgggggccaagggcacancatttgaagccatccaggacgtcatccgccacattccgcggtaatnaacggccgggccgggggaggccnta

SEQ ID NO: 9031 - DNA, 400 bp, Homo sapiens
gaaaaaagctggagctcgcgcgcctgcaggtcgacactagtggatccaaagaattcggcacgaggcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatat

SEQ ID NO: 9032 - DNA, 400 bp, Homo sapiens
  misc_feature 326, 334, 371: n = A,T,C or G
gaacaaaaagctggagctcgcgcgcctgcaggtcgacactagtggatccaaagaattcggcacgagggaccgcggggcggacgggagcgagtatgtccgctctgactcggctggcgtctttcgctcgcgttggaggccgccttttcagaagcggctgcgcacggactgctggagatggtggagtccgtcatgccggtggtggtgtgcacattgagccccggtatagacagttcccccagctgaccagatcccaggtgttccagagcgagttcttcagcggactcatgtggttctgggattctctggcgctttttggcatgactcanaagagggngctgggtcacttttccgtatccctgatccttcccagnggacagatgaaagaattaaggtatccctt

SEQ ID NO: 9033 - DNA, 395 bp, Homo sapiens
  misc_feature 4, 5: n = A,T,C or G
cttnntgggacgtctagtggatccaaagaattcggcacgagttgcaagcaagtttatcggagtatcgccatgaagttcgtcccctgcctcctgctggtgaccttgtcctgcctggggactttgggtcaggccccgaggcaaaagcaaggaaacactggggaggaattccatttccagactggagggagagattcctgcactatgcgtcccagcagcttggggcaaggtgctggagaagtctggcttcgcgtcgactgccgcaacacagaccagacctactggtgtgagtacagggggcagcccagcatgtgccaggcttttgctgctgaccccaaaccttactggaatcaagccctgcaggagctgaggcgccttcaccatgcgtgccagggggc

SEQ ID NO: 9034 - DNA, 400 bp, Homo sapiens
  misc_feature 2, 12, 32, 62: n = A,T,C or G
cncctcacggtngacactagtggatccaaagnaattcggcacgaggaactatgaggctgtgnttttgtagtgccacccacttccaaaccagctttggtctctcatctggagcaagggaaagagtcctgtttcacccagccacagggagtcctaagcaggaatgactggagagcaggctggataggatacttggaactaagaagatatacttacttagctaaagcagtgttacgtagaatagtatcaaaaatttttcgaaatcgtcaatgctgggaagacaggagaaaagcttaattcttgacatttaaataccagttttccaagtaaggagttgatgtaagagccaccttaaacgatgtcaaatacacattttctttttctgtagactggtagatttaat

SEQ ID NO: 9035 - DNA, 400 bp, Homo sapiens
  misc_feature 19, 24, 201, 396: n = A,T,C or G
gacaataagctggagctcngcgcnctcgcggtcgacactagtggatccaaagaattcggcacgagatgtgattaagactgagggagccactctaagagttctatatacccctggccacactgatgatcacatggctctactcttagaagaggaaaatgctatcttttctggagattgcatcctaggggaaggaacaacggnatttgaagacctctatgattatatgaactctttaaaagagttattgaaaatcaaagctgatattatatatccaggacatggcccagtaattcataatgctgaagctaaaattcaacaatacatttctcacagaaatattcgagagcagcaaattcttacattatttcgtgagaactttgagaaatcatttacagnaatg

SEQ ID NO: 9036 - DNA, 400 bp, Homo sapiens
  misc_feature 21, 26, 109: n = A,T,C or G
gaaaaagctggagctcgcgcnctcgnggtcgcactagtggatccaaagaattcggcacgaggtttggtttggagagtccatggatggtggttttcagtttagctacggnaatcctgaacttcctgaagatgtccttgatgtgcagctggattccttcgacttctctccagccgagcttcccagaacatcacatatcactgcaaaaatagcattgatacatggatcaggccagtggaaatgtaaagaaggccctgaagctgatggggtcaaatgaaggtgaattcaaggctgaaggaaatagcaaattcacctacacagttctggaggatggttgcaccgaaacacactggggaatggagcaaaacagtctttgaatatcgaacacgcaaggcttgtgaga

SEQ ID NO: 9037 - DNA, 225 bp, Homo sapiens
  misc_feature 24, 113: n = A,T,C or G
gacaaaaagctggagctccgcgcnctcgcggtcgacactagtggatccaaagaattcggcacgaggataaagttgcctctcaatccttgccagttattaatttggaatttccngactggagatgtttctaccaacttccaatcttatccctaggccaggttataatagtaaaaagcaaatggtttttatttttattttttttcaagacctccagctaaaaaaaaa

SEQ ID NO: 9038 - DNA, 400 bp, Homo sapiens
gaacaataagctggagctcgcgcgcctgcaggtcgacactagtggatccaaagaattcggcacgaggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaa

SEQ ID NO: 9039 - DNA, 399 bp, Homo sapiens
  misc_feature 385: n = A,T,C or G
gaaaaagctggagctcgcgcgcctgaggtcgcactagtggatcaaagaattcggacgagcttacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggnccttgcccctggaa

SEQ ID NO: 9040 - DNA, 400 bp, Homo sapiens
  misc_feature 21, 23, 28, 33, 69: n = A,T,C or G
gaacaataatgctggagcctngngcgcntgagntcgacactagtggatccaaagaattcggcacgaggnggggtcccagtagcaatagatacaagtcattttcggtggctctatgggtgtgaagccactggcagtttccctggcttgttgtgtaggttaggctgttaggaggcttcctgttcacatgttgctaggactttcctctcacactgtggcagtggtgccagggcagagcattagtagtgggcaggaacacagggaaggctggggccatgcagtgattttttaaatgacagtcctttcagtctacagaaggaagagtgttggagtaagatcagtctcctgggtggttgttagactatgaaaagtactaaaaaaccagagaagacagtggtgttgc

SEQ ID NO: 9041 - DNA, 283 bp, Homo sapiens
  misc_feature 23: n = A,T,C or G
gacaataagctggagctcgcgcncttgaggtcgacactagtggatccaaagaattcggcacgagacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagcccgcaccttgtcatgtaccatcaataaagtaccctgtgctcaa

(The sequence listing continues in the following parts.)

What is claimed is:

1. A method of diagnosing osteoarthritis in a human test subject, said method comprising:
    (a) determining a level of RNA encoded by an asporin (ASPN) gene in a cartilage sample of said test subject; and
    (b) comparing said level with a level of RNA encoded by said gene in control cartilage samples, wherein said control samples are samples of normal cartilage;
    whereby an increase of at least two fold in said level of step (a) relative to said level of RNA in said control cartilage samples is indicative of osteoarthritis in said human test subject.

2. A method of determining whether osteoarthritis may be present in a human test subject suspected of having osteoarthritis, said method comprising:
    (a) determining a level of RNA encoded by an asporin (ASPN) gene in a cartilage sample of said test subject; and
    (b) comparing said level with levels of RNA encoded by said gene in control cartilage samples, wherein said control samples are samples of normal cartilage,
    wherein a determination from step (b) that said gene has statistically significant differential expression between said sample of said test subject and said control samples is indicative of osteoarthritis in said test subject, said differential expression consisting of an increase of at least two fold in expression in said sample of said test subject compared to said control samples.

3. The method of claim 2, further comprising the step of isolating RNA from said cartilage sample of said test subject.

4. The method of claim 2, wherein said determining of said levels of RNA encoded by said gene in said cartilage sample of said test subject is effected using an immobilized probe.

* * * * *